United States Patent 7,868,149 (PLANT GENOME SEQUENCE AND USES THEREOF) - sequence listing, part 13

SEQ ID NO: 6202 - DNA, 12571 bp, Oryza sativa
gccgtttcctccgcaccacacggtcgccaccgctccctccctccacaggccggcgtcgccgctcctccctccgcgagccagcgccacgcggatcccctccctccctccacaagccaccgcggccgccgcaacacctcgcggtcgccgccgccagcactcagagagagagagagatggaatacggggagagacgtagatatggatagggtttggtcgagggtattttggtcattacaaaaattaattgtatttctttcttttttaaaaaatgaaaacttaacagtgttaaaaaacagggccaaacggagtgttcgttttaaaaatgtagggtcaaataagcaaactagaaaaagtagggtcatattggtagttacacttcaaaacagggtcaaataagcaattgtcccatactaaataccatattaacacagccttaacttttgtattcattcaaacggttgtatctatctattgatacattaataaatatattcgtcaaatgaattttttttcagtcgtatagagtatcatgaatatacttctgaaatgattgtaacaaaagttttgatggatagacttaagaggtgattcattacctaatgcatatgtaaaaagccaaactgcctttctaataaataatgtatcatggaggcctgttctcgaataaacacgatcactattacccaacgcccaaaaaatgttaaactctcaacaaaaccgtccaagaagagctgcaatgttttacaagctgatctagaaatcatcccaacacatcgaaaaactgtaatttgtacaagcagattgaggagtgagcaatcgagtaaacgagctaaccatgggcaatgagatcgacacctccgtcttggccttcttggcctcgaggctccagatgcactactcgaaaggtaggccatcacctcatcgtgaggcggcggagatggcatggacgccgggagatccaagctggccagcggcgggggatcccccccatctacgtgcgcctcctcctagtcctgcctcccctgcattgcgtgcactcggacaccgcagcgctgttgagttatgatccaaattcatttgcacttaataaagaccagcttctgccgaagtaaagcggaggcccgtcgccggaggcttgggccacccattgggttctgcggtacggattgtaatacctgttagggtttcacctcatatatatacctcttgtaagccgctgtgcggtgttgtaccctcaccccgatacagtgaagatattttgctggctggcgctagtggtttttttctttcctactttgagaggcttttttcacgttaaatcttgtgtcttctacgattaatctactattctttgtcgtttgtttgcccatcgttttctaacgagcgctgcctctgacttgccactgccgtgttgagcccagtgctgccaagcgccggccaccgcctacatgtgccttcctttccacggacaggctcggcggctcccacgacctgaatggaaggaaggagagggaatttgggatgaagaaggaagaatagagagagagtggaggaagtatgacaggtgggtctttcttttctttgatgcttgggatgccatgtccgattagattggacttaaataggactcaatgtggacttattccaagcagtagcggtagtagtgcaggccttgggccttggcccatgcagcagcaaatagcctagctaggtactcccaatagagcagcaagagctagcaaacagatcggcagcagcagctaaagtttagtcctatttggagagaatgtcaccaacttagaaaactagaaaagagatggatgctgaggatttaacactggttcgaacgatgacgaaaatacggtgttacattgtgggtgtgatctagcaattttaggaaccggtaaaccttagattccacaaataaagaaaaagtcgactcgaaacatgggatgaatcgaccaatgctttgagcaaccccatcaccccaaaacccatcggcatccaagaaaaaaaaatcgcaaaaaataagcatcagctctaatcgagccaatgctttgagcaccccatcaccccaagatccagcagcatccacaaaatcaacatccaagaacaagatcatagaatcaggatcaagaagaaaattgatattcacacatgaaccacaaaaatccatgaacgataaaatccaagaacatggagaggaggacgtcgtagggaaggccaccgtagccaccgcccgccacccaccgtgggtgaagtcgagcttgtggaagccaacggcccatggcgagatggaggccaagggagggaggtaaggcgaagggcatggatgttgaagaggacgtcgagcgagccctgagctcgtggcggctgcatctggccacccctgagtcaccttgtgtggagattatgggtaccgcatacccacacggcatggttatccgactagttatagaggatagcttatatctatggaatatgtaatagatcatgacttgggtattacgtttccttttatattatggagcggcctaaagtcctcatttgataatattgtaaagtagatttaggaaaccgataccgtattggttaaggtttctatcttgtaatcctgcccccatcctatataaggtgggcaggaggccctctagggggcatgagcacatatgatcgtcagatctatactacacccggtggattcaaatccccaaacaggagtagggtattacctctcattgagagggcttgaacctgtctaaatcctttgtctccgcatccatccacttttaggtcccgtgtgctacccccttttattattgccgaattcatgtttcgacaccttgtgagggaagggcaccaccgattgcttggggctcatcaccatggagcaaccggagctcaatgttgatgggccaaccaccccccgcctccccgagctcatgacaacaagatttagccacctccgaagcacgtggatgtcggatctgattgcccctgagccagccgcctgcatggaattatgtttgtcccattttagtttttttttttttgctgaggtcgagtacatggaggttggaggccatggtgttggtggaggcgtttgcttgtggtggttgtgctgtccctattctacaaggatgtttgatcgaattcgggctccagggttataagcagacgacgaagacagtttgtttcaacagatatggagcgaccttgctcaacaagaagcggcgcggctaagggatggatgggtgtggaggggaggcggcaatttggggagggggaggtggggatggggaagagctgacaccaacaccctcgtcactgatgcgctcgctaacggtgtgcaactacgtgttgctacaggcggtggtggttgaggaccggagcccgatgacaaggagctggtgcaatccaagcacccatcacacttgcacccgcaccacctccatgttactgccattggcctgtacacctactcatcctcacactttcctttgccatctacttggtgttgttcctactccatctctctccctaatcggttgatttaggggcgtcagtcagactctggtgagatgttcggcaagcttgcgagatggggattccactagccaggatctagcagcctcaaatcaaatttcttgtcacctcttccttaacgtccttcatcgatccaacaagacaactctttcacgaccatctgagtaccgttgccactatggttatctggattttggattcatctttctatttgtttcttaatagctgcaaccatacatgatttgccatttgggtagagcatggaccacttgtgcaactctagttgacaggattgcattctaagctctttagattcaatggtgaactccgctgaaatcctttgccgagtctgataacgcttatatacaccaaaatctatggctcagcaagaaacctctgctttgagccgtttccgtggagatagccaaaagagattgccagcctgtcaagtggtacacacgttgaatgcggtccaaggatgtcaagtagtatgcatgttgaatgagatccaaggacgtagttgtcgtggcaatgccgtagctccaaatcgacctgctactctactattgtttggtttcattaggaatagattgcttccttagttcagtaaactgagccctccataaagttgcatggttcaatactttcaactaataagtacgacgatgtgttgtgtgtgtgttggggggggggaagggggggtgttaatgtaacctgccccctcaatctgtcatgtgtaataaaaatgttactccctacattctaaaatataggctcaatcacttttaacacaaagaccaattcaaaatttaccttgatgcatataagcaatgtgatcggagggggaaggggttaatggtgtaggatttaaagtgccagtaatatatgcatgcatgcacgtattatattatgagacacgataaaaagtatccgtgacttatatttttgagatggaatgagtatgagttctgaaaataattttaaaaaaataatacagtggcccagccaaatttcccttgacacgcacctaaattaggcgcacccagttatcacaccaaatctgtcagttgagagttaggacctctctggcaagtagacgtggcctaagtgactaaaaggcaatgtatttcttattaattgtctctcatgttcatgtacatgaagggtttagggaaagatagttaaatcatggagggttttttttggttaatgtgcatatacgtagggatatctgaaatttactaaaagaaaatatttcacgtgtacgatatacattatcgttaacttcaatgatcatcatcgagctgcttttcacgagtttgcactttgcatgacaaggcaccacatgttttgtcacagtcgtcacatgtctcatctctgcaaccaacttctctttagctcgaaaataaatcaatctcgtacgaaatatgacacatcattatttaaataaatcaatctcatatgagatgtgagacacatgctaatagacatatctaaattaatagtattaagatgtatcacatacaatatgagtttaatatattttgaaacgcaggagtacccataaatatgtatgcgtacaaacatggagcagcagtctctcgtgctgccaagtgacaagtgcaacaataatcgttcacatagggaaaacaaaaaagaaaggtagaagccccactctccttgtacgtacgacagcatgatcggcggcgccgccaggccaccgacaccgccggcggtcgtcgacaagacgatgtgcgccgcgtgcgacatcctgaagctcctaccgacaggcaccgtgctggccttccacgagctggcgccgtccttcaccaaccacggcggcgcgtgcggcgcggccagccggtacaccaccgcggcgctcatcgccgcctgcaccgcgtcctgcgtgctgctctccttcaccgacagcctcgtcagccatgtcgacggccgccgcctctactacggcgtggccaccctccggggattccgcccgttcaacttcgaggggacgcgcgaggagatggaggagaggttcggcgacctcccggggatgaaggtcagggcgctggacttcgtgcacgcgcacgtctcggcggtcgtgttcgtcgtcgtcgcgctcggcaacgccgacgtgcagggctgcctcttccccgacgccggcactggcttcacggagatgttcaggaacctgccaatgggattagggttgctggccagcatggtgttcatgatcttccctactaccaggaagagcatcggctacacggacatgatgccgcacaaggaagactacgggaaaggaggtaataatattcctggccagaccacgccgtcggtgtgatgaagtaaacataacatgatactccatttatactttataggaaggtataaatgactgtacagtgtaaatccgtagtggtgtgtagaagttggtatatatattggacatatatccaagcatggaactgtagaatgtactcatgtggggctttaagccctctttctttatatctaaactagcatatatgtggtgtaaaaaaatcatcggaaattacatatatctcgcgcgttgcagcggaatttgtaggtaattgtcaaggaaaacatatttggataagttacctacataagattagacagagtaatgaaaattgtggattttatttattaccatgcttgattgttcgtacatacatacatacatacatactatggactggagcaaacctcaacatacatacatacatacatacatacatacatacatacatacatacatacatatacacggtgcagtgcacgtacggcaaacgacagcggcgcacaggagacgatgcgccgtgcacgagacattggtgctgtgccgagtccttcacgtcacggcgttgcctcacataggcattgtgcgcggcatggcgcacgactgcacgagagaagcagggcagcagatcggcggctagcgttaggggcgaaagggattaagtcggagcgagtggcggctcggctcgatggcttttgccagtccagttcggtcggtttaggccaaagcaaagccgcctggagaaggggaggaagacgggtttgcctcatggccgagctgggtcggcttggtaggcttgatgggctaggccaggggaaatggaaaaagagaagaaaagagctgagcgactcaagttagactttttagaaaaaaaacaagaggattagggtttgggtctagatgagttgggctaggcccgcaagggacaacattagactttagcttacaagtttgaaaaattgattatcaaaatactttagtttacaaaggttttaaaaaaatacttattagtttcttttatttgtaaataaggattaatcctttaaaaggattttttaaaaaatatttgattttatttgtaaaagaattcattaaagggatattaattaataaaagggttttcaggaaagtaattagtatttgcctttaggtgaaaatattttcttgatattaattcataatcatggttgtttaataaatattattttaactccacaattgaatttagaatttgcatttaatttcttatttaatttattttggcagcatgaggtaattttgaaaatccaataaataccagcataagggaattttcaaaaaaaaatatttgtccaaattttggtttccacattttaaattcgaaattttcgggatgtttcatgctaatatctagtacaactctaaatcctaaactataaccgactacgtatatgtatctgacacaaatctaacagaaacattgctcatattcttgttcacataccaagcccttgtatttcccattagctttatgtgttgggcgtgcgctctccttgtcatgtttaacagagcagcttgaaactatttttttttcaggtagtggatatcaatccggcctatacatccctcaaggatgtaaattactagctcaatatcctttgtattataaccctttagcttgtcaatgaattgccgtttcgattgggggtagttcatactcgttagagaccaaactgtgggtttgttgttcatccggaacttttgctgaactgttgcaggcaatgaggatgccctgctccaatgccttcaacagcgcttcatcgctagttctatgtgttgaacacgtaataataaattttcatattgcaattcacgataaatgtatcttactccatctgaagagttccacgagctgcagattcagatagtggaattgttcttgataagatccctgcaaccagcatatatgcatttcaaaatggtcctgtctatgcagcataggtcaccaagtgtcccttagctcttcactcgctcaaaggacactagctctagccacgtagctgatatatgaaaagagaacagggtaaaagtcgtaatatacacaaactaaaataggacatatatatatatattcccttttctagtgtttgactatttttagatgctttgctgtacaaataactttttaggtcaattcttatagcgcattcttttccagaaatttggtgtaattcgcatttgtcattggctccgatgaacagcaactcaacaagctattgaacagttgacgttcaaccttacaatgataattatttcattgatgcgatatggaatgagaagtatacgatggcatgtaagaatctggtaaaaagaatataacagcaatatatgttattcttgttgagagattgatactactagagaggggccatgatatcacaagaggcttaaactgtacaagcatggcatcttttctaaacatgcagaagttatttttttaatcttaaagagaatataacttaaatggaaggtacgagagaaaaatatgtttttcttgctaatttaccagctgccagaccagtttttatgaatgaaagacataccaacaaaataaaattttgttttactttgttttgctttggaacttttaacagtctcttcggctgatcactgttgctgtcataatttcaaatgcaaattcttgaaaagttgttgtcatttttgctacagtacaagctcagctatctgttgctcttgttttctcttcactagctgaatgccgtgctttgctacggatgataaaaaagtatattagaatattgtctaaaataaattaacatgtgttttctcttaattgtgttaacaattcctttgctatagggaactctgaccctaatttgattttatatgtgggcatcatttagatttgtttgtttttctaataataagaagttcaagagcaaatttataaaattgacaatggaaatagatagggtgacagattcactaccagcaccattaatttcttttaaaggagtatagatgttctatgtgctcgtcttaacaaaccttactttttttacatgattacatcatttaatttgaattgaaattatgagtgcagtttaaagtgaatcaataaattaaattaacttcccaaaaagtaaattaataaatattattaactgaactttgaacatgcattgttcaaagttaccttcatctctatatatgaacatccattctacaaagtttgtcatcacttcatcttgagtatgccactaattgaagaatgttgtttctaaccgacgatctatagatgcttacatgctttgtaggagcgatttgaccaaagttaggaatacttttccattaaagattcccagaatttctctgggatacaatcgatctgccaattgcagcagccagccccccctcttgcctgtaagtatcacacccatgtgtagcattgttcctttcttttcactagcaagttacaagctgccacatagcagatctcttgatacccactttgcctggaatccctaccctctttcagatgctccttatccatacaaaatgctgactttctggccagtactgaaagaacaagagagaaagaaaaactcatattacaataggcgacttcggaacgcggcatcgcatacctctaacctctccatatctgatgaggtgtgaggaccttgctttttgtgagattctaattctagacatacgggataagagttcctgttgagaggccattgctgttcatgagagcctctgaatggaatcaaagcttctctcaacgttgacttggctgacgatgatatgattccttggggatgaccacaacacatacatttggtggctctggcctaatgtcagtgttgctgatcaattggtaatgttgtaaaccaagagggtgatgttgtctgaatttgaataaattgattttcagttgaacggtgaatccgggatgacaggagacaatatttgctgaatttccaagcacaggtatagattatccagagtgctgaatttccacagttcagtttcttaataaaacactttgcatacttccattggatactggacagcaaaagcaactatacaataggacaaagaaaaaaaaattcagaatgaattgatctgtacttagatcttagtaggaaagaaaaaacaactcatattctgatgttggcgttgatttgcattcctcatacctgtgacctgtgcattttacatcatcaagtttgttattctcacgcaaaggtctaagccgtacaatcttacgcagacattatccataccacacctaatggctgaaaggcaaaattctctttctcctcaaaatttttctccctaagcatggtacttcctagttcctatgccttgagaccttgaccctggtaattttgttgggatttgagagattatatatcagcaagcgctgctctcttgagtaataaagaaataatttgcattagttagtcagtccatgctatttataacagaacatttttcatatcattctcgttcttattcataaaggtgaaaaactagtaaaagcagatttatcagcaaattctagcaagttgctttgttctgattccttcacagttatttgatattttccttggattttctacagaattccatagtattttatatctaagactacaggcttgttcagattggtaccattttaaaccataccattatttagtaaaattgacaatcatgttgttgcatttagtttcttaccaaatattggtaatgtctatgaaattttggcaatattgtattaagactatcctatcaaaatttggcaacgttgcaatttaccaaaattttgacaataccaaattttggaaagattcattttggcattaatctgaacaccaccaccagcgtctctctctctctctctctctctcttctgacttagctttgtcaaatatgatagaatggaactactaaaagtaagaggagggtcaaggccttatcaacacctcccaaggaccatctcggcatcagtttgctgcatcaccattgtcatccatatattccatattccacactaaatccatcgatccgtggaccgtggtgtcgcgaggagcaagcttgcttggccatacattatccgaaccttcgtcttttccccgatcgaattgccgcaaaatctcatgtcgtgcacgcacattttccatggctatataagcaggcaggaggctcctcacctatgcacagctcaaagcaaagcaaagcacaacacaatcaaagcctcatacaagaagctagctagctagtactcaagctaaatacctagctagcagtagcaggcgaccagctgcatttttccagaggaaaaatctctcagtttagcttaattaattagctcttgggagaagaaggcaagaagaaaatggacagggtgaacaggctggcggcgcagcgggcggtggtgatcttcagcatgagctcgtgctgcatgtgccacaccgtgacgcgcctcttctgcgagctcggggtgaacccgacggtggtggagctggacgaggacccgagggggaaggagatggagaaggcgctggcgaggctcctcggccgcagccccgccgtgccggcggtgttcatcggcgggaggctcgtcggctccaccgacaaggtcatgtcgctgcacctcagcggcaaccttgtcccgctgcttcgcaatgcgggtgccctctgggtgtagcaccaacgacgcaactatacctaccagcgactggttcttgatttggactgataccgtggcgcagaataattttatacgggtactttggtttgtatcaggcaggtcaggtatatctaagggaaaataaatagtacgtgcaggccttttttgcactgcaatactagtaaatctatagagagtggggaattaagtgtgtcatgtcagccgcctgtaaggctcttttgagatgtaataatgacacatatccgtttaatggagtatacctcttttgtcgatcgttggtcttttcgtctgtgtgattttttaaaaagctatctaatccagggttttcactttcggtttgcatcgaaatttagggttttcactttcggtttgcatcgaaattctgaagttttggtgcaactgaaatttccaaaaattttgggaaattttcaactttttgtccgaaattatttgaaaattttaccaatttttgactgaatttgaatacattttgatcaaattcacaaaagtttgaaaaaaaattagggtgcaaattttgcttgccggaaggggggggggggcaaaattactaaaatttcaaaaaacttaaaccgaaattgaaatccctgatctactctagcacaaacacatatatgcttaattaggaaaaccatctccaaactggtaggacgattggttaattagggacttggggtatacctcttgggatgtggatcaagaacctataacacagcgtcttcaaactcgcattagttcactctacacgctgagtggacccacattcacataatcacatagcaactcgcttatattttcgtttttgtttcgtgtaaaatggttaatctagtgatattgtgtttggagtgaattggatatttaagcagtctcaaacctatgaagactctccatataggactattatcactaaatgaacacttggaccttacaggtctaaaccgaaataagaacactcatgagct

SEQ ID NO: 6203 - DNA, 6588 bp, Oryza sativa
ccatccatcgcgcaatagtcccttcccaccacatcaccagtacatcgctgctccaggtaacaccatggatgatatcctataccaagtagcgacccgtcgattcctgagactcccttccccctgtcaaaattcagcggcactattctgaaggccgtaaacacggaataattttgaacaagcaaaaaaaaaggcgaggaatgtgatctcctggtcaaaaacgattatctcctggtcaaaaaagattatccaagtctaccaagcttgtgaacgtaagttaaaatccgtcccacgtaattggtactttattttatgccgattgacatcttgcttcgtgtttgtagagaatataccagcaattccaagctaagtctgaaaccctagaaagacttatcttgatactttggagtcggccaggaaagaatttaggccccttttaaaacaaaggaaaaacataggaattccaaaggacttataccatgtggaaaataatcctatgagaccctttgaaataaaggattgatttctaccaattccattgacattcctatggaatggactattgtaggaaattttagaggaaaattagcatgaggtcttacctcatgttttcttcttcccgggtcttgaattcttatgtttttcatgtgtaactatgaaatggtagttttgaaactttcttgtgttttcaaatctcataggaatccaatgaacatgacattctattcctacattttttctattcccatgttttgacaatcctgtatttcaaatgggcccttaaagaagttaaagaagccgccaaagctagagagcatcagctgaggaatgagatcggccagcttcaggatataaacttggaataccgtggattagtcaaaggtaagcaagcaatctcaaaaacttccagcttcaggatataaacttggaataccatggattagtcaaaggtaagcaagcaatctcaaaaacttctagcaaaccctgtctcctgaagttaaataggtccaaaagacaaaacggttatctactaaaaaccaaagggagtagtatttagactgctttgagtcaggcttgggctaacaaaacactacctaataggtaagccgttggcgaagtcacaaggccctctacttttcattataaaaccgataaaccagaaaaagatggattgttttgcgaaagaatctttggacccataaaaagcagaatttgtgcttgtggaaattctcgagcaagcggagctgaaaacgaagacgaaagattttgccaaaaatgcggagtagaatttattgattctcggatacgaagatatcaaatgggatacatcaaactcgcatgtcccgtgactcatgtgagtcattttttgactcaaagcagtctaaatactactccctttggtttttagtagataaccgttttttcttttggaccaagaaaaaggacttcattaaatcacatgggacaaattacagtcgttttcaatcaaccaagaaacagaattggactcaaacccagttcagaagcctgagtaatcgtcccttctagctttgtttgctaattcatggctaatcaaattttgttcccgctggatcttcgtaatggaagtcgtcctttctcctgatcaaagccatcttgcttctctgactagaaacgccagggttgagcagtcctcctccttatcagtgagtagatgcacaactgagatgtagtctgtttcaattgcaaccggcagcagtgtccattgcagtgctaaccgaaggccctccacacaggcggcaagtttagtctctaacgctgaagagcagtttgcaagtgacttgcacatcgtaaagagggtttcaccattgtagtcccgaagaattgcaccgatcccagcactaccatcggactcaaggaaggagccattgatgttcagttttgcccatcctgagggatgtcgtttccagcattctttttgttagtgatatgctctagaggcaatcatagagattattgtatcacatactatgtttacatatttttccgactttgttccttgaagtagataacttattattggttaatgaatatgtgattctttcatgagactctttatgttgtttgttactatttttaaaggatcctgatcaaataacatatgtggaacaaataagtttaaatgatcagcacatgtattaattgatgattatatctcatggatcatggtacagagatatcaaattaataatgtgaatacatgttggggaacatgttgttggatagacccaacatgagacactgtaagagccatatgtgttgtatcatcagtgatctcatttagtgttggtgttgaatcctaattagacctgagattatcatgattcccaacatgtgtagtagcttacttagggactgctaaacgctactccgtaattgagtagttataaaagtagtttacgggtatgctgtgaaacatgcagtaggatatgaataatcaagatgagatttgcccctcctatggagagatatctctgggcccctcgatgttatagattatggaagtgcatggccatgccaaaggtgattgaggagtcaatcacaggttatataatctatcacaggttcgagcgaatgattgagctattaaaggatggcacatatctagccttgagcttaatcgatatcgtgaggcgaaggggttcaaacaagtatacactagaggttcagccgatatgatctttatgtatgtccggtgggtcaatacgttctgctagggaccgctgttgacacgtggaccgaaaaggagttttcgggttatagctgagtgtacatgaacctacagggtcacacgcttaatgggccgaaataaggggattggatggagatccaatataagcttaattcggatagggatccgaataggagtcctacaggccttggaggcccgagttatggatcctatatattcgtgaggggtgtaatcggcggaggtattgcatcacgtgagaaaccctagccgtcactcccctccccgggcaaaaccttagccgcgcgcgggtgctagcacatctgcgcgtgtcgttccgtccctgtacgtgtggataccggtagaggcgccactgctttgcggtgctgatgggcgtgggagtacggcgaggagaacgcacgaggaggataatgacgagctggtgcgatcgactacttcctctgtatcgacgcgcgctactttgcgagagttccttcgacttcttagcgccttcttccgctacacagcgcgtcgagtggtaacgatctatgatctaatacttgcatggttcctagtttacgtgatagaaaattttgatttatgctatcgtagtctacgcgtatcccgacacttttggcttatcatccttttgcgtccggcaaattgtgtcgccctggatctgcttcgcctttaccaagtcactcctttggccattctttattatcagttggccattctttattatcagcaaggattggacgtagctttccaagaaccttttcgatgcaattatgggtgttggtcttttatcgtgcattatctcattatgaatgtaccaagcaatctcaaaaacttctagcaaaccctgtctcctgaagttaaataggtccaaaagacaaaactatctactaaaaaccaaaggaagtagtatttgagactactttgagttttaacaaatttataatggcttgtgaatgaattatgatgttacttttaaaaagtgcaaatttacactgccatagattatttatatcatttaattcattcatatgtaccattgaataataatcatatatagatcattctgatattcagcacaatctagaacaatccctagagcaccaatgtatcccaagaaaatatcgtactccctccgtcccaaaatataaacatttttagcatagtgacaagtcaaacattttcaactttgaccattaataacaaaaaaataaaaaagatcaatcatctaaaattgatgttactagatttatcattaaacaaactatcataatatgcaactctttttatttaaaacatcttatttttatagatattattggtcaaagtagcatatcaagaaccgtgtcagagtctaaaaatacttatattttgggatgaaggaagtagttgctattaaccgttcatcttttgtttctaagcatgtgtttggtttgggaatgagtttgattcatccttcttttttggatgggatagtcctagttttcaaaagatggcacacatgttagggagataaaaaaatagattggatttgtccatcaattttcaagagaccaccctagatgaggagaatatttccttttagagatcatccacctcacatattcccaaaccaaacactagaaaatgggtccgacccaacacgaccaattccatcccttaactaaacgcttgctaagggaagcatgagtggaaccttgagaaccccgctgtattgctcgggtcatgttgcatcacatatttcacattaaatagcactgtagctctgcttgcattcaggaaaaagacatgcatttattatagggccttatttgtgaaataagggatctaataacactttattgggggtcacggcttaatcaacattttatgccaaaaaaaaaagtaccgcaaacttgcaaaattacaagcacaaatagtacttaacaaagtagctcaacttgtacaataaaccacgatgtggggcgaagcaatgcaccattatcattagtgcttccagcatatctacgacatcatacacaataaatattacagcagagatggccatcttactgctttgtgacttgagagtagggcacggttggatcgctaactcatagtatccctccatttatctagattctagacaacatattgaaaatcaacaaaactatatgatatgcagaaaagtaacaaataaggcatcacctagtataagattacaacatttaggagaaccttgcgaagtcccagcagcaaatctttgtcctggcggactctgctgagtttttgacagaccaaccattgcctgaaaactcaaagcagccagtggtgttgtaccacaagacgacttttatcattttcccattcgtaaatgcagcaccgcagggcacagaagtcaggctccggcaagtatccgtccaccagcagaaaacccatcaagccaagtatctgtacacatttgggttgtctttatccctctccaagtaatcccttgtgataagatcctcaattcgcttctttattgccttgaagtcaggctgcaacggaaaagagaaaaaaacttgtgatggtgaagacatcaaaggagtttcgagcaaacaagtgctttacacatttcccggatgtcagattcattatatttaataattatagtatatttcagaataaggaaacaccaacaagacggtggtccaagtctaactgaacaaaacggtgctagcccatcaaggcaatcaacaaactctacatcaacaaagtacaattaatgagttgtaccaagaatttcgtaggaacaccatgaccttaaaagaacataatggattgagcccagcacttacataaatggagtgtgtttaaaatgctttcactaacaagtgcaagaactttcttgaagaaataactcgtaccttaaacatgcgtccaagctgctccacacattccatcacaagttgctgatgacccaatactttgcgactcttcataatacgcacaattgatgcatcaattgcgtatctgcgatccttatcaacatcttcaactactttcttcttctcatcaactggaggaagaggtatctaaaaacagcacaaacacaaagataatacattgaaccagagaaatcagaaaagtacaagcataattgattatgcaacatcagaagttcacgctttcatattataccactgaatatgggttcactttattgccgtcagaagatctcactgctgattttctttaccactctatacatattccttagtactccctccatccaaaattataaggcctatatttttttacatggtcttcaatgacatactttgaccattaatttataccatgttatgtttccaacaaatatgaatctagtgatataacatgcataatatgtagcatatatatgattagtatgattattagtaaaaaaaaattaccaagtttgattttccttaaaaagaggacgtcctataatttgggacggagggagtttttttttttcatttttctttaactttatccagaactgaggacgcaaaacccatcatccttagcatgcacccatattggctagcggccgcttactggcacctgccaatgatgcctttgccagcactgccacattctacatcttacattgccatagtttccattctcttttgttggtgtgcagcttgcttgtgtacaatttaatggctgagcatatggagactaattcaagcctgtgttggcttcttggttgggtagccaaccttgctgtttgatcggatgaggccacatgatcaaagataccacaggtggtctcagcatcattgaattggttaaaagatgcaccggtgtgaccttggtaataaaatgaacccaaa

SEQ ID NO: 6204 - DNA, 2202 bp, Oryza sativa
acagtgagatcagtaaccatgccctccattttggaagtgaactgccctccacattgttgctttagcttggtaaggatgcttctctcatgttcatcattagcactcttgtcaaaaagcaatctccttgcaagcttctttctgcaaatttagccccagaggttaacaactgcatgaatccatgcgcaagaatttaaagacaaaaagaataagcatgcaagataataacagcttacctatagaactcagcaaacaagtccttgtcactaatgtaggcaagtaaccttacaacctggtaatcacccattcaagattaggacttactaatgacactaatagatcaaacataacaaattgatggttgtaccttctcaagggtatcttcaattgcttcatcactaagcttttcactaccgcctttctttaagatattgtcacagaaggtagctagtaattcagcacttgaactgccagaaacacctttgttgcaaaaaacttcaaaagcctccttaagtgcctgcataaacaggatacagaacatgatccaatattttgatatcattatgacaataatggtgtgagcatatcaaatagcaaaccttatggaagagagtgtgcccctgaaaacaatccgtaacataagctacatacttgtcatgaagctcaatgattttccggacaaaaacctaagataacaaacagtgagtaattgaaacaagtgtagagccacgaaagaatatataaaaagttattgaaacaaaacctgttcctgtaaaccaactatctccttcttctctggctgcagtataacaaagaaaaagcaaaattacttcaagtgcaaatccaaagtgtttggcggagtgcagagctatatgtacagatcagcagagtaaatatcactacatatgttaccagcaagagttgagtacaaagtctagctaattgattaaatatcctaaccaattgataccaccccaagtacacaataagatgaatgtactaagacaacattaatacaaacaaaagttaatatatagactgtgcaccttcttattactagcagcatcttcggcttgcttcactaaggcagtgccctcattagtaacatgctacacagaagcaacattccattacatcatcaaaatagatttaagaaataaaccactctcttctgaaaaacaaaatacctgcttaaatatttgagaaacaggttctaaaccacgagttattctggaaaagagcctgtacattctagagagatcatcaacctggagtaaaacagaagatgctatgttagcagacttcatttgttcctgataaactgttgagagacgtggagcttctccaagaaaccttgtcatcacgaagcaatgcatggcatccagaatgctccttctccaggagctgacttgcgtattgagttagcaactcatgttgcactttctgtgaaaatcatgtcataccggagaaagtgaattatacataatgctctatcaggaaaaaaatatattctgatttctgaacatacaattataaattgtatatggacatgtggtgtgtatgcacttagcaaacgtagattaaatatcaaaaagtatgctctaaaatgtggactgtggagtagaagcaacagcagacaattcactaacctccaacaacttctgttcactactggagtgcaaataatgagcaactcgctctttctcccttttcagacactcctctgcctatgaaacaaacaaccattagaaaaaatatatattatgcttacctacagatagggatgttcatgaaacattcttgagaatacctttaacatgtaatctggacaagagtcctcaagaatccaggtctgggcttttatagagtaatagtctgcagtatctttgagcaagaaatcttcaaaatcattttcgtagtagtccatgctagtcaagccaatctcaacaaatatatccagaacattctttaacagggccctatcaatttgttcaccctcacgttcttgatctatctgttcgagaaagtatgtctatcaccagccatacacaataaaaaaagatagcatcacaagatacaatgactcaccaaggatatcaccgcactttttacttttcctttgatctcttgatatacctgttacaataaataaaactgattaaattctagatatagtcatcaagcaaagaaatgcaagttgtattg

SEQ ID NO: 6205 - DNA, 25684 bp, Oryza sativa
  unsure (1)..(25684): unsure at all n locations
agtaattaaacttcattgaatttgtagggcatgataattagctagaactactaatgaactatatcataatggaagaggatcctctaactttgagttattgacaagtgggaccgctgagtagagggcgcacatgtcagtgaccacgttagagagaagtaagtcagaggatctcaatcctatcataataggatggaaaaagtctgttttcatctctcaacacttcacacgttttaatttcatccctcaactataaaaccatataaaagctgcccatcaactctcaaaaccaaacaaaacttatcccactgccctatcctatagtgattttgactcagcaggtggggccccactatctatttgggaaatggactggagaatggtgaatcttacacaatcagccatgacactctatgacaaatgggccccactatctatttgggtccaaactatcaccaaacatggtggaggggcaacttttacccggttttcagaattgtgggagtgggacatatttaaccctgttttgcaattgaggtacaaaactaaactgagtcaaaaattgagggacgagaaatagactttctccaaataggaagggaaacaggacagggagcaactaagctcaggacttcatatacagatcctcaatatggcggggaaccagggtcccgaccatagaatcgtatgcattgcaatatctagttatagaaaatgttgtatcaattatatgatcaaccatatatttgagatatacttaacttatcaacaacaaatagcaattagcatatttacatatttaatacaagtcgctgcacactaaatagcaatgaacacatacatcctagaaacatatgcatatctatatgccaggatgatactataaaggtcctgttgatgcaaagggaaaaggaaaccgatatttcaaatggaatggatgtagtatggacagatttcagcagcagcaactgttccagcatcactaaatcaagtaatcgatgcttagcaagcaagttatgacctcgaaaaacttacaccttgaaaaacaaagttaacatattagacaatagacgcggcacaattcagaacattgaaaagcattttttctggtgaattacatgaggacttgaggagcactttgctcagcattaaaatgatccaatgcaaaatgagtgagggagagtgtaatagatatgcatatggtcattatgtaaattctctcagatatgaaagatgtgacattaaaccataaacagttcaaatcacaatatcttcgaagtgtttatgacacatcatgcaatcaacaggtaacaaaatcaaagattagctttgaacaaaaatgaataaactgcattttgcaccaagtaaagcacggtaagcaccgtatttcactttgcatgaggtgtggcacacatttcgcaccagattacatcatcgaactaatatatatcccaagaaatgccataagccctaaatgaaactttgtcaaacatggtcaagattcatcaagtttcataaggcttcactcaaatttcatgaggttttcctccgatttcatgatgcaacctggtgcaaggtacatttactaaagaaattgatccttttgtggataataatttattgggaaagaagtaaggtcaatacaagggactgagggaggataaagaaacaacagtaatatgcatccaggcatctagcattctacccacagtggttgctcaattgatcctacaatcacaattcatagttgaaaggaacatatgccttgcaaattcagtatttctcaaaacttctcatgtcgatttggcgcccaaacagaaagtgattacacaataaagtgtggttgcacagtacatgctgccatgatgaaaagggacaaaatcatgaaagaacaatcatttcaacataaagggattccaattcagaaaacaaaactcaatatgatgctattttgttgaacctttgaagctttcagtaaagcagggcatgagccttttcggtaaaaatgatgctagtctgctctgggtaacaacaaatccaaatgtgctgaagaaaatcatcccaaattgaataatcaatgctctctaagtaaatcgcgaagtttatataaatgcacaggcagtgaattggagtacttctgtagtgatgatgttagtagcctacttccagtaagatcaaatccaaatgcactgaataaaatcatgctaaattgagcaactcatgctctccaagcaaatcaaaaaaaattgtatagtggacacaggcagtacaaactaaagtacttttagcagacagcatctaagagcacagtgaccaaataataagcaaaacgcagtaagctatattcaaaaaaacatgaagtaatactgcagtacttagtgcggtcctccttagttaagaaagtacaattatctacctatcagaagaagccaacaaaaaatatctcgattgctccaaagtatcgacaatgatcaaaattagagcagcatctttcggcatcgaatctatcttctctatgtaaacagctataaactctcaatgcgtgtgctattagtccattggtacatacgacatgattggcataatttcaacgctatccctaacccatctgcgttagaaaattcaacacaggagcgcattaatcgagctagtcaatgaagggaggaacccaacagccgctcaccatggacgtgatgtactcctcgaaggactcgcggtacttctcgtagagctgctgcgagtagtcgtgcggcggcttctgcgtgcacatgttgtaaatcgtcctggagcacggagacgaaccctaaatcagatcagcgcgcggggaagaaaaaaatcgaataaatcgggagagaaatcgaggagggcgggcacacgcacgtgtagagcatcatgtagtcctcggagctgaactggggttcgggcttcccctcgaggatgttcttcagcttggtgatgcccttctgcatgaactcccacccctgctccagatcgatcgtcttccgctcgtgggtcgccatcgcggccggcgccgccgccgaatcgggggaagggcggcgcgagacccaccccgccgaggatccgccggggagccctagcttggggggggctcttcgctgtcgtgtacgtggggggaggggaacgaggtcggtgggttccctcccgccgcacgcgaggtggacggaggcgaagaggggaggaggaggggggatgacgaaatgggaaaagtggaggggcctttttcttttctttttcctttttttttttgctcccttttcgctgatagggtggggcgcggccgcgcggggtggaagttttgctgttggggcggtcgtgtgatcgtgtctcgtgtgggaaacacgccggggtaaaggaaccaggtcttttatatctgtaataattgattattctgaaattcaataattggtaaattagtggtgctattctatgaaaactggcccatttgtaaattggtaaaaaaattattattctcggaatatctgaaaagtttctttcgcatttacttaaaagttttaatcacctatctactctactcctctctaggcattaattgaccctttcagatataataatgtgagatgttgttataaataaagattttaattgaaataaatacaaggaataagtctacttcaccccccaagtattgaggttggtctacataacccccagaagtacgaaaccgggtattctgcccctctaaagtatcaaaaccagtttaaataacccctagagtggttttatatgtggttttgttgtgcacacgatggcatgtcaatggttctggccttgtaacatgctaagcattttattcacaagtgaaaacaggctgagaatgatgtaaattagtgttaatatatactccattcaacccataatatgaggcgcacaagcatttcaagattcaacttctataatatttgaccaataattagtataatatgaattaaattttatttgttgggaatattatcattggattggcatttgaatttacgttcatatgattataattttgttgctataataaaccttatagtatatgagaaattataagccaatcgtaccaattttgatcattttttatattataggataaagggagtaatatattttaggcttgccgatcaatgagtgaaaagcaatagttagatcaacttaggtttactagactaatctttgtgtcatgcaagccaataccgctgccacataatcatttacatggcaaaactaccaacaaaactactctagggggttatttgaaccggttttcatacttcaaggggtagaatattcggtttcgtactttaggggggttaagcagaccaaccccaaggggtgaagcagacttattcctaaatacaatgatgtaatcggatcttaaaaattatactctctttaaaagagcggaataactatatatcattcgacagaaatttggggatgaaatcttacatattttggaccattggatctgtgccaagatttatgcatcgacttcttttcctccaattccagtggactccccttcttccccggcgccagcgacacccgcaacttcagcagggagcatatcggttagggtttggagttaagggagggggaagaaggggtttctcggggcttaagagggaaggatgtggggcggtgggtggtgcacatggacaggcggccaagcgccggaaccgcgggattgacagcgggcggagggccggcgttggcggcgggggaaaacggattgcaaccttgggaaagagatggggggagggagaggaggccaactagggggagccttgcgggcgccgttgaccccttccggctagccagcaaggctaggcggcggggtagcggcgcggcgactgcacaggacgtggaggagcgctcacgctcacgcatgcgtgaaagcggtggtggcggtggatggattgagaagtggaggaaaagtatgtttgttatgttgcaagatttggggaggttttttctgtcaaaagacacctagacagtccctatagtatttgattggaaaaaatagagtgtgcactagttaaggaagaattatgcgtatccactattcagattttgcctacatgaatttgcgtgtgatgttggtaatggaccacagcccacaagcccttttataattcaactcagtgtttttcctttggaataagttcacattaactcccttaacaagtgacagaatctgattcgtatccctcaatcacaattctatatctcgatcccttaactattaaaaccggtgcaatttgactccctcgacggtttcactgatatggcgcacacgtggcaatgttgacctagtctccttcccacgtggtattgacgtggtgtttatatggcattaaaattaaaaaaatatatttggaacccatttatcattcacacaaaaaaaattgtggaacccacaaaaatgtggggcccacatgtcatcctatctctcctgcccttcttcctcctctctctcccttatttctctctctttctctcccctttacttcactcaatctgctggaggcaggcgggggatcgagtgccgccgccggcggcggcgggcggtggacggtagccggcgggtgggcgggtgttggagcagcgacgcaggcaggcgggcgagggccacagcggcggtggcgggcgggagggcgggcgctggagtagcgacgatggcaggctggcgagggccaaacaactctccatggccacccgctgccgcaccgctgcaaccaccggtgtggacctcgacatccgtgctgttcgatgccgccgccgctccaggtccaggggtgcctatcgccgccgttggtcgaccgcctcgcccttccgttccccttggattcacttgccgcggcggcgccatatcaaaggtagaagaggaggcgacgcggctagagaaacaacgcctggacaccatgcttcgctgcctggatcctctccttgccaccaccgagtgaagtaaaggggagagagataagggagagaggaggaggaagaagggcaggagaaagaggatgacatgtgggccctacattttgtgggtcccacaattttttttgcgtgaatgacgaatgggtcccgcatatttttttaatcttattgccacattaatgccacgtcaatgccacgtaggacgaatactaggtcaacaccgccacgtgtgggccacgtcagctaaaacgccctccaaaaccgccaagggagtcaaattgcaccgtttttaatagttgaggtgtcaagatatctggcattatggttgagggatacgaatctgattattcggtcacttgttaagggagtcaaagcgaacttattccttttcctttcctttgttttatacttttgggtaaagtttattttatgtccctcaactatggtggagattcattcgcggccttcagccataaaaccaactacaaaatttcctcttactatcaaaactattgcaaatcgagtcccacgatggtttcatctgatctggcgtccacgtggtatgttaacttggttttcgtcatatgtggatgcttatgtggcagtagaagaaaaactttaaaaacttaatgagatccatatgttagtcagaaaaaaaataatatatacttcacacatgcatgcataaaagcgaatacaataagatgatatagctggctataaaagtttgcacatcagatttgtgcttaagtggagtagagagaagaaaagcgagatatatggtataataattaagttgtgtgagagaaagagatgggccatactttaatagtgttgtatatatctataactaactattgtatgtatggctatttaattagcattagattatgtgttatttttatagctagcagttggctatactattaaccttgaaagaaataacaatctagggtaacattgacaaatgcgacgatgtgtgttaatcttggcactcaaaatggtgcgaaaaaatacatatatatgcacatctagctgaggttaccggattcctatttatatgtgataaaaaaaccttatcttctaactactggtctcctcaaccttgtgccgttgtgcgcataccacgtatatattatctgtaacactcgccgtcaatccaaactatcaatgttgagattgctcttgaactcttcaaacgggcgcatagccagtggtttggtgaatccatctgctatttgatccttggaagaaatatatcctatctcaaataattttctagaaactcttctcgaacaaagtgataatacaagcatgaaacacatgatttgctgatagatacttaactccaatgttatcacaccacatgattcgcgaccttaggtgcatctataccaatttcacataacagagtcggcaaccacataatcttagctgtttcatcagctaacgccttgtattctgctgcagtgcttgacctggacacagttgcttgcttctttgcactccatgacactttagagcctagaaagatagcaaaacctctagttgaacgcctgtcatccaagcatcatgcccaagtccgcatcagaaaaaccattgaccaacaaagaattgacaaaccttgttaactgagaaagaaatacctggtcttgtcaaatttaagtactggagtgctccaacaatacttcagtattgcatcttttggcccaaatagattcatgagttgacaattttatcgcatctaagcaagggagtacttactggtttgcaatcgtgcattcctattcgttgttaaatatcatatgcacacttggcttgaatcaacattatttcatcatttaccttcacctctatactaagaacgtagtgcaagtctccaagtccttcaaggcaaactccttgtaagattctgcaacattaattttttttgaggtgaaagcggcaagagtattgccgaatatattagagagaggagagttttacataacgttcaaaagagcaatattacaggcataaagtgagcgcctcgggctattaagcatataggtaggtataagactaggacgacaagctaaatcagggcagttggaaaacgaaaacgctttcttgtatgtcttcattgatctgttgggcagctcgacttgaattcggttcctgatgtttgaagatttttgcattcctttgcagccatatgtgctaccgtgtcttgattaggatttcgactcggtgtcgtgattctattctactggttccctgtgctaaatccatcatccagtgtgccaaggaggtttggtttattgtcccctgtatgccctgtgttgccgctacaagttccaagttcttctagtgaaatcacattccctgaagaggtgttcagtgtcttcaaaagcgcttctacacagagggcaaatccaatcgcattcccaatgtcggattagaaggttttcagctgttagggctcttttgtgtagcaccagccatccaaaacaatctttgctttggtagtgcctgtgctttccagtttgctctgagaatggggtcttgttggcaagttatgaattggaacttgtaagaacttttgtgctaagtagatacctgtgctggttctcttccagattatagaatcttcattctgtattgatagttgaatgtttgatagaagattgccaagttgcaccagctcgtgtatggcttccccattgtcaatctgtctaagcgaaaacacccagtggttatcgtcaagttcggttgctagattcttgttttttcctgttgccaactgaaagaggtttggggcaatttctttggggcacattccttggagccaattatccttctagaaaagaattttttgcccatttccaatgacaatttgggtgcaggcttggaagagttgcaaatcttttgcattgcatggtaattccatgtcattccatggtctgttacaatcatgccatcttatccataaccatctcacttgaagggctgatgaaaatctttccaagtcaaggattcccaaccctcctagttccctcggcatgcagacgatctgccagtttacaaggcttttttccggctttacattctctgcaacattaatgaagttgcacttgctgtagatctagccactattatattgccaacataaataagcacaaaaattgtgatgtctcctttagtataaaagaataaggatgtatctgctccttgatggtttaaacccaagctcatgaaattttatacttaactaggctcgtggtgcttgtttcaagccatacagagccttgtctaacttacatatataagttttgagttaacaccaagcacttatacaaactcaaaaccacaactctctcgcatacacacacacgaaaatcatggatttggggagaaaccactgagtgtccgtctcgcacaggaacatggtagaacgactcatcttggatgcttcttgactcacccacacatttgcatcgaacccgttagctcgatcggacggctacacaattgctagtagatcggacaaccatggaaggcgtcattgcttaataaagaacgagaacgctctctgttaagatttcacaatttaatatggttataattgtaatctcacatatccttctccttattttctgttgtattccgtctaaggcatagttcatattcttattgcccacattgcaacttatcaggaatggctttggtatgattctgtaaaaaaaaaaaaggcaggccgtggatttcctccaaactcaatcgaagcagacgaacgatccaaactgcctccgcacattccagaaacagaagggccccacacgacccccgtttcctcccctatttatttccgccgtctcccccgcgagatcgattgatcgaatcgaagaaaccccaaaccccaccaaaaccctcgccccacgcctccttcgtccacaagcctcgcgcgcggcggcggtggcggcggcggcggcgtaggcgtgatgaatatgtcgccgcgcattccggtggtggacctcgaggacgggtggcgcgacgtgctcgccggcgtcgccaagctcaagtgcatcctcgatggctccaacgtcgtgcacttcgtccccgacgagtacatgcacctctacacgtacgttccccaatctgctcgctcgtcttctccgcttgggttctctcggattcgcgggggtttttttgttcgttcgttgttggttccaatctgatttgatctgatctggtacggctgatccgtggcaggacggtttacaacatgtgcacgcagaagccgccgaacgactactcgcaggtgctctacgatcgctacaagcaggccctggacgatcacatcgaatccgtcgtacgtgtgctgctcttaatctcccatcctttttgttttgggtgttttttctgcgacccggctgctcgatttcgccgctgcacgtttaggttcttagtgcgatgatgaattattgccgaagggggttttcggtttattctgatttatcagcgattttttgggcgaatttcgcaccaattaggggttgccgctggtccgtacagtttaacatgttgcacttgtaacccgtgatttggaccctcggttgaggacttgaggcattatgtggacgattcttatttcttaactgtctgttattgtttttaaactttttttatcgatccattgttattccgcttttttttttattgttgcttagttgtgcccgtgcgcaggggctgatcagtccctcctgcacccacaagacccatggatatccttaggaacacccccttcaattttttcaccataaattcaattttttcaccataaatgataaactaaaggtccctaaatggctggaggttaaagaaactgtgtaattaagcccccccaaatttttgttcctggatccgcccctgcccgtgcgatgcaaccaaaaaaaccccgatagtgaaaatctcttcatagtgcgtaaatggctgacggaaatcatggaaagtaaaattgaacgtgatcttgtaatggaaacataataggacttgtgtttgtgcagcctttgaaaaagccaagacgtttcaacgtagtagcaattacatagacggctgatggcattttgacgcttatttaatttggttcatttttttttctgctcctgtgttgcaacctgcatgttattggtgtcctcctgtgtatttcctgaatgagttcttggagatggatatgtatgccttatttatgataattgtttgcagtgaagcatgttaattagattgattctgtactttcagtgcgaggcacatttgttgggatcgatgattgcatcttaagaatgatagtatgagatcgttaatgtgcctttttcctaatttatatctttgagcttgaaggtgttgccctccttgaatgagaagcatggcgtgttccttctgagggaaatagtgcagaggtgggagaaacacaagctaatggtaaggtggctgaggaggttctttgactacctcgatcgttactatgttacacggaggtcccttgattcactcaaagatctgggctggagtagcttccgggatttggtgagcctcagttagttttcagagaatctttagacgagtataacttagaagcactacagttgcttattattactccatgatttgacaaatacctttgatgattcttctgttgtgataggttttcgataagctcaaaagtattgtggcaacaattatgattggcatggtgagcttgccctccgcttcttaatctcgtgcgcattctacagagctaacttgatcactactaatttcttttatttaatagattgatgatgagagggaaggcaatctaatagaccgtccactcctgaagaatgcccttgatatctatgttgaaattggggatagtcaactgaattattacagtgatgattttgaacaatcatttctcaacggaacaacagattactattctaagaaggcacaaacatggattcttgagaattcttgccctgaatacatgctcaaggtatttgtggagttctgaaatttacattgctgctaagtttaacgataccctcttactagttatgtgcttaataggctgaggaatgcttacaaaaagagaaagaccgggttgcaaattacttgcattctactacagaaccaaagctatttgcggtttgtctcagttatatgtttgatgtttcttggcagcttttcaatgatgcatgtaaaacatgcaatgactttctgtgcttctgaaattgtacccttcaacctaaatgctttcaggctgcactcttcgagttgatagataggcgtgcagaagaaattctgaacaaggagaactccggatgcaaagtgttgctttgtgatgaaaaggttgcattacactgaaaaaaaaaactctggtttgtgaagttgcaaaatgaggaaatcgctggcaatcaatttactgactattttttgctttctgactgtagaccgaggatctagcaaggatgtttaggctcttctctaggataactgacgggctgcttccagtatcgaaaatatttaaggaggtattgaattgtctcattatgctccacatgctgcactgctgaaatattccaatctccttgaaatgttacttctgtgcagcatgtcattgctgagggtatgtctctgctgaaacatgcaacagatgctgccaacagcagaaaggtgatgattctatgtctttgctctgttccttggcccagtggatttgctctgttccttcatattgtgctttgcaagtttccacatccttgggatgacattcttaatttatatttcatttgtttgtcaaatcagtctcctgtgggtgcataatggcatctaacatcttaattgtgctgactagcctgcaattctataatagcaagagaataagggcatgtttggtatagctccaactcctaaatttaactctagaaattgagtatggagtggagttgtggagctgcctaaacccaactccatctctttagtttattttgtgagagtactcctgcgagctctactctctttctgagtggagctgaaaccgtttggttgagctccagctctaggaaaggtggagctggagttggagctgtgccaaacataccctaattattgctaaatagatacatgcaatagataataatgtgttctaattattcttgaatctgaatttcgaatggactatttgttcctagatctcaccctgctgtgaatctttactatgtggtcgatgtagtctgtccaacaaactggttacaataagacccacagaagcacatatgatttcgagaaagggatccacgnaatattgggtagcccgtagccgttgttaaaccaggtcgagtactttatgaaaagggcggagtatctgaaactgtaaggaagcttattacaactgacagcttacaaagtcaattgctattagaaggatttactagttaactggttttcatgctttctactgcaatatttttttcgtgttatttttttcagaagtgaatgcatcgcaaacgttggaattgtattgtgtacaacttgtgctaatcagattacttatattattgtattctgcacgtatacaggatgagaagaagggggtggtggtgggattgccggagcaggtctgaattagacatacatttgcttttaactaaggttgtactactgcttttttagtcttaatgggttaccaccgattttaggattttgtgaggagtgtcatagagctccatgacaaatatatggcatatgtcaccaactgtttccagagcaactcagtatttcacaaggtttgctacttgccaagttaccgaccctaattttgtcttgcagcatttggttgctcaaaccttgtataatgctgattgacctactttatttacttgtctcaggcacttaaggaggcctttgaagttatttgcaacaaagatgttgttggttgcagtagtgctgaactgtttgcggcatactgtgatagtatcttaaaaagaggtggaagtgaaaagctaagtgatgaagctatagatgaaagtcttgagaaggtatatagttattgcaatactgtttgtacaaactagttacgaaatctcttgttcaacagtgtatttaatttgtatcaggttgtcaagcttctaacatatctcagcgacaaggacctctttgtagagtttcataggttcgtggttctctattttcttgatgacaattttattatgttcccaaagtaaataggaaactcacattttggaagcctttgttttttctggaataatctattacaggaagaaacttggaaggagattgctgtttgataagaatacaaatgacgaacatgagagaatcctactctccaagctgaagcaattcttcgggggacagtttacatcaaaaatggaggggatgctcaaagatattacattggcaaaagaacatcagtcaagttttgaggagtacgtaagcaacaatccagagtcaaatcctctgatagacttgaatgtgactgtcttgacaacaggatactggccaacatacaagaactcagatataaatcttccattggagatggtacgtctatggatttcctgtttaatttgcactaaatttttgatgaactatcacagattaactttataaccgtccgattcacagttgtttgagacattctcattttcctatttgagtttgtcttgtaactcatcaatggccacgaaatgcgacctgaatattgcagtgctaagccataatgccatctattgttctggaactccatgttttcaggttaaatgcgtggaggttttcaaggaatattatcggtccgacaagcaacacagaaagcttacctggatcttttccttgggaaactgcgtcgtcattggaaattttgatgctaaacctgttgagttcgttctcaacacttatcaggttatttcgaaatctttgtacaaagtgaatcgctcacacacttaatgcatggaacaaacttctcacttaattctctcttaccttttccctctttggtcaggctgcattgttgctgctattcaatgaagctgataaactgagttactctgatattgtgtcacaattaaaactgtctgatgatgatgccgtgcgtttgcttcattcgctttcttgtgcaaagtataagattctcaacaaagagcctagcaacagagtgatttctccagaggacgagtttgagttcaattccaaatttaccgataggatgcgaaggattaaggtgccatttctaactatttacccattcccccctggtttttcgagctaactaaacgtaattttttttttgtgtgcaggtaccacttcctcaaatcgatgagaagaaaaaggttgtcgatgatgtcaacaaggacaggaggttcgcaattgatgcatctcttgtgcgcatcatgaaaagccgcaaagttctgggccatcagcaacttgtagcggaatgcgtggagcagctcagccgcatgtttaaggtacacggcagaacacatacatgtcgattctgctaacctactttttgaacattctgccaatttgtgtaaagctttcagtcatctgtggtgagaagggagagaaaatccatgttttcttaagacttgtgttgtcagatattgacaatggggatttgttctcactcttgtgcagcctgacatcaagatcatcaagaggaggatcgaggatcttatcagcagggagtacttggagcgtgattcggagaatgcccagacctacaaatacttggcttgatgattggtcctgaggcgacttgctgactgtttgtctgtttactcaccctctggattcctagggcagtgccctgatgttgccaccagtagtctctgtttacttacatccacgcatcagggttgtacactcttttcctgctcaagtgaatgattagaggaaaaacagattaggagaagcagctatggctcggctgtgactgtgaaccacatttacatgtttagctttgacgccctttgctctaccttttgagtttctataatttttgttgattactttcttcttgccgatcattgtgttaaatcgcaactcatcatggagaaagaactttattgcagagtcactggcactttacctgcctagtgcctagcattagcatatgtggtttattaagctcgttattattaaatctaaatacatgtcgatgacacgccctgcattaattgttctgcaggcctaataaacgacctagtactgtataaaataaaataaaaaatgttgggggtaataagcagtttatatctaaactagacgtagtagatcatgccgacttcgataaggctgatgtgcgggatgttgagcacgaggccggggcctctgcaattcttgcggaggaaagcgtaggcgacgttgacggcgaacttcttgaacaccgacgagctcttcctcgccttgatgtacgagtggcccatgatgtaggcgacgccggcgtgcttggcctccaccagcgcgctcagctcctccttcaccctggggtccgtgtgctggttcgccacctcgaaccgcacgcgccgccggctcgcgaaccccggcgactccgcctcgtgcatcgtgtgcatcgagtggatgagcgactccggcttggcggccgcggcggcgcgcgccaccacgctctcctcctcgccgggctcccgcatgaggagccccgtcctggcaaggtcgctgggccgcgggaccacggccatgcggccctccacctccacggaggcgacgaccccatcgtcgctgatgctgcagcgctggtcgaagtcggcctccatctgcacgaactcggcgatccgcagcacgaggtcgttctcgaagtcggtgtcctcggcgagcacgtccttgtagccgtgccgaacgacgcagcggtacatgcggaactcccgcgggccgatgcggcggacgaggtggcgctcctcgtcgcggacgtgcggcaccggcacggccttgacgcagatgaagacgagcacctggtggaacgccggcaggttggtgacgaagtgcgagaagatggccggcacgccggtggccagctcggagtagatgatgccgatccccgggacgcgcacgatgcccaggctggggccgagcgcgtggatccacctgagcgacaccttgttctgcacgtcgaactggtgcttccgccgcgtgccgtagtgccacacgtacatgacggcgacgaacaccagcgacagcaccagcggcagccacccgccctggggcaccttcatcagcgccgccgacaggtacaccgcctcgacgacgccgaacgccaccaggaagagcgccgccaccaggcagctgtactgccagacgaagacgatgacgagcgccatgagcagcgtggtgaccagcatcacccccgcgcacgccatcccgtaggcgttgccgatgagggtggtgtcgcggagccccatggtgacggcgatgcacagcagcatcaggatccagttgatctccgggctgtagatctgcccgtggatccgccgcgacgtgtgcacgatcttcacgcgcgggaagcagcccagcgccgtgcactgccgcacgatggagaaggtcgccgatatcaccgcctggctgcccacgatcgccgccagcgtcgcgatcaccagcaccggccagaagatgcccgctgcaaaatgcgacatttcattcggatcgatgtcgtcgtatcacgattcatgtcacctcaccaccagtgattagcagtagattagaggagtactccacttacttggaatggactcgaagaatacgaagtggatgtcgcagtggggtgatttggacaggaaggccgcctgccccatgtactgcagcaccaagcacgggtagatgagccccacgaacgcaacctgtcaacaagtgtacgtacgtacgtgtcaaacaaatgtcaagatatttaacctgctcttaaaatcaatctgcattatattaaacgagacgcagtactgcactatcagtgctctgacagcaagcataaacagacacatatacccttatggatgcagctgtgaagtggccaagatccgcatacatggcttcggtccctgcacatacatacatatatatattattataaaatatgtagttgatgagtcgcagtgcagcgagcaaaataaggtttgtttgcctgtcatggagaggagaattcccccgagggagatccagccgtccttgccggtgtgctggaagaacctgacgaggtagtaaggggagagggcgcgcagcaccctggggttccacaccacgatgttgtagacgccgagcgccccgaggaggaggagccagacgatgaccaccggcgcgaacaggaacgccaccctgtgcgtgccccagtgctgcaccatgaacaggcacaccagcaccgtgcacgacaggatctccacctccccgctcgtcagcgcggtcgagtgcacttgcagcccagagaaggacgacagcactgcccagccagcagccaggacaaaagatcgatcatcgatcacatcagcaacccaaaccacacaccaagtagtagtagtattacggtacgcgcgctcaccggacatgggcggcgtgaggacgccgtcgccgatgacgagggaggcgccgaagaggacggtgacgaggaggaaggtgcgggacttgcggtggttctcgaggaaccgacggagcgcggtgaggatgggggtctcctggggggcgtagccggggcggtagtaggaggtgagctcctcgtcggcggcctcctggtttggcatgaggctgaacttggcgtggcgcaccagcagcgagtagagcgcgaacgtgccgccctcgccgttgtcgtcggcggcgagcacgatgaagacgtacttgaggagcgggatgagggtcagcgtccagaacactagggagaagacgccgaacacgatctcctcgtcctggaaccgccggagcgacccgatgatgaaggtgctcttgtacacgtacagcggcgacgtgctcaggtcgccgtacaccacgccgcagctttggtacgccagcagcagcacatgcctgtagtagctcctccagtgaccctgtacccgtaattaattctactgattatttattattttatcagattattactttcattcttcgtattatggccctgtttagttcccaaaaactttttgcgtaatattttgcaaggaataatttcacacacacatgtattcttaagtttagagaaatgaacaactaattgcacagtaagaggcaaatcgcgagaggaaatcctttgagtataagtcagtacaannnnnnnnnnnnnnnnnnnnnccatccacatgtgctaatgacggattaattaggctcaaaagattcgtctcgcggtttccaggtgagttatgaaattagttttttttattcgtgtccgaaaaccccttccgacatccggtcaaacgtctgatgtgacacccaaaaattttcttttcgcgaactaaacaggcccaatatatggagaaatacgtgcttatttaatttagggaagattgcaaaaatcaccctaaatatatcatcctaagttcgagatttcttcatgtaaaacgacttgttacaaattccatgtcttaactcaccttgtttcgatatatattcctcccaattaccattgtttgcgcgttttttctcctcgtgtcttacttggtttagtgtattttttgatggacatgacccaaccacatcttttgcacaatgtaagggcatgtttggttcaatactaaacttaaccataccaaatacttggcattactcaaaaactgtcatccatttgttttatatccaaataatttgtcatgccaaattatttggtttttggcatacttcataggtagcaaataaaacacataccaaaacattagcatccctttgtggtaacaaaccaaattcaaagcctagccaaaaacatttggtaacaatccaagcactttgcagaaaaataaataaataaaaaaaatgaggcaatgatcaaatcttgccatgccaaataaattggcaaggccaacaatggccaagaaccaaacatgtcctaagtttttttttttaatctggttcggctgaggagagacaaaatcggtaggaaaaaaaagctgtccattttccttccatcattggtcgcactaaagtgatacacattgcaaaattatttaactagcgtcagtattcttcatggattggtaatactgtatactactgatgccctctgtgctcacactgtctgactcggtcacaagctatttttaggacggtgttagtaactagtggtgtaaaataacaatgagctactcctactgcatgccactcttaatgtaaatgttctccttgcatgatccactcttggaaaaaaaaacaaacaaatcactctgttattgtcaaataattcagtcaagaataacattttagttgggatcgttcttcctgattaggtactagtaatatattcttccataagtatggtcagagataagatgcagggtacattaatcaacaccatttcctactacacctcagtaacataaaggaggaaataaagagaaaaggaaaaaaaagggtcagattccgttgatggaccagcaccgatgttggtttaggtaacagaaatgcaaaaaattgcaaacggtaggggtgcacatcatgtccgtatgcttacacaatatcacaaattcatcacaagaggcaaataaataaattatttggaaaatgcgatttcaatgcacgccagagcaaggggaaatgtatagctcaccgggttcccgtttgcggcacctgcaccggtgacatctgccggcgagagaccgctttcgcagtcggccaccggcattttattttattggaagatgaaaggagagggaggaagatggccgggatggagtcaccaattgcggacatgcgcactctctctcactgcgtgcttcttctccgattcgccgtcccctaaatctgttgttttatttgggttaatgagcactcgtcggtattcttggggttatgtggatgagtttgtattcatcgaggcaaatgtagaggggagagagagagagagggggagagcccccggtttataatgaggtgttaacagttgtggccatggagtcatgcaaagatgaagcattagaggagtagtagcgtatagtactctaattttgtagctgtgccgctttttaagatattttactttccttggaaaagtactggtacgtattaaaatttacactaaaaaatttgacaccacgaaataccaaatatctagaggtaccaaatttatattatcatcttcgggtacatttttaagaacagtaaaattactcatagtccatgctgtttgtactttttattcgggattgttattaatacttaatagtgtcaaagaccgttacaagtaataacaatgtgttgaggcgttgagcgaatccatttagtttttaacttaaaaatagcacttcctccgtttatgtaagtttggccaggctttaattttttctaagttaacaattcttataacaccaaatttcattaaatccaacagtcaatatattttgatggaatatttgttcggtgttgttcttttataaacttagtcttaagaagtttgacttaaaaaaagttaaactatattatagagtgcattatttatttagggaaaagtccgaattacacccctcaactattggatgagtatgaattatccccctaaacctaaaaaccagacatctttaacccacaactatcaatatggatgaaaaaccccctaacttgactcagtgcgaatttggatcatacgtggcggtccagtcagcttaaaaaatggtgggacccacctgccagctcttcctcttcttcctcgttgccactgcttaaaaaaagctatgtcgagggtgaggcggtgacaagcgacacgggaggagccagtgaaggaagctggggggcagggctggcgcatctcgccgcaccagtagaggggggcgactgacatcgacaccgggctcagatatgatgattttgatttgggggagtcggtcgagaatttgagagcaatggcggagaaagtgagccaggggagcacggtaggggaatgatggcgtcctccggggtcgccgtcaccatgaccaccgtgcccatgacggaggagcacatcgatgccttcactcaccaggtccgcctctgcttggtccccctcaaggatgtggctgggccaccgctgacgtcgccctggcaccgaggcggaaggcgatgacgaccaccactggggaggagcgcgtggcggtggcggccgtcgaggaggagtgcaactgggggcggtgggactcgagtggcggaggtggaggagctcgagcgacactagctggaggcgatggccggaaagggaatcggcggcgatgtacaggtcggtgatgttcatagggagctccacgcagcaggccggcatgagctttggcggcgagcacgcacaacagcagccgtgcccccccaccgccgttcttggctccccctccgccactccgagctggctccatcgtccccgcctgttgccgctgcttcgaggtgccttccccgtccctgcccgctaccactgtcctcagctccccttccgccactgagctgcctccctcgatgatgcccgccatcgccatccttgactcctcctcggccggttgctcggtgatagagagagggggagtcgagaagagaaagagaaagagaaagagagaggtgaggggaaagagagagaggatgagactaaaaggtgggacctatcgatttaaagaaaaagaattgctgactggattgccacgtaggacaaaaactgctccgagtttgagttagggggtaattcgtccggtattgatagttaagggtgaaagatatctggttttcgggtttagggggggggtaattcgtactcacccaatagttaggggtgtaattcagacttttcccatttatttatcggctccatgttgacaggctaggtttgatcaaatgatgtcaaatcatttcaacgtaccagaacactgcatataaggggcagatgactcggtatggcgagctgtggcgctcgccataccttgatctgctagtgagacccccccggggcgcgtcctccttcctaggacgccgcgccgcaccggcacgatcgagagagggagagtgagaacatggcgcgatcgagagagagagagagagagagagagagagaatgggcctaattagttggcctggttcatcctttatgtgcgaaggcttgacgagttcaaagtttgtcatgatttagcaagcctagcaaaaaagatggctgaacttgagagacacattgtatttccattggtatattgtctcattgagttagtattgcttttactggtggcgactagatcagttgagagggccttctaggtaatgaagattatcaagacggagctacgcaacaagatgtccgatggttggctcaatgacttgatggtgtgctacatcgattcaaaggacttgattttcaaaaaaaatcaaaaaaagtatttcagaaaaagaaaagtaggcaaatgcaattgcctaaatctcctagacctctaagcaattaaataaatgtttggtataccttcacattttattccaatcattgctctttatgttatcaatcttaagtatatagtatactaattaatctttgcaatttgttttgcagtttctatatgtctatctatcctcactagtctctagttcttatatgtgatgcattgctgacagctggaatcttagaggtattatttacaattttggcaaatggatgatgaatgtgaacctatggctagtgcttgttgccatgtttgagattgcgtcatgatcggataatgttgcgtcatataatatagtgcattaagattgtttttttttctttgtgctagtccatgggccacaccggcgacaccgtcacacctaattttttttcccgtcctccaccactgtgcatatataaagataagcagcattattaatttgaaggtgcctctaggaaaaaaacagaacaacaattttctacggcgagtgcccgagcggaacgccacaccacacaaagataagcatgcgagatttaggcacaatgctattcttagtgccacaatgcagcaccgacacctgccaagcctaaccgtgaatcccttcttaactcccgccatggcgctcctctccaactcgaggaggacacgcacgttgccaccacaggctacgcaaaattctctcccttcctcctccaccacctccactccgacgatcctcctcctgatcctgtgccggccggcgatggcgtaccggttgctggagctcacgctggtctccgcgagcgacctcaagaaggtcactctcttctcgcgcatgcatgtctacgccgtcgcctccatctccgggagcaacgtccccatgcccatgcacggcacccacgccgaccgcaacggcggcagcaaccccgcgtggaacaccgtgctccacttccccgtccccgcccgcttcgacacccgcggcctcgccctccacgtccagctccgcgcccggcgctccttcggcggccaccgcgacgtcggggacgtgttcgtgcccctcgacgacctcctcgccggcgcgcacgacggcggcgagccgaggccggctagctaccaggtgcgccgccccatgtccgcccgcgcgcacggcacgctctacttctgctacaggttcaccgacgtcaagcatcccgccctcgaagccatcgaggccgcgaccgcgaccgcgacgagcagcgccaccaaacaagggcagtacgtgcccatgtacgcgcaggactctgatgagaaggcgacggagaagagcgtgtcgtcgccggtcaccgcctacccgccgccgtcgaacgccgtggtagcgcacccgccggtcgtgccgtacggcgcgccgtacggaggagggtacccaccgcatcagcagcagtacggttacgcgggtcagccgccgtacgcgtacaacgccggcccaccgccgccggcgacgtacagctacgcggcggcacaacagccggcggcgaggaaaggtggacgaatgggcatgggcctcggactcgggctcctcggcggcgcggtcggcgggatgatgctcggggaaatggtcggcgacatggaggctgacgccgcctacgacgccgggttcaacgacgcactggaattttaggtcttttgtcgtgttttcctgtgtacatgggcaatgcacctgtataaatttgtcacgtgcataagaaatttcacgatccaacaatgggaaacgcgatgtcaggccacaagggtaagcagatcctaaatcaacgctatatatatatatatatcatccagtacgtacaaccacacatctctactccttaaaaaattcaaattggtgttggtgatagtgaagccaaagcagatataggatctaacatacaaagcagacatgcgatccaacatacaaaccatcgacacgtttggagcgacaaaaataaaagaagacgtacacgcgatccggaacaaaaaaaaaaatcgtaaaaaacagaaacgccccgcaacctgcgccccctcctccgcgcgcctccatcgccgccccgcaccctcccatcgcctctcctccgcgctgcccctccaccagcaggcggcgcggtccatcgccgccccgcgccctcccctcgcct

SEQ ID NO: 6206 - DNA, 38039 bp, Oryza sativa
  unsure (1)..(38039): unsure at all n locations
caatttgcacacatttaattataggtatttgctgtgtaacatgcattggtttgtacttgtgcattaatcttgaagtttcactggtctacgagggaaacttcgttggagggcggcaactgtatggttcatggatgcatacgaggtgaccctcctaatccagtggattggccaccattattggttaatattgattttgattcctgatttccttgcagcacaacgccacctggtggctgacaagccggcaagtacgagtatgtcgattagttgtgcatctttattccatgccgctatcatatttctgtgcattctaggaaccattgaccagtggcactctgccaggaaagtggctaataatgtatcttgttgctacttatccagatctacatataatctctttggtagtaattttggactaatccctgctgcatcctcggtttattgaattgcattttaggaaaagcaacaatgggaatctggagcacaagtcatcaatggcgatctgcagaagataaatcaaacctgtgatctgaatgaagctcatagtttttcccaactccttagtactactacttgctagctgattctgattagatataattgttgatggtttcgaattaatttctaaacaatatgatattttgaacttttccttaaaaatatttgaaatatgacattcatcaaattaaagctcaattggactatatctgtgaaaattaatttgactaacatttcttatgaaatttcagactttggtgcgtcttatagtcacaatgtagcaagacttgttcagtctggattgtaaactctggaaaatggtttggggtggttacctgctgttaattcattctataattaaaattttaattatcttcaatttcctttttatgagtcttatatctataactctttccatgcttgcttgccaaaacatataatgccttttgtttgttcatgttactaacatccaaaatttgtaattattttgcgtgctatattaagttttctattccaagaaatttacactcattgattatttaacatcatttgacccatagtgattttaaatttatgtataatttttcccgttgcaacgcacgggcacccaactagtaggagtactacatatataacttaatatcaacttggtatatatttgtaattaaactcatattttggaagttttaaatcatgaaaaatgttataatcaagattccaaaccaagcacaaattggtagttaacatttaacaaagggaaaaggaagaacaaaaatagtagaataattttgacgattgttttccctcaaaatttgctctcaaatctatcctaaaccggattaaattgtatttacaaatgtcataaaccaacttggattggaagttccagtctctaattcgaaaattccaatatgataagaaagtccaaattcctcaattctcaagctctctgtttaattaaaatattttggatgaaaggtcctatttttcatcgggaaagtatcatacatttcgtccttatccaaaactccaagctatctcctccaccacacattcccttccttattttttttcttttcctcttactctctatagtctcaaagacactgcattgccaccattgccgggtgtagtggcagagacagaaattaacaaatcatagagttgggtagggctcaactaatgaagttttttttttcaaaaaattacatggtgaattaagagaatttaagcatgattatgaaggcaagcctacggctcaagcccaagcttccctaggcttgcctctacttctgccgggtgttatgagagaggccaaagctattgttgtcggtggctacacgtattgcagtggtaggcggtgttgatggcagtgttggacttggcaaccgatagggaccggatgcggacactgctggtcctagctaaggttgcctgcctcgtgccactactcatctatgtcattccctagacatcacctcctgctgccgcatcagccacttagtagtttcggcggttggagtatgagaagaagacggtagtggttttattttgttagagttttagcgatgttgcagtctattgtttatcttattgcactttattgtatcaaggtgtttcattttgttttgaatcgatgttgcatctactgattcttcgtgttgtagtcagtatgtttaaaatgttgatttagttgaaacactttcgttcaagtgatgaaacattttttcccgattgataaaatatatgaaacatttttcatcgagtaatgcaacatgtgaaacattttgcaacaatatagtgtaacaccttctggtgttttaatgaatattggacgtctgatttgtagcgctctccagagttcagttctggtatgaaacccagtgttttaaatcgccggctaagacatttagcaattggtcttctcaaatagctaatagcgggctaaatggggctagagcatctaaattatacatgagagcaaatagctagatcctcaaacaactatatccagagatagcggaatggctctatgtcggtgtgttgtggtggaggcaaagtagcttgccaggggtggtttcttggttattttggttgtctcgtttatggtttgatcataggaagttggagcttctctttgggcttgacaatgatgagttgtgtttgagcttcaattatgctgccgcaagtgtatagttagttctttgtgtggttttctttgccagttttacccaattacctgtgcatttatgaggtttttgttcctggtttaccctaaaacatgagtcccatcatcttttaagggtttatcctaaaaatgacgactggattgttttggccattggatatgtttgtgtttcctaatcgcttctgcttcagaaaggagatacaaaaagagagtgagaagcatgggctgggctgcgccttgtcaaacttcaccaccccaagcctctcaaagcctagctacgccatctactgcttcataccattgctagctaccactgttgtcgccacacagtgtagccaccaccaccatgggctgcgctaatgcttacctcttctctgctttcttgtctgctcgctgttgctgtttttgctggccaataacagggaaaggggtaaggaagggagagaagaagaaaaggaaaattaggggattttgtggaattataggattggtaccaatgtggtactcaagtttatgacaaactacttgttgtgataaatggactagtttgctctatttattttctttcattttccttaacttatgcattaatgctaccattctagttatatatgcaagtttcaagttgatattaatgtaaatgatgctcttattgttttatgattctatattctcaatttggttatgtaattcaagtgccataggtaaccatgatggcgccatttggttatttattcagaatccttgagtaagcattggtgatcttgcccatttcttgtggtagtttgttatatgaaagagaaaaataatgtttttaggtcattccttatcagtagttgtcatggttacgaataaggcataccctctattctactagtcatggaatatacggatatggcataccttcgtatgtatgataaagctccgtatgcgataaggacatcgacaagagattatggaaataatcctcatgggcaagtgcatgacagagtactactcggaaaggattctgatatatcatatcgtgcagtgtctggggtctctgagttctacttggagaccaagagaattcacaatataaatacataccccctgagggtccaaggcatcgaatcataacaccaataacccgtcaccatagaagtaatccagaagacttgaagcctgctcgccagtagatcttgtcgagaatctcttgacaaggatcttgcttgtaatcttgtaatcagttgttctctattgtactatgtggtttccatatcaatctcataaaaccggattagagctattaccttacaagggatctgaactagtataatccttgtctctttgtttgcttgacgtcaaatcgtgtagatcctcgtatcaacataccccaatactctcatcatccgttctacaggtatcccccgtcgatagtggagtgccaggtaggggaacttggtgcacaaggttctaccgagatgatttcaagcttccccgacgtctgcatcagcactagcttcggcccaggagatccaacccagacgtcgctagtgtggactcaagttggatccatcgtctttccggtctacgctgcaaaaccaatctcgtatgccctagtgtttgtcgagattgagaatggtgcagcaaagaaaacgagaaacgacatcacttcagccgcacctcccgtctcgacagaaaagagggcgccgactacgacaacactcaggaagaagcctcaagcggccaaatctcgttctttttctgcgaaacaggctctgacggactacaaggtggtacaacacatgaaggctaaactcgaagcttgcaaataacgagatattcaacgcgtctcaccaaccagattcacctggtgtagtccaatcaataagtcaagaaaacatgacctttcaaactgcaaggttttccttgacgccactatacctccacacccccagatccaacaacgacaagttcaatctcaacatgttgcagaggaacaaagcgtggaaggatctccagatcgcttcgtgggatccgtcggcattgacccccacaaacccttagttctacatagcatggaggatcaagaatcttcagcatctaatactacacgtgatgtgaacgttatcgaaggagacgctccaagcaatgcaaacccatgtgatccacctcatcgcgaggctacagatcctgtccgtactcatgcataacatctcaccgcaatcgacttgctattgagagagtcctttcgatccggttctgtaccctgaagcagatcactggttggaagaatacgatctacaatatccaacctcaacagtgcctttacagcaacagctggaccagcaactcagggaccctcttgtcttccggcacaaggagaagaggtgcatgccgatgggaacgtcgatgctaccgaaatcctttgcgagcacccgagtcgagattaggccggaacctttggaacgcctcaccaagacgacaaagtcagcagaccctatcgccccgagatgatcgcgaccttcgcgaccacttgaacgggtgtaggcgggaacgataggagcaggatgacgtctgccatcaccagcgacgttctccacatcgacaacgcaataacaacggtaaccgaggaggctgtgacaataacgccaaagccaccatgatgaaaacagcttgtcaaagagaagaaaaagcaacgccatgattttttgcttctgcaacgagcgcctgatgcagagcattgacattgtttggaggttctcagagctggctatcccatttattggaaatgcagacatgctaataacaagctgcaaagctggacaacagcaagcacactatggtatgttcccacttccgaagccgaaatccggtggcatgccggccatcaccttctgcaccgtcggcctggccagcagcgcctcccaccacgccttcacgtgcgggtacgcgtcgaccacgccggcgtactccgtcgccatgaagtagcgcatgttggagaagtggctgaggtccgcgaggctgatgcggtcgccggcgaggtacctggagcccgacagcctcgcctcgtacaccccgagcaccttctccagcttccggacgctctcgtccacgacgccctggtcgcggtcgcggccctcgaacttgttgatgatgcagtgccacaggatgggcctcacggcggcctcgtgctggtgggcttccacgtccagccacacgtccaccattgccgactcctccaggcttccaccttctccgagtcccaggaactctggtttgtacttgcgaaagatgtacctagcgattgctcgcgattctgacaagaaaaatacaaacgattttagtttcttcttttgggcatagtgtgttatatagtatgtgtatccgtgatcttgaataaagaattactgaatctctactattaattgaacagttattcagagaacaacaagtattagttttgattggaataattcagagaagcaaatagaattcaatcgacgaaaacaagaatacaagtcaagcttgcttacgatagagcgtcaggtcgccatcctccagtactggaatctcaccgaacggctgcataattgatatacagaaaacaactttaataagcaggaattgaaatgttcttagcaggagaaattaagtttggaaacaacaactcgtgggcaaaaagcgcatccaaataaccgagtattcatgacaattcggatcctaacgtctattgccaacatatagtctactattgggcaatcgaagtgcaggtattccatgaatcagcctgcactgtaggtcgctctgaccctttggactaatttgcgtaacatgcgaagaagatatagtgcgagaattatgagaggctcacgtacgtttctggcgaggtgctccggccggcggtggtcgccgccggacctgctcatcggaacgacctcgtactcggcgccggcctcctccagggccaccagcacccgcgccatccatggcgataccacccacccgtacactttcatcggcgccattggtccttcttgcagctgaatttgccctgcactttgttggtacatatatagttgctgctcatcggcccattttgttgctaccctgggcgtctattattgtacaatgttgaccgtagtgtgggggatttggtgatataagcgttgtttcttttgtgatttatatattggctgcggaactgtgggtctgtggctgctattgccttgcgtcattgcttacgcgagggccatttgtttgttctttccacgcaggcacgtgcacctctggttctatggaagtgtgaattcaccattcttgagagctacaggggagctacttttttccaaagaaaaaaaatggtatatctcggcatctttttaaggcctataaattttctctcatcagtggtagttgcaaagtttgaatgttatatttacgtgtttctccttacatttttatacattttaactgaagttgacagaagcctagctaacggtaataacataaaggaagaaaaatagttgtgtgatgcaactcacgtaatctatggcaattcttaggatcaatcgttggtcattggcaaaagatagaatatctgtgagaatgttattgtttcattacatatttgaccgttttgactgatttaattgagtaccaaaatatgaaacaaaattatgaaaaaatatttcatagaaggctatttcatagaatgtgagaaactttgtagaaatttatttgagcataagtgatttgtcatttttaattatatgcatgcaaatacaatgcataaaaaaaaaccaagaataagccacaaataatctgtcagggttatggataccatatacctaatagtagttgactaaatcttggcagaacccaccacataccatgtcttatacggatactgacctctgatatggagggagttccggatagagaaagacaaccataattctgcatggaaacgacaatgactactcggattgtatccatattggtttccctagttctacttagacaagggaacacctatgggtataaatacaagaccccataggaggagaggggacacggagcaatagatcaagatacaacatacaagccaacatacgccaagacaagacaagatgccggatattgacttcagagataagcatggctagtccctacggtgtctacggatactgtcaggagagacatagcgctgtctttgatctcgccggatgtggattcgaggaggaaggctaccctgttgtcgactacgagtcagcacttcagaccgccaagtcgacaacagttagataggctaccttaaatattgtactggtgtgatcatggtgaataagagcaatgaccggcttcggccaacaggagtagggttattacctgacgattcaggggctcgaacctgtataaaattcctcgtccccatctcttttattaaaatctcgcatatatcctagtaccaacgatccccatactatgcaaataccggaatcgcgacatcaaacgtcgacacaatcaaattagcaaaacaagatctgtttgttgatgagtgtgagtggtttccacaacttggctcctacaatgtcacattagttaccaagcaatttggccaaattagcttattcagatgaattacggagttgggaattttttttaggatatacaaagtccatccactaatcttgaagtttttattcgatcctggagcgattttatgagctatgtgttctgtaaatttgtcacatttttatcattttgaaggctaggaagatcattagtttagtttttattataattcaaagtgttgacctagttggctcaactaaagttaattagtggatgtaagtttttgtaatctatactaccaatagtggcggtggcagttagtctgtgtccaccactaccaagtgatttgtgggaaccaacgatggtaagagaagtttcctagttcaaagggtgtatgagttgtgtgcatgcagtaagcacacgggctgaagtggcccatctgaatgtaactttcttttttccgtgtggtttcaggatggatctgctatacgtcataagattttttaggtctaaaattatattttaatacaatatatgttgtataacaaatctatctatctatgatatactaaaaatccattaaatttcctacaaacgctctcaagctgccatgtggcatcctataaacgctctcgagtcaccatgtggtactctaataaaatagataaatttgacaatcgattttcatttaaattggtagactcattattttagatcgttagatttatctttacaggaaaataaaaataaaatccccctccgtgcgcgcctcagggctttcacggacgtacataggaatgatccatcccatctcagtgcctttccttttttttaaccccgtgataattaaaattaaaaactcttttacgtgccttaaaaggccatagataaacaccaaccaactctcatctattctctactaataaatagtccattaaacatcatataaatatttctaaacatttgtatagtaatcttaaattagaaaaaaaatacattcggccatcaatttacattattttaggtcatcatatctatctttttctttaaaaaacatccaaaacctccctccacactcccatgcagtgttaaagcccattaatcatcttttaaatgttttcaaaccaatccgtgacacttctaaattagataaaatcataaaaaaaattagaacaaagcatccaaccattgggttgtgttaccagtgaaatttagtaagcccgaagtagtcatcggcttagagtcagcatcggctttgaaatcctgagattagcctatgagagttgccaagtcgtcagttgttggattcttgctatattcggttaaggaaattgatctactaaaggaagcttatccagaagagaccgagttcaaagagaatgcggcatggcaagttatctattaattagtaatagtttgttagtttccttttatctttaggaaagtgtatttagtgtcctataaggactttatcttttccttttatctttaggaaagtttctttcttgttcgacaaggacttgtatcaacccatgggtataaatatgtacacccggggtctatgtaatgtaacacacacgttcaatacaatctcggcgcatcaccaccctttttgctttagttttgtttcgacgagttcttgctttcgggttgagctgcatcggtttcgatcttcaacaagaggtaaaacttgttatgacggcttgtgttttcgggattagtgcttccatctttatgatactctaatcttatttatgtaattcgtcgagttatcatatattttatataatctctggcaatattgctatctaacctacaatcggctaacatctatcagtagagggcagtcgattaggttaaatatcaacgctggcttagattatatacgatatccaccactctatgaaacttccaatggcttgattgtctagatattgtccttcttttcacacttatagctgcatcagttgtttgatcttatgagtcgtgattagaatatcaatctctagcctgcttattggttgctgattagggtagtatcagggtttcaaccgatcttacctgatttaactatacttgctttatatgctttattgacatgttaaatctgccctttatgttaagatcttattgcatttaagtatattaggctttcgtttgatatattctgcttactttaatatcttaatatagagttgtatctgagtactagccgatacatgctagatctatctgatcagctatgctataaacatatatagtcttgttgttggtatatatttcaatttaagtgatttatactgtcttggcatggcgactgatctatcccaatcacttgatttaagtatatatcgacataaggattatatattgttaatatctacagccgatcgagtagatttagtcctttattatctaattataactgccgatcgatgtatatatgacatcggctcaaagataaatgatatgtcatcggcacttagccgatcggctatcgtttatggatttaaccacggtttctttgtttctatttcttgttgattgcaggatcaaatcaactggtacgctagcatacccgaaggtgagttttggacctgcactggagttaagcagatctctcaggcctcgtgtttttcatcaacacgcaattggcacgcccggtgggatcacgaattttatatccacaagtctgaagaagaagtcaatgccaagatcatggtcacggtggagaatttaacggaggaacaacaatattggctcggggggcaagcgcatcagtttcaacatggtggagcacatcagtatcggctcatgaaagccgattacaagaagcaaaggaagattggttttggagttatcaagacaagaaattttgaagcatgaattctcgtactccaaaactagggggggatgtgttaatggtgaaatttggtaagctcggagtagtcatcggcttagagtcagcatcggctttgaagtcctgagattagccgatgagagttgccaagtcgtcagttgttggattcttgctatattcggttaaggaaattgatctactaaaggaagcttatccaaaagagaccgagttcaaagagaatgcggcatggcaagttatctattaattaggaatagtttgttagtttccttttatctttaggaaagtttttttcttgtccgacaaggacttgtatcaactcatgggtataaatatgtacacccggggtctatgtaatctatcttcatgatcaatacaattcggcgcattgccaccttttaccttttctactttgttttatcgtccggcgggacttggcacctgacgtggagctgcatcggtgttcgatctccggcgaagggataagtccaatgttccgccggtccaggcaattgtatcgtctacgtcggcgtcgttcaaggctgcatcaggacattcgacctcttggattactctggtttggatgatatatttgcctacctatttatcatatgtctatgttaatctagtcttagcatatcaatttagctctatcggctgcttctcattttagggtttctgccggtatcggctaaatcgcgttgctagattagactaacttagacatctaccaccctgaaaactcagtcaacggcttgattgtctagatattatgtttcttttcatacttagtgctgcatcagttaagtttgatctactaagttgtgcttagaaccataatctttagcctacttcttgattgccaataagggtttcatcggggtttcagccggtgagttatttggacgttgcatcggctcataaggattgcatatacatataagttggatttagccgatgacaacaaaggtttcactgtttaatctaatcttgtggatttcatgacatcggacctccagccgatgtgtgctttaaccttcggatcgatgcttatttatcatatcattatttgccgattggtttatactggattatattgttattttattacatcatcatcagccgattgcctttatatcatcatctacattggacatatagccgattgcttaaaccctatcgctatcggctggtattggcattggctattatcggctatcggctgaagctactccatcggcttgtcagctgattggctgttttgatctactatttgcatatcttgtcagttgcaggatcaaactgactggctcgcccgcatctcaacaacctttggacctgcattggagccaagcagatctcccaggccggtgtgttcgattttttcgtcaacaggttgttattatatttttttaaaaaaatccctattttttaataaagctggtagacctatacttatatatcctgatagacatataacgacttcctgtcaagttaattaatttctctcaacatgtatatgggggctatttacctatacaatttgatcttcatgcatttatcaataaatgatctttttaggagataaataaataatcttaaaatgatcatagcatctaaattatatatatgatctatgaagacactaataaattaaagaaaaaatctttaaatgatatcatttttttacgtcataatgtgtaccccatcttgcctaaatttcatatagacaacatgttgaatatataaacatgatcagttgaacaccatactaattgtatcagcatagaacaatatagaaacatgaatttattgtatgagctctactttactgacatttattgtattgcaataaccactgcataataattactttagataattggaacaactctaataggtttgaaaaattatctaagcctgacaattattgtattgcaataaccattgcataataattaccttagataattggaacaactctaataggtttgaaaaattatctaagcaatgccaaaaagaaaatttatgaaacaaatagttcttttgaagcatggcatgcaaatgttactcagttaatattccgcttcaataagtttctcaaatacaacttacgatacatgcccactcattcgcgtgggctacctttcttgttagaataaaaacatccttcttaaattccattgcaacgcatgggtatttagttagtgttataaatggtcttatcaaatttcaaagttccaatatttcaaatagcaaaaagaattcggataaactattttatcaaattttctatttatttcttggagagtgattgtgcgatgttatgtctgtgataaccctagttagattagttatacagaagggaacaaaagtgaaatttcatttgggcactcaaattgaaaatcatgaactgtggctgtttagagcttaaccgttgattatatatgttgctttgtatcaagtcgcctaaatcggagctcaggccaacaagatgatctctgcacctgtagattttctaatgtacaaaatatgcttaacctaaagctcacaataatgcggaatttaagattatggatcgttacttgaagccatcatgcttggtgtgattccccccccttccgccggcctcccccttccctcctccggccagatctaggagggaggggggaggggagccgccgccgccgccccgcgcgtgccgttgccgccgtcgtcgtcgccgcccccacgccccaccgccctccccaggcctccctccggccggatctgggaggggaggggagccaccgcgccgcaccaggagctagccgcgtcgtcgtcgccatccacgccgccgccgccctgcgcgcgccgtcgtcgtcaccgccgccgccgagccatcgtcgtcgccgccccgtgcctcactgccctcccaggtctccctccggccggatttgggaggggaggggaggggagccgccgcgccgcacagggagctagctgcgtcaacgtcgtcgccgtccacgccgccgccgccggtagagggagggaggggaggggaaagtgttgagggagagagagagctgagcgagggaaatgagtggtgggaagggggtggaggagaagataagacttagaattttttggggtaggtacgattttcgcaggcgcgggttgagtggtccgcctgcgaaaatgattttcgcaggcggcgcttaagtggtccgcctgcgaaaatagacagcgaacttcaccccgatttatatttttataggcggtcatttggctttaagggtcatgtccgtctgcgaaaatcagacccgtacgtcgggaaaaatgtattttctagtagtgatcgctcgtgatctcatgtgaggtagcggcctcgcgtttggatctccacctgcactggccaaagatcacactatgaacaccctctagtgcttagattaggttgcccaggaacatatatgccatatcaatatttataagatatttcaattgattgttttcataggtattagtggtttatatactacgttttgggttatgtacttctgtcaagtcatcatttcaggtcacacaacttaattgcaagcagtggtgtttcccctttataattcattgcttctggctttgtccaccagttataagttttgaatgatgtcatattttaatctactaatttcatgtcacgatgtgatctggtttagttttgacatgcttaattagcaaaatacatatttgttctctacttcaattagtttcttccaactgttacctatttattgcgttttatttattcatacatatggcatagaaatatatagctaactattcacactttttacaatatattacaacctatgggaaaactaataaaacattattaagaacctgccagtgtcaaagcaccaaaatatttattagagtgagctttgcaaatcagaaactcaacggctgtgtctatgctagaaaaaaaaactcttttacagtgcttggtaggtacctgaggtacctccttaacgaattgttatccaccgttaatcttcaaaggataatttaggaacaaaaatttttacactgcacaaatccattcaccaggaaggcaaagggtactgggtactcgagcaggtcgatcatgtacattgacgagacaatcaaaatcgatcgaacatcttgaatgatcgcactaacagcaaggcggtcaatctcatctcaggttcggatcatcaaattgatcagaagtttcagaagcacaagggcctcaggctgtcaggcagccgagatcacagctacaggatacgaaagaaaaacgacaccaaccgaccaactagtgatgaagcgatcaagcaaacaattcaatcctgcagatagattgactagattgatcaccggagatctcaactcaattgatgccgccctaatcagaacacctccttccgcaccatggcgatcatggcaacgaggtccaccgctcttgccctttaccgaaaaataattttatgaaagtcaattactattttacccttccaccttctatacctggctcaccattttaataccttttttctagtttcttctctctatccgttagattattactgatcaagcgttctaattaatttcaagcattgaagatctcttaaaatatgtgcaccacatggatgttctagtttggctgggtcgagttaagatttgggtgaacggatacaaagcaacatagctctacacatccactgttcatgattttcaatatgagttttcacatgcaatttcacttttgccccgttctttataaattatggaacgtgggtttactaaaatgcacctattctcatcaggtgcatgatattcgtgttccgattctttttgttgagtatgtatggataacctgtggcaggaacaataggtaattccccgcgttttgctatgtaagttcctaagtaacttttatttttttaataatcaagctaaaaataaaaaatatattagttattaacaacaaattaaattaaataaaattggtttgtcaaactatgttaaaagagacatatagttagtagactatgtatgagattgtagatgaaatattaatatatcccgcacatagataagtatatgttaaatattataaaaatgatggatatatatgtgtgttaaaaattaaacagcagtgaggtggaatttagttaggttgttactttgtgttcaaaacattacatttgcagaaataatgaaccaggttgcattcatttggacctttctgagattggtctgtcgattggaagatgctagcattaagcactagcacagagtgcttggcgttactagcttacaaactgatatgggacaatggactaccaaacaattgcgatgaaagagtcagtagtcatccataaattactgattgatgtgaaaattaaaaaaataaatccacatacatcattatcatccataaattacttgattgatgtgaaaaaaaaacccacatacatcattatcgatcctttctctggcagataatactacctccgtcccaaaataagcgtaaccataagtttccgtgcccaactttaattgcctgtcttatttgattttttttatgattattattattattattattattatattataaaatatgaatggtaatttatgcgtgacttatttttcttagtttttttaaaaaaatttaaataaaacgaacaattaaatgttttttttataatgaacgattaaagttggatacgaaaacttatggctgtatttattttggaaggaagggagtatatctgaaagtgctagctgttgcactcctatggtgttaggattaatatattatagtggcggcactggggcatgcttcacctgggtaacttagtagcgttgactgtttttcttttctcattacagaataaacaaatcatggttaagtgaatagaaccaggaggggatggcgattcattaaggccttgtttagttttaaacttttttcttcaaacttccaacttttctatcacataaaacttttctacacatataaacttccaattttttcatcacatcgtttcaatttcaaccaaacttccaattttagcgtgaactaaatacacccttagtttttaaacttaccagatgattggggcgaactaaagaaattattgttggactaatgtattggtgttgttctcgtcgagaatctgattcttcgtcgccaaccttgatggggaagcgcagtggaggaggcggtggtggttgggacggggatgtggaaggatggacgcaacaattgataggggcggatggcggcagaactagctgtggtggaggtcgtaatgggtgcgggggtgtggcggcggcagaagtggtgggtggtggtgatggggaggtgtagtggaagatgtaacggtgaaaacaacgggaattggggcggcaacgaaaaggttgggaggcatttgagatttgtttttcgctcttggcctcatgagcgttttacattcgcgaggcttctcctgttctccaacagtgccgcacacacacggtgtaggcgcagccgccaccacagctagcttggcaaacatgcccagtgaatttgtagctgcattcgactgtcacttttaatccgatgatgtggcacattctaatggtcaaaaagtttagtattttcactacttagatattagaccctgtcggagaatgaacacctccaccagggaaccgtgaggcccccttttgtgagttcggccgggggcagcgggtgagattcgaggattcggtgagcgaagatgtgtgatcttgagggggttcaatcccctaaagacgatgagacaaatggggtttatacagtttcgggccgctaagaagcgtaataccctactcctgtgtttgggattatggtcgagtgtagaacacaagtgcctggggttgctagactcaagcgccagttcgctcggaagtccccccctccaccactaggcctggacttccttttatacctcaaggggttaccacatgggcccaacaacctaacctagctccggtggagaagtattataatctttgcattaaatgcatgtcttgtctcttgatttgggaagccaagcgcacgtcgtcttgatgatggggcctgtcaaaccttgccgcctgacacggggggtgcccctgtcagtcaccatttaatgggtgaagacttctgggctcctattacaccgggaaacgagagccttgctttgaccagagcgggaggaccgactccggctgggataagaggatgagaacctctcaccatcattatttgatgggatatgtcgggctgcacgtcgcctgacacacgcgatggtgcgcctgacatcctgggtcccatcagtcattcgaccggtcacagaccggttgagtgcactgcacaccgcattaaatgcggcgtggcgcgaccgctcgggttgccattaatgtgggtaggtgggcacctggaggcggacacctaacccaccgtacgtggtgacctagagagggggtcgggggagcccgacccctagtcatgggagggggcggtcgccgtccgacctcgggcccgatcccccctcgggagagggccacgtggcgcctggggcagccttctccctctagtctcggccagggagtggctgccgccctacctcgggtccgatccctctcgggggagggccacgtggcattggggggcagcctcctccgtccaatctctgggagggagtggccgccaccccaccttgggcctgactcccctcgggggagggccacgtggcattagggggcagcctcctccgactagtctatgtaagagtggctgccaccccacctcgggcccgactcccctcgggggagggccacgtggcattggggagcagcctcctccaactagtctatgtaggagtggccgccaccccacctcgggcctgactcccctcgggggagggccacgtggcattggggggcagcctcctctgactagtctatgtaggagtggccgccaacctcacctcgggcctgactccgtctttgggaaggagtggccgccaccccaccttgggcctcactcccctcgggggagggccacgtggccttggggggcagcctcctccctctaaacatgatacccccgggcccatatcaccgacatacccctagtaaattttattctagattaggccagcagtgggtggagttggcgatgggtggcaacgagatatgaggttagcaggtggtggtcggacggcgacaaagactagaaaaaaggtggtgcaggggaatggtgttgccgttggcttagtgaggaagtgagggagggaggtggggagggggagaagggataagcccattcccaacccaagacactagacatagtttctataaactccacatcgtcaagaaactagtactagacactactcttccaatgcaaacaccactattccatacttaaatttaatgctacttatctcacatgatgtcttcgatattgtgtagaaaccatgtctcatgcaatactctctccgtcccacaatataaggaattttgagtttttgcttgtaatatttgaccattcattttattcaaattttttttacaaatataaaaaacgaaaagttgtgcttaaagtacggtagataataaagtaagtcacaaataaaataaataataattttaaaaaatttgaataagacgagtggtcaaacgttgcaagcaaaaactcaaaatcccttatattatgggatggagggagtatatagattccttttatttcctcatttattcacttgccacatcatttttcattctaggtggcaacttatttaatactatgaacactatcctagtcattgggttggaaatggcctaatgcttactattgcgcatgaatcccgatgcatgtcttagacgtaaaaaatttggctcaaatttatgatatttttggacacctgaaaactaaaaaaattcataataaaatcaagtacttattttgagtaagtcgtttttatactagtatagtacacacggtacaagctgaggttcacaccacaaatgtccaagctagatgcatgcaagtgcccagcatggtagcacgagcatctggtcggtctttgggacggaagaactcaacgagttgctagttctgaattctgatcatccagaaacgggtagtccgtgtagcccaccacaggatcagaggtatagaacgtgctcctgtcatacttgttcagacctgccttcctcctgaacctctccggcaggtcagggttggccaggaacagccgcccgtacgccaccaggtcggcgtagccgtcggcgaccgccttgtcgccttcgtcccggtcgtacccaccgttcaccatgaacgtgccccggaacgccttcctgaacggaagcaggcggccgtgcgcgatcaccggcttgctgccgtcctcgccggcgccgacgcacattctcggctcgatcatgtggcagtagaggacgccgaggttgttcatgaggccgatcacgcgcagcgcgaggacctccgggtcggagtcgtggcagtccatgtagtcggcgaacggggagaggcgcacccccaggcggtgcgcgccgatctcgccggccaccgccgtgatcacctccgcggcgaagcggcaccggttctctatgccgccgccgtacgcgtcggtccggtcgttgacgctgtccttcatgaactggtcgatcaggtaaccattggcgccgtggatctcaaccccgtcgaaacctttgttagaaaatgagtagcattgttaagctgtggttactgataccgaagactcttaacacttgaggacgtagtatctggttaatatcgactaagtgtaaaaaaaaaacaatgtttcgtccattgacttttaatgttgttgcaatgattaaaaaaagaaaaaaagaaaaagaaaatatgtgtgggtcgatcaaaccatttccaaacactttactcgttgcaacagaccgaatcagcaattgcaacaaaatttcaacattatcgatacataacatgtttacggcggatatgtccgagttgtgtttattaccggcctcgatggcatttctggcagcaatacgaaagtcgtcgacgatgtttgggatctcctctgttttcagtcttcgaggaggagcgaattccagaacttggccatcatggctgacctgtggggtcacttgcttgtccgtgcttgagatgggtgcttgcccattaggctggaactctgaaaaaaaagaggatatatgattgtccatccttaaaatcaccagcggactgattgcatccatcttgcggccaactggacttaacaaagtgtcgagcgagcaaattcccaggagatacgaaaagatactcagctgatttggacttgacttcatgactaatttaaggaggagggggttgtcactttcattttagtggtctatttcaggaccataagaagataaggatatataaatatctgtctaaaattattattaaaaatatatcacaacaaatcaaaatcgttttggatgacaatacaaagtagagccaagcatgaatgagagagaaaaaaaggtagccaacaaatcacaaaacagcaccagttcattatcttaaaaaaaaagcacgagtttcaccagcgtcgatcagtgacaaatcatcagcagtgttgggttgcaaaaatttctgaaatgaaactgccgaggtgttgcttagatcaaactataaactaagaactacgaaacgcaaacaatatactttagataattagataaacttttagcgcatggtactatggcaaactgcagaaagatgaatcaaaccaaaaaacttaaaaaaaaacataaaaggacgacttggagaagaactaatcaagtatagatggccatgtgggccgcccggcacggcacggcctaggcccggccgtgcctgggccgaggcttgtcgggccggcacggcccgaccgacgcaccgggccgtgccgtgccagctcacgtgctgcactcacagcccaggcacggcccaacacgcctcgggccgtgccgggccggcccgaaggcacgatgggccatcgtgcttttcctcagaataagtctaaattttctccctcctattgggctgtgacattgtatagctaaaaaaagtctattttacctccctcttctttgtgctgtggtatataaatagctaaaataagtctatttaaggtccctattctttagacattgacatttatatgtctatttttagtccctatactttgtgtaccgggcctagccagccagcccatcgtgccgggccggcccgaccgtgccgggccagcccagcgtgctggtggggaggcccaggcacggcccgacagtcgggccgggccggcacgggcccgacccaagtcgggccgtgccgtgcttgggccgggcaaaaaggcgtgccgtgggccgggccttcgggcctcgggccttatggccaactatataatcaagcgagcgagcgtcaccctgcctgtcggggagacgcggcccgtgtgccatatctggcagaagaagacggcgcccttggcgtgcacgccacgcccccacctgctccgcgctccaaatcccgggcacgtcggggtaccctctcgccgtctccgacaccgcgcaggcttccgccaccagcagcgcgccccgcgccgcccgctgcgcgtagtacgcggcgttgtgcggcccgggcacgttcccgtaggaccggcaccgcgtcaacggcgcaagaacgaccctgcatcagtacgcgcgcgcgcgcacacacaaggcagaagcaaattgaagggatttgcatgaaacgtgcacaggagaacccgatcgatcgacgagaacaatagcatggacacgaacctgtgagcgagatcaaactggcccatcttgtaaggggtcagaagaggggtcgacgcctccattattgtgacagcttcgaccgatggttggattgttttgtttgtgcaagaaatgatgaaaaagaaggctgcgaggcgctgagctgagcttgttctgccgctgaaccttttataggcagagggaagttgcgtcactgtagtagtgtgttctgctttcgcgcgcgcggcagagtagtggtgtcctagttgactttgcccggccgaaatggttcgctagctgggatattatagtcttctttggcaatggcgtgtgcttgtctgcccggctaacggaaggggacgggcaggtcctgtcattgtggcattgtgccaatcagcggtcgatctaatcttgtatgaattaattactagtaatagactagctggtagtaccaagcaatgaacacaaggagatagacgtacataagtttctttttttttttctattgtaggtcacgcaggttccatagtcatagtgtagattattgcatctatgtgggccacaacacataaatcgatgaattgggacgaaagcgacttcacttttccttatattatatcacatcaaactgaacgaaagtgacagtttctgagaaaaaaactcccttcatccctcccaacataaattcatttttttatccatattacacatattaatataaaactaaaaatactataatattcctactttatcaaatcttaatgcaactagttctcactttatctatttccaacatagttacttcataatttcacaaaccctgatggaatgattattaaaaatgaaattatttcgagagagaagtcaaaatcttgtataaattaattactagtaatagattcgccggtagtaccatacaatgaacatatggaggtagacctgagtttctagtgtaggtcacgcgagttacatactttaagttgtcgcatctctgtgggccacaacattataaattgatgaattgggacgaaagcaacttctcttcttttattatatcacatcaactggaacaatagcaatggtttgtggggcgaaaaaaaaagtaatgagattgttcaggccttgagggtcacgtcttagtactactcacagattgtgacggagcgcacactatagttttgtttttttcagctcattgttttcttcatttcagacaataagttatcgtgaggcgcaaataaaaaaaaaagctatataggcatgtgtaaaaaaaaccatagacttggcagatttttttttcccacaaaactgtatatatctagttgtttggatggcacaatctacatttgccacaagacacgaaactattggagaaatgagcatgacatattttatggtgaacgagacttgtgcccatgaaggtggcaaaatacggcaagaaattaaaataatatgaaccaagcgtttgccttggttggtcaaatttggcttccacaagtgtggtaaatttgggtagccaaccaactaaataatccagctagaatccaaataacataaaattgtaaatttagctctcttttttttttttgaaatagcatgggcacatgaatatatatgaggtggtgaaggaaatgggatgtgtattccatcctacccacccaacctgaagctcgcgaggaggaaatgggcaagaaacatggagacccggtactatccgagttcaaattagcctgaatccgcacaaactatgagttagggataaaggaagagttctatctaaccgtatgtcctatattataaaaaatttatataaatctattaggaatccaagtagctacaaacatgataaaatattggttaatcactattttacaagttcataactaatatagcataaattcttacttatgtatctttttaacactctaattgcctccctagatttaatatctatgaattagtgatacaaataaatatccattcccaaatctaattccgagaaaaaaaaatgagataggatacatgatatctatgtcaaccagaagaacaggtggactaggggttcatgatatagaaaaccagaatcaatatttactaattaaatggttgtttaaactgattgatgaagaaggactttgacaagatcttttgaggagaaaatacttgaaaattgctcaattattcaagctggatggaaacaagtagattcccattttttattaggtcttatggttaaagatagattcttaaatttgggtccttgaatggttaataatggcactaaactaagattctaggaagacaaatgggtaggaaattattcctttcagaatagatacccatccctttataatatcgttcaaaggaggattgtttcaatcgcaatagttatgagttatgttccacttaatgtttcttttagaaggacgttggttgatcagaacttagataattggcacaatttagttgtgttgattttacatactaatatgaatgatagcaaagatagctttacagggaatctcatcaaaatggttagttttctattagatcaatgtacttatctttgattaacaatggtcattgttggtgaaatgggaactagggtatccctttccccagtgacccgagcttacattcttattccgtagaagaaaaaccttatttagtcgcaactaaagacgaccgcatgtcagggtaggggacccaggacccgccctacttcgggtcccaagggctcctatgttattctatgttatacatctctatctctctctccataggagtgtagatacatataaaatctatatctaagatttggatctataaattagcaaggcggagagcccggggccgcctttgaccgggtcctagtgctctacttgcccttctaggtcacacattcctccttgagaggagtgtggagacctataagatttacatcctaagataataagccaggggaagcctaggacctaacctagactaggtcaaatggcattccttacctttctagaccacacattcctcttttagaggagtgtcgagacttataagatttatatctgtggatttggaagccatgaggagcctgggactcaccctattccaggaacaaggacccctcaggctcttcttagttcgtactctcctttacgtggagagagcatggagacatgtaagatctacatcccgtggatgtggacttagtgtcctaaactcattcataatgtcttcgagaagctcgtcttaaataacaagactacctactaaggagcatcggggtgtgcccgagaacgagagggtccatgggtccagcccccaactagctatttgctagtatgtgaaagtccatgaaacgggttcacagctggatttccaagttttctagaggtgaaaagacatggaaaatatggcactgctgagtcacctgggacaataggagtgaagccgcgcgtcaaacatgcccaacgacacccagtagcgccagtcggcagaaaagtggagatgtgacattatctcggcaaggcttgggccctctgggcccaccacttggcgcgtggcgagctaaacaatggcccagttggcctcggtcatcaccgggggagcctagggtaatccaaagacaagatcttcaccagctggcctcggtcatcaccgggggagcctgggcaatccaatgacaagatcttcagtaggtcttgcattaagaggccaaagaaccaccaagcagcgacaagacaactcaaagccaaagtccctagcctacagcagaattgcaagcccctctttgaactataaaaggagagggagatgccacttagaggaggatgcacattatctagttcaagaatagttaaatcttgtattttctccatatcaagatagcaaaaaaaaaaaaaaacaaacacaggagtaggggattacaccttcgggtggcctgaacctatataatccgcgtgttcatttggattttcacagttcttaacaatttcagtcaatgcaacttcatctgtagttaaccccctggccgaatcttcactcggggagaggtctgcacctcccccactgttggttgatcgctcctccgacagtcatattgagataaataagtttatatagaaactaaaaatgtcaattaaaatcaagatttttatgtgtgatttctgttcaaaggactaattctaacctataataatttagcaaaaagaaattagaatggtagtaaaagatgctattttttatgagatatgagactatatattcaacatttttttattgtcatattagaaatttcgttggagagtagtttatattttctttgaactaaaacctcttaatagtatttctaatatacctaggaattggctttgtggtatcgattcaagaacaaagaaacttattttttttaggagcgtccacattatgtgggttcaatggttgtgtagaaatgatgtggtttttaataaatcttaaaaaaacttatggtgcaggtacttttaaaggcaacacactgattctagtttagggcattgtttcaaaagtgtgaacagaacaaggagctaatacatgttgcatgccaaaacttggaggttacagttatgcagattttcatcattttccgttggagatttacaaataaacttcaataattgtattatccttaagtgttagtgtatgttagtcaaactttttttggttgcctggattattgctctctttgagagaattatgtaacaagtgggtgtagcttctctgaagcaaatgccatattttattctattattaaagaaaaagaggtgcattacgtatgataaataaacaggagatcaaattaaaaacagaaaaaagagtttctttataccaccctcagcctctctgtgactttgcccctgatataggcttcttgcaaaatgctacatatacaaagtagcgtaacatgcatgtccaccactccattttattcgtaaggtcgaccacaaactagctttaatttattgctgacttgcaccaactttgaccatagtatcaacagatgggtcagtcgaatcaatcaaacagctagaggctgctcaagaaacgggtagtccgtgtagcccaccacaggatcaggcgtgtagaaggtgctcctgtcatacgcgttcagagccgccttctgcctgaacctctccggcaggtcggggttggccaggaacaatctcccgtacgacaccaggtcggcgtagccgtcgccgaccgccttgtccccttcctcccggtcgtaccctccgttcacaatgaacgtgccgtggaacgcccttctgaacgggagcaggcggtgcgggacgttgcggcgcgcgcggtgctcctcgatgctgctcacgcatgcacctcggctcgatcacgtggcagtagaggacgccgaggccgttcatgacgccgatcaggtgcagcgcgacctcctccgggtcggtgccttcctcgcggcagtggtccgcgaacggggagaggcgcacgccgacgcggtcggcgccgatctcctctgcgacggcggacatggcatccacggtgatgcggcagcggttctccacgctgccgccgtactcgtcggtgcggtcgtttacgctagccttcatgaactggtgaagcaggtgcccgttggccgcatggatctccacgccgtcgaaaccttcgtcaaagcgtaagactaacggtatcaataacttggtaagatctctagtagttagatggtgaaatattaccagctttgatggcatttctagcggccacacggaagtcctcgacgatctggactatctcccctgtttccagcctttgaggtgccgccggtgccaggtcatcggtatttccaaaatagctgacttgaggtgttactggattatctgtgtttgaattcggggcatgaagggaagtttatgtgaaacaataagagcatatataccgtaaaatgttctctttccaatactcccttcctagagaaaaaaaagagttgtaataaagaattaaacatgttaagtatacccgttgaaaacacgcgaccgttgtgccagatttggcagaagaagagtgcgcccttggcgtgcacggcatcaacgatcggccgccaggcctcgatttgctcctggttccaaagtccaggcgcgtctagggacgacggaagcgtgtagtggctttcttcagcaccaccagcattcccgctctcgtttaggcgtgacatgaaccaccattttgacaggttattccggtcatttacccctgattcagttgctttgacaccatctgtagctgaattatagtctgttaagttcgtgccgaaaagaaagccagggggacctggacgctggcggtggattggaccgttcgcagcgtcgtccttggatcgtcccaacgcagcgtaggagactgcgctggcctctgcaatgaggagggcgcccggcgtcgccctctgcgcgtagtagaggagattgtgtggctggggcatgctcccatatgatctgaaccttgataccggtgcatgtacaatcctgtaaccaccgccgtaagtttccgtaatgaattttagtaattttttcacggatttgctagaaaacttcccccaacagcctgtttggcaagagaagggaagatgaatgggagtttcaaggagggagttggtggtatgattggttatgggagttacatttttagttcccatcccttgtttgcgctgtgtttagttcagcgcaaagtttgggttttgattgaaattgaagatgatgtgactgaaaaattgtgtgtgtatgacaggttgatgtgatgaaaaaagactgaaatttagatctaaactttgaatctaaacacagccttagtcgaatcccaccaagtttcacgaattaataggcctcccccaggtaagagatttgtaggaattggacctcttaattccccatctcaaacactctcaaatcccaagtcttccaaccaaactacaaccaaactacagacttaaacttccagatatcataaactcccattccccatcaccatctccctccaaccaaacaggctgcaagttcttttcccccaaaaacactcagatttgtgaccatcgtatcacctcgagatttgtgcacgaatgaaaaaaattgctagaaagaaaatttcacacatatcacatgtcccagtgctagctaatcaaaccatagttgaatggaagttttatataagttatattatggttgcaacgcagttacattgcagtcataatgtaattataatgtaattgcactttaattatactgtagttacatataaaagtttctgcctcaaaaaatttgctgcatttatttttacatactcccaatttcagagcttgtaaaagtacatttcttaaaagaaaaattgtgcaaaagtacaatcacgtgtcccgtatatatgaaagtaacacattgtttgtaccaaagaaaagacatctcaactttcaggaaattttataggtggggtggaccgtggacgaactaatcaagttctttacttgagagtaactagttcataactgacctgtgtgccaggttgagctggcccatcttgtagggtgtcaggagatgagtgtcctccatgtgtgtttgtatgcttttgacagcccgatctatataacgcacctctgttcctttcgaggctatttcggctcgcttctacatcttctagcttggcatcttgagtacttatagtggaagaagaggtgtagttaattagtcatatcaaattacgaatcgtatatatgcatgttaatggctatgtgcttttctggtagcactcaacacgtactgcttaacaaccggagcgcgcgagccgcgaggattcgtattgatccggcagagttgacttgggaatgagaggattcgtgttgatctggctgttgacttcggagttgggaggggtttgcacgctatatacatcggtagtagctagacgctagatgcatggagtacgctagctagctagccccgacgccgcaccggcgattacacgaacccttttgtttctgtgtttgttttagtcccagaccatgaaatctatctattatattaatggaattaaaaaataagaaatattagaagagaagactaaagtccatatagaaatacaattagaaaataactgaaatttagaattaaaaataaggaacattagaagtttagaagtagagtatagagttcatatagaaatacaattaggaaataatagaaatttgaaattaaaaataaggaatattagaagtagactatagagtccatatacaaatacaattaagaaaaaaatagaaattcggaagtaaaaaataaggaatattagaagtagagtatagagtccatataggaatttaaaactaactaaaattcagattaaacataataaaatgaaaagtagtgtttagagtccgtataaaaatacaatttacaaataactaaaattcgaaatttagaaaaacatgggaataagagtttaaaatcaatataggaatacaatttagaagtaactgaaatttaaaatttaaaattaaagaatattttttttatcaagaggcgtgaaagcctctcatttccattactagaaatgatagagtttacaggaattttttttatttttaattttttttattaaaagttttacaaaaataattttccattttgaaaattgacataagtggtcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgtattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacatgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcataactgatcaaagttcgcgcattggaagaatctccggccccgagtttgtatcatgagggaagacttgagtatgcatccatccccacaatcgcacaaaggacggtcacaccatggtagaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgttgttatggactgtgcgcgctactggatctgacactaccgtgaagcgccgaaagtgtgttgttgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggacagaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatttaatagtattaataaaaagtaaagtaccgtgtgggcgagggatcgacgctccgtgagaggaagagctggcgaacacgcccgaagaggtggcgaacgcccctgcggagctcgcggaagcgccggtcgtgcctgcgaacgcgctcgaaggcagacgaggtcctgcgatgaagaaacgtgccgttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtaccgtaggtcgaggtgctgctccgacggtaggcgcgcgaggccgtggttgtaccggaccagctggaggtacgacgtccacggtgctgcgacaggagaagacgcgcatgaccgcacgcatcttctcctgcatccagtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtcacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaacgacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctcttggctgcccaaagctgaagcaacatagggcagccagcgatgatcgctcccgcgtcagtcttcgtgcacggcagaaccccagctccactgcggcacgtcctgtggctgagcatccacgatggaccgtgcgtagtggaccagccggaagtccacagcgtgcccgtgggtgctagtgaacatcacccacccgaacaaccacaacaggtacgcctcaagggagcgtcggaccgagttatcatcagcgtcagggtgcagaaggtccgcctacaattaagaatgaaatgttagtacaaaacactatgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctgaggtctccagcggtctaccagagcggcaaggagtgaccggtctgcatcccaccgcttcgctgggtcacggtcgtccgccgccgcctcaacaagcttacaaagtggtagaaggcctgccgcacgcaacctgtatagaacaaacttcaaacataagtacaacataaagcaaagttgagttgaaatgtgaacatacgcgtaccaaggaacgtgacgggggtcgacacgcaaccacgcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaatagattgatcagaaacatataaataattagttcaacataagtaataaatgttcataagcgaattactaacacatattaaacaagagtacaaacaaacaaaagtgtcaccatacggaatatttctgattacaacaataactgcagttacacgatatgagtacttagtccgaacactcatcacgataacattatgatacaacaccgaatagttcgcaatactactagtacaacaatagtcagaggtactcattacaacaacattcaattgaaattacacgatagaagtatttagtccgaacactcatcacatcacaacagcattttatttcctaaatcgatagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcaacgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6207 - DNA, 1557 bp, Oryza sativa
acttttctatgagcgacttaaaaatcaatttcagaaaataaactatgatgaagaaaacattaaaattaactccaaaattaagttttaaaatctaaaatttggttgtagccttgtaggtgataacttaaaaaacatcgaaatccttccctatgacctgataacttgaaaaatgctggcttcctagttcctactcatgcacagcacaaccacagcctgaccacgagaaagacagaaaggaccttttcaagttttcttcacttcttcgaagtagccacaaggctagaaacatgaacatgccgtcactgacacctctcactttcaagtgattgcaactggggaaaataataaaaaagaagtcaataaatccgtactacatttgactgtgcttttggtaccaataattctgaaaagggagaagagattaggaggattcatgggaaccagcagctgcacatgcagctaaggtttgactggtgtgagtgtgtgcatgaattcatgatccaaatggtttgaatattatttccggatccggttcaattcgtcatttgcttggctggtgtcgctcatacgtagcacgctactagctggctattcgtttcaacaaaggcttggcaatattcaaattaattacaaataatttgtgccaagatgagaatatatatatggactgctacattgacaaaatcagcattgctatatatgtaggagtatatagtactagtctttctcatcatgaatactggaaaggaatttgtaatttgaacgcaagttttggtgaagcatacgtgggaggacgcaatcatgaacaaacaaattaaaccagacaacgcatgtgctgccccttgcataccgcgcacgtgccatactaattaaataaccacgagtctactcgctggattcatgtttgcattatatctaaaacattttttatttaaaaaacattttacgttccattgtcattttaagggatttatttgttattttcattccttggctccggaggtagtgaaaagtcgacctgaaattactttcaataaacggtctttataactaaatattttgggtttatactccgtggtccatagctaatataagtgacaaacatactattcgatcccgtccataataattatcgttttacacataattgaggttaaactttttagaactttgactatgtttaaaaatatttgctttacaaaaatagcagttacattacatgtatagattaatcttaaaatataaatattctttatatatctcataataaaaaataatagtaaagtttttttatttaaagcgataattattatgaaactatagggagtaccattttcttccagcatggaacatacaccaatttatttttgagaaacagaaaacctacaccacggcatcccgtggagacgggatctcctctactactcctctccctccaaatcatccggatcccctcctaatacctcactctccttccccaaatcacacggcactgtagccctccccgacacttctcatacctcactcttcttccccaaatcaggcggcactgcagcc

SEQ ID NO: 6208 - DNA, 802 bp, Oryza sativa
aataggtaggcaaatatatcatccaaaccagagcaatccaagaggtcgaatgtcctgatgcagccttgaacgacgccaacgtagacgatacaattgcctggaccggcggaacattggacttatcccttcgccggagatcgaagacgatgcagccctgcgtcgggtgccaagttttgccggaacataaaaacaaaagtagaagtaaaagggtggcgatgcgccgaattgtattgatcgtagcaatagattacatagacccgggtgtacatatttatacccatgggttgatacaagtccttgtcggacaagaaagaaactttcctaaagataaaaggaaaagataaagtccttataggacactaaacacactttcctaaagataaaaggaaactaacaaactattcctaattaatagataacttgccatgccgcattctctttgaactcagtctctggataagcttcttttagtagatcaatttccttaaccgaatatagcaagaatccggcaactgacgacttgacaattctcatcggctaatctcaggacttcgaagccgatgctgactctcagccgatgactactccgggcttaccaaatttcactgttaacacaaggctagggttggcacgtgacatttgaggtgaattgcggccaccctctggagctgggaaacagatggtgtggtgccaagctaccccttgtccacaatacggggaacccttgtaccatatcaccgacatattggatttcattttgggattctctgggcatgctctataagtttctatgctgcactga

SEQ ID NO: 6209 - DNA, 2241 bp, Oryza sativa
  unsure (1)..(2241): unsure at all n locations
tgcatcaccatcattgtagaaccaatgtgcaacaccagctgggagtgcaacaatgtctccttgcctaaattgatgaatcttttggtgctcatctctaaacttttggctctgactttggccttgagatgaaaattgttggaattgttgctggtaagtcgcagggcaaccggggaaggttaaacccatagaacctctccctaaaaattataatgttcacataaggtacatacaacattaatttgaccatggagatcataactactagttgcatcgatagagttctcgattatatttattaggatacaaaccttggatgatgtagaccacgccaggaatatttgtgtatcgaggtaccaaaaggccttgaggctgaatgacacgtcggatcacaaaagtacccgtgcactggaataattcattcttctcatcgaagtactcagtcaccccagcttctgacctcactttccgaagtggttcaaatgcttgtagtctatcaaatctacactccctaaaacttccttgccgaggactatgccatgggtttgtgctgggattaaatagctgggccatagaaccatggcataatagaagaacacaaaagtatatagaaaaccgagagaaaacggaactcgccatagctatttgtacttgcttatggaaacttaagctaattgatgtgagttcaaagacagaccaagctagtttatatagcaataaaaaagcatcttgggatacatggtgatatagtttgttgcacgtacagacaatatatggcttgtagtgttaaaacagtacaaaaggaaaggtaactttgcaagattgaactatacatttcatgactcagccatgacaaacttctggtgcttttggagtaatacaaatggagtttgttaaagaaatgtctatccatactcttaatatgtatctttgccttgtcattatatttgtttttgcaccataaagctcttatgcttgagaagatgagtctaactttaagatgataataacttgtaagcatgttgtcatttttgcgtagcaagctatatttgataatttaggtgttccttcaaaataacaaatttgtaggtttgttttcatttacttgacaattgataagtaacttgtatttttaaatgacatacttataactntgttgtcttgtaaaatataccggacaataaagcatattggtgtatgtaatttttccatccataagccttcttgcagtttattgactatataacttgcctattgattttttaagtgttccttcaaaatagcaaatttgtagggttgttgtcatttacttgatacactacaattgataagtaacttgtatttgtaaatgacgtacttgtaactttgttgtcatgtaaaatatatcagacagtaaggcatattggtgtaagtaattttaccatgtcataagcctttttactgcttattgacccatataacttgcctatatatattatttaactatttgaaaaacacatattatgataattttacacatctgaccacggagagctgtgaggctacacgtgggcccgtgtcactcaaatccacccaggcgcacggattgcttcccgtgcacctaggacggctccccgcgtgctcccgctctatgtgaatcgtgtttgcagacgagtggacccactcgggataccgcgcgggggaccgagtacactagccttgtgcactcgtcctaggccacatcctcgtccggtccactcggtcccccgttcgtcgtagctgctccgtcgtgtgttcgctcggctgtgcccacgcagcacgctgggccacacgccgccttcagcccaaaaaggcagaagccatcccctttttcctttttctttttccatttaattcaataatactttttttctttagacagagaatcaattaatcttagaaaatccatatctcttcaactgtctgttcgattgactctgttcaacttctaaaattcctcaaaaatcgagatctattcagtggcacacttagtactcactaatacgagcttttccttggtcgttttgttgagttatctcgttccacgtgtagcttcggagccagaagagtcctagtgcgcggaatacgaggaagaagctcaagatatcaagcaaggtaggtcacctttgattattttgagcccataatttgaaactaagtatttcatttctcaaaatgcacatctctaaattacacatgaaatgttggccgcagtttgcaatataa

SEQ ID NO: 6210 - DNA, 1679 bp, Oryza sativa
tccaattagtctctccaacttgcacgcatgatcatcagtctggttcattgagtaaactcacgtatatattctgctgcatgccactagctctatacacatgtagccagctatgtattttccgcccgtgctccggctgtgcggcgacatgtcttcgatcgccggcgccgacgtgccacaccgtcgctccataccggccggcccgctggtcccaagctggcatgcagtcggcggccggcgccgttggtcgacatcgataacgattgatcatatgccgccgccgccgccgtcgcccgcggccggccggccggccaccggaaaagatgggtattgagcgtgtacgtgcagtggacattacacgggatgtgtacgcggtacgttgaaggaattaattaatttatggaagactaattttccttttattaaaaaaatagaagaaatacttcttccgtcccgaaataagttaatctaatatggaatgtggtatttcctactattataagtttgaacatatgtgtttgtctaaaatcgttgtattagaaatatcacattccatactagattaattttgttctgacgaaggtagtaggaagaaggaattaattggtaggaagattaatttcctcagacatatatgagtaagaggaattaatttgtaggaatattacattacgtcgatcgggagagagagagagatcgatttgttgcggtggatgccgatgggagtaagcggcaggaggcctcaaagtccgggaggtggcctgcgcgggtgcacgtgcgcgcgccgcgcgctcatcagcagctagctgcggcttctatcccggccggcacctgactttcagggatttatgctattttatttatatacactactactgctgctggataattcattatgaattcctgctcacaccttgtttggttgttaattcctaatacaaacccagtacacatatctaagaattataatttttttagtttcaagtactttttttgaaacaaatatgagtatatccatattaattttagaagttgagttgaaattattcgaaggtctattactgtatctatcctaaaatataagatttcactcatgcatatatagttgtatatatggacaaagtctctcatattataatataagtagtcaaagtttaaacatgttaactacatgtatctaaaatgtcacttattggtcagtggtggaagcaacttagtttttagagttaattgaaaaagacttcgataactttcgttatgcaagcttggctttcggttttggaccgccgctcatgagtcatgagccgcacaaccgcaaaaatgctttccaagcagctccaaattatttttctgtaattattaagtatatatatttgtatacatatactccttcatatatatatatatatatatatatatatatatatatatatatatatatatatatatatatatatatatataacttcattttaaacatgtgcgcaacaattaaaaaaagagctcagtgacttttgtttctttttattatattctgtattggaaagggtagtcatttttatgttggatattgtttaatttacttggctataacaaacaagaaaggaaataaaatgtgactgtacgttctaaataacctatattcatgaaaaaaaaaggttgattgaaatagacttacatta

SEQ ID NO: 6211 - DNA, 845 bp, Oryza sativa
gggaattgtatctgattgttttgatgtttttgcagtggaatgcgatgaattctatgcgaattcgctcttcgtcgtcggcgagtttggtggcaacgactacaatgcgccgctgttgcgggaagggcctttaggaggcctacaagttcatgccggatgtcatccaggctatctccgatggcatcgaggtagaaattcaatagcttcgttgtgtcgcctatttgttagtggtcatgtggagaatgtgatttcaattatacaactgttcgtgtttggtgcagcaattgattgctgagggcgcaagggagctgattgtacccggtgtgatgcccactggatgcttccctgtctacttgaacatgctcgatgagccggccgatgggtatggcccccagagcggctgcgtccgtcggtacaacacattctcatgggtgcacaatgcacatctcaagcgcatgcttgagaagctccggcccaagcaccccaatgtgaggatcatatatggcgattactacacgcctgttatccagttcatgcttcagcccgagaagtttggtaagttcttgagctctttgatagttagctagctcaggaagcatcagttcgttcttatcctttatttcacatcggtactaaattggcttttctagcaaaataactgttttttagctcttgctgctctaatttacttgaacagatcaagtcaactgatacctagagtcaacttttcctcctgtcacccttgaaagacacaatatattatttttagatagttcagatctgggtagaggtgcataatctctctagtagcacaatgcaatccttcttattgcagtaatgatgggtca

SEQ ID NO: 6212 - DNA, 3322 bp, Oryza sativa
tcctacttcatgccatggatattccattatggactatagtggacagggccggtcctatgattttgagggccctaggcgaacccatcgcgatgggccctccaagctatatataaaatttattgatatatatagacgctaattttacttgcaaaatgaaaacaaatacatctatatattaaatttaacattcctggtaattatcaagaaataaaatcgaccaaaataacaatatatttgtaacttggaactaatataattatttattaacttaatgaagaatagaaccccgtcatatccattgcttcctatgaaaagatacttcttcgggtatttcttgatgcaaaatcataaagaacggtattaagatcaatagtgtccaagatatccttctcgattgagcacatagccaagccatttaaccttatttgcgacagttgatctcaaatagtttttcaacaacttcaattttgataaacttatttcagctgaagctaccatcataggtaaagttaagagaattcgataggcaactgaaacatttggatagaaatctgcatccataacaaacttcaaaatcttagggaaatcgaagaatctggcaaactcactttcatcacctttaattctgaataaaaatcattgatctcaacatcggatgaggtactagactactagtattaggtgttgccccccaccattatgccccccaccccaccatcatgggcccccggcggtcgcctcggctccatagggccagggccggccctgatagtggatgtggctatattcatataatttatcctataaacaagaaacaacatgtcgtgttgatttcgtgaacgacatttaaatgccactcttaaggtcttggcaagatgcgggctccgtggcggcgacgccgatctggcccggcaaggcctaggccgttggctgccgctgtccccctcgtcacaaccctcctcctgccccctgaagcccgtcgcatggctgtgtgccagtgtggaaggaggggatagagagagaagagagatgggaatctgacatgtgggcccaaggacatttcatacatttcacacgatttctccctcctcttaaaccaaaaattattattttagtgggtccagtgtccaccagcaaatatccaacttttgaaagtgtcttcaccccaaagtcactttggtgtcctgcagttaaaactgcaaagccacgatgtactgtagtaaaatttgcctttgatttttgagcccctcgtttctcttcaccacgatgttgatgaatgaggagtgctatacgcagccaagcaactttcacagagcaaaataactcgcggccgatcctaatccggagattcacttggattcagagtgatcggatggatgaagagcagaagaggatttagcgtgcgacactggattccatcggtcgaacaaatggcatgcaagacagggcaccatgactgggatgggcctaatggccggatttcatttcatgggccgcgaacttgtcccgacagaccagcccacgggtcccctgttcctactctctcccccctcccgtttttttttaaatggtccttttcaaaaaacttattgtgaaactatacagtacaagacactttaacaagaaataaaccgtgaactcagcacaaactgtctttgcgctgagattaaccagcctgagaggagtgtgtgagagaaatagaggagtggggaagggataacataagacaggaaggaaagggaagagaaaatgagaatgagatgacatgtgggtcccgcgtaaggccccatgttttttaattattttttttggttaaactgacacatgagctccacgatttttatcgaattgaattgccacgtaagcgtcatgcaaatgtcatatgggacgaagacctagtcaaaagagccacctcagctaaaaccgtaaacaataccgtcgatggacctcatttacaaatgttttaaaagttaatgggatttgcgtaatattgttcaaagtacgatttaaaaactaaaataaaagaggaggacctcgagctaacattttccggggcatttaactatttgccacttttaaatttggtatttaactatttgccacccctatctcaatgaaatgtggatccatatgtgtctatgacatatgggttcagaggcaaatagttaattgccacatctaaaagtggcaaatagttaaatatctcaacattttcctcatctaagggtgtgtttagttatttgagtgtaaagtttttggagtatacggacacacatttaaagtattaaatatagactaataacaaaacaaattacaaattccgcatgtaaactgcgagacgaatttattaagcctaattaatctatcattagcaaatgtttatgtagcatcacattgttaaatcatgacgtaattaggcttaaaagattcgtctcgcgatttacatgcaaactgtgcaattgattttttttcccacatttaataccccatatatatatatataaatatttgatgtgacgtttttggcctaaattttttctatctatttggttttagttccactaaaattgaaaatttggttgaaattggaacgatgtgacggaaaagttaaaaatttgtgtgtagaaaaattttaatgtgataaaaaagttgaaagtttgaaaaaaaagtttggaagtaaactcgcctaaacaacacagtcccagtctcacagtctgcctacattctccagtctccacttcccacctaagcggagaagcgcggggaaccgaaacccggtgatggcgcacccgcacccgcggccgctggaagacgacgacctcctcgccgagatacttctccgcctcccgccgcggccctcctccctcccgcgcgccgccgccgtctgcgcgcgctggcgccgcctcgtcaccgccgaccccgccttcctccgccgcttccgcgcccaccaccgccgcggcgcgcccctcctcggcttcttccacagccaccgggtgagcccctccttcgtctccaccatggatccccccgaccgcgtcccgcggccgtgggcgccggcgggcgcttctcgctgcggttcgacgacttccgctgcaggatcctcggctgccgcgacggcctcgtcctcgccgtcaacccagtgatgccgcggctgcgcggctgcttcctcgtgtgggaccccgtctccggcgaccagcgccgcgttgccttcccgccggagtgcgaccagggacagaccgaggtgcggaacggcgcggtgtttcgccttcccggcggcggcggcggattccgattccagatcgttctggtgggcacccgccat

SEQ ID NO: 6213 - DNA, 520 bp, Oryza sativa
tgaaactcccatgcatcttcctttctcttgccaaacaggcggtttggggaagttttttatcaaatccgtgaagaaattactaaaagggattacagaaacttacggtcggtgggttacaaggattgtacatgcaccggtattaaggtgcaatcatatgggagcatgccccaaccacacaatctcctctactacgcgcagagggcgacgccgggcgccctgcttattgcagatgccatcgcagcctactacgctgcgttgggacgatccaaggactactctgcgaacggtccaattcaccgccagcttacaggtccccctggctttctttttggtacgaacttaacagactataattcagctacacatggtgtcaaatcaactgaaataagggtaaatgacctgaataaccttattaaattgtggctcatgtcacgcctaaacgataactggaatgctggtggtgctgaacaaagccactacacgctatcgtcgtgcctatacgcgcctggattttggaaac

SEQ ID NO: 6214 - DNA, 3034 bp, Oryza sativa
aacattataccttgaggaagacagcgtttgccggtgggacgctctcgaacatgtcgccggcgacgtactccacgccggggccggcgccaacgggagccccggcgacgacgtgggggaggtccagcacggtgcatctcacctccgggaacgcctcggcgatggcccgcgccgccgtgccgtggcccccggcgacgtccaccagtgagctgatcccgcgggacacctcgccgtgctccctgacgacgacgtccatcaccaagcggctgtcggagaccatcctattgttgacgaccttgttgaaggccgcgtcgtcgtcggccatctcccacatgctccggccatgggtgtgctcgaagatgcacgggcccggcagctcgcgctggagccagtcgctgatccggaggaaggaggcgatgaagctcgggtggagcagcattgacatgagcgacgcctgctggtggtggttcccggagccgacgaggaggaggcgggacgccggcgtgagcgcgtagacggcggccggcagctcgtcggccgccgcgccgtctaccggctccgtcgtctcgactgcgaagacgccggtgagggtgagcacgcgcatcaggcggcgcaggcacgggatcttggacgggtgcagcgacgtgaccctggtgactatctgggacagggtggcggcgccgccgtggtggtggatggcgtcggcgatgccgaggtccatggcggccttgagggccacggatttgatgacggccaaggtgttcacgtagagctagagctcagcatcgagcaagccagccccgtgctcgttgctttgagtggacgccatgacactgcctctagctatcttctactttggatttgaatatgatcatggacagaggggacacatcatatatataagtagagggctcgaagaatcaccgcatttcgttatggaaccagaaattgctgggaataaagagttcatatgcagtattgtaattcgatagtttttttttgttgaataactttcgaatttataatcgattttgctatatctcactcgaaagattttttcttatctctcactcgattttctcactcaaatttacagtgcattttcttgtaagttacagtgtaatttatgaaacttatactgtaacttttgttacactataatttttgaatcttcgcatgtaaattttaaattttgtattggatttggtctttttcttgaggatatggtaatttagtgtccattatggtgtttcttaattgcttttttctttttattatatctatcggattttaatctaaagattaaaaatctgtgtgatacgataataaaaatctttcgaaagatgtataggtactcccatttataattgtagtagatatcatagtgttatttaattttaaccatgtatatattatctatctattatattaaaagtccattaaatttactacaaacgttcctaggctatcatgtggcatcctataaatactctcaaatcgtcatgtgtcactataacaaaatagtaaaaatctgacaagacaattgattctcatttaaattggtggatcctttaattttggacgttagatttacttcacaaggaaagaaaatctccgtccggacatcagccttggtgcgcaacgatccctccaactaccgttcctctctttttttaatccccataaaaattaaaattaaatacttttttatgggcctaaaaagcccatcaacttactatatctagccaacttttcatatattatctcctaataaatagttcattcaatatcatataaatatttctaaacaaatgtccagattcgttttttatctcttaagatcatcttattttcttcatcctttttcagtttttgttgtactgttgaaagtacatgcatagtttttttttacagttttttgtgattgtagttggtgtgcacggtgtgtatacaaaaattttgtgtgtatagggtatgtatacttactaaatggccaatgcacattagctaaaggaaaattataaagagtgatcatttgaagtatataaatcatatttagagtaaaaatatttaactcatgatggcaatcataaaaagtccacaccacaataaaaattatttttatggaattgtttttttgctaggaaattatattcctgctaggccacgtgaagtctcacgcactctgcataaaacagtgagtagtctcctacaatccgaaatcaatttgaactccacgaggccttttatttgaaatatatatagtgtcacatgcatccaaggtggagaaaatctagcatataagaaaatagcaagggcatcttaacaaagggatacaatagtaagttgtaaaaatacctagccaatgttgctacataccgaaaggaactatcaattgccatcggctgttggtaaggaataatatggacaaaaatatttgtacgtatcactattttcaaatagggattatcaacaaccaatgtataaaatgataattttaagacacttatttttaattgcatgaacaattattttcattgtaatgttacccaaatgattttcgcgagcattctttacacatgtggctcaaatgtgtagcctcctttgtggcgagccacttgcattacgctcatgggccgcctttgaaaataacttttgcagtcctttttgcacaaaactattttagtgcagtacttacccacgagattgcgttgcagcttttgtatatagaactatttagtggagcacttcacccacaagatagtattaagtcattctactcccctggctatagaaaaaaaattattttagctcctaaccatatttcaattatgaatcaacgaactcaaaaaattcatgtcctttaaagtagctccataggtttctccacatcttgcacatataagctactaaggtggcaatacaaaatcagtagcctttcttatgacaatatgattaaagtttacaatttttttccaataaattattattttaaaactcatgttgactatgtgttttcttaaaaatagcgtagggt

SEQ ID NO: 6215 - DNA, 627 bp, Oryza sativa
cattcatcagagaaaaagttctacagtgaagctgatggtgtggagaattaggtgtaggcctggtcaagctgcttgtgaagtgaagtcgtttgcgccgtttatcttattttccgctgcttagatctttattgattgagaggaactatctacctctataatgacattttattcgcttattaattagagtaataattgtactatattatcaatttgttattgtgtgcctcggctgattcctgtacgagggttcacacacatgtaagcgtttggaattttggatagaaattccgggcgtgacaccccgggacaggtaggcaggactgagcccctagcagcaggacaccggccctgtgccatcacatctcgactaccgggccgcagctcgtgtagccttcatttgccctagagatgtccatcgacccccgactttgtccatctccatccgtgtacttttgtttataaccagactgagccacaaactaagccttacccactagacatgtggaagtatggtagtactttgcaacagaggcccgaagaccggtccttatatgaccgaggtgctactatcaaaaccatgcaccccgagcccagcctaaaaccattttgagggttttgaataggggg

SEQ ID NO: 6216 - DNA, 886 bp, Oryza sativa
ctcgacatgtggatctccccaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcctataacaagaagggggcccgaaggcctcggaagaagaaggaaaagctattaagattggcggaggcctgggggctcactccgacgtgcctgggtagccggcctcgccgtcactgtcgtccgcaccgtcgtcaccgcactccttgtcggagttgaaggcaaacgcgaagccgaggggccgctcattattgtcggtcggttttcccttgctgatgcgcgcgacttgcgaccgccgggattctgcccgaagagagagagagcagggaggagaggcccccgagccgaacggtggcccaaggcccccgacggccggagctggccctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggagatgtggcccctgacgaagaagatcagccccgccgaaaggtgcagcggcccgtctacttcgttagcgaggccctccgggacgctgagacccgataccttcaggcccagaagatgctttacgctatcctgataacttcgaggaagttgcgccattatttccaggcgcatcgggtcacggtggttacgtcttatcccctcggccaaatcttgtataaccgagagg

SEQ ID NO: 6217 - DNA, 3447 bp, Oryza sativa
  unsure (1)..(3447): unsure at all n locations
nnnnnnnnnnnnnnnnnnnnnnnnnnnnnnnnnnnnnnnnnnnnnnnnnnnnnnntgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccttagtgtaatcttttgaatttggatagtttaggtggatggctgggcctgtcgcaacgtgggatagcgttggacagcggatgattaatattaattaattattacaactgtttaaatctttcaatttctgtttataaatgctcgctttatgcaaatgaaccacttcagctcttctttgatgattccctgcatcatacccctattccggtatgacttgctgagtacagtgggtagtactcagtcttgctctacttttcccaaccccagagttcgagttcgggtcagatgaaagtttcttcgaggagtaggctttgtccgtgccgtcgaggatgcctgtggagtggtgttcccgctgcagttttagtcaaggcttagctcctgttgtctttttttttcttccgctgcatttatgtaagacttttatgatgtttgtaagacgtggatctgaatgtcaacattgtcgtttgtgtaccccggccggtcctggacggggattttaatgcacattctgcttgaaattctattcgggaatttttgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagatttttcaaaacgagtcagtctagggttttagtaaaactattgggatttattcgtcagtcagttgggatttgatgggtgaaatgcattaggtcctagctcaggaacatgggttgcaaggtatttatgctttatttgttattattagtatgtatctaatttctcattattttatcgttatgtgagtctgtcttttttattcgctctcatgcaaaatgatctatgcataaaaatttcgctcttattcgattcccttatttgagtcttttattgctttatttaaatttggatttgagcatgcattgatcctacccctttgtcttctctagatggccggtcacccacccaaccaccgcggagaaggcatgatcaactttgtggcagagttggcacgcatgacactggtggtgggctaccccaacgcgccagagtacacgacgattccaccgctcagtggcgagcttcctcaccgtgttcgcttggaggtccacggctacgtgggtacctgcctagctaacatggtggttgaggcatccggaggctcaacagatcacgcctgtcaggaggcagcatacctgatgatggctagactacgggagcgccacaactacatcttccacgacacggcgtaccgatttcaccctcgtcgagccagtggtgatgatatcagtaccttccgtccgacagccggcgagaacgacaccacctttagtcacatgtgtgctgtgatgaggggattggataggatgcactcggacctgcacaaggcgaccaaggccttgaacgatgggaagctcatgaggatcgtcactctgaaggacgagatagcgcgcctgaagagggagaatgctcagttaaagggtcttcccgcgccaggaggagtccggatccgcactacgcccgcaagacgacgacggcacccgtgcgcatccagcttgcgcccaggaacccacctccatcagcagctcccgcagcacctccagttccgcccgcagttcctgcagctccagctccagctcccgcgtccgctctctccttcgctccagcatcagccgccagaggtccagccagtggcaccggaagttggttgtctgctactcccagtggcagccgcgatctcagtagcagcagctccagtggctcacagtcaggcagcggcgagacttacctgccaggctccgggagtcgctcagaggtaccgggtgacgagcaggaggacgccttcgactccaccgaccgaaggagccgttccgagcattaggctcgttttccattagtttatcgactgtctagcttctgcttgttagtttgtgtgtttaggttgcttgtttggggtcagtcgacggtcgatatcatgtgcctatgatatggctgtcttaataaggatttttgcttgctctttaagtgttttaattcagatcagaacaattgcagtttaaattcctatgtaataaagcttagtttctgagcatctgtttttcttcttctccccgtatgcttttcctccagatggtctacaccaggaatggtagccgcgcgacaggcgagggcagcaacggcgaagagcgcactgatggggcgcatccccacagcgattctggcaatggtccgccaccacttcccgagaatccgacgctagcccaagtaatggcacatcagacccagatgatggcagccatgatgcagcagatgcagcagcagcaccagcagatgcaccagcggatgctgcagcacgccgaacagcagcatcaacagtttggtccccctccccctcagtccaagttgcctgagttcctgcgtgtcaggccacccaccttttccagcaccaccaaccctatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccaccaggtactgaagtcacttgggcagagttctgccgtagcttcaggaaggcgtaggtgccagatggggtcgtggcacaaaagaagagggaattccgggcgctccatcagggcaacaggactgtgacagagtacctccatgagttcaatcgcctcgcgcgatatgcaccagaggatgtccgcaccgacgccgagaagcaggaaaagttcatggcgggtctggatgacgagctgaccaaccaactgatatctggggactacgctgattttgagaggctggtggacaaggcaatccgtcaggaggatcaacgcaacaagatggacaggaagaggaaggccgcacagttcagggcacctcagggaagtcaccagaggccgcgcttcactcccggacagcagggtggacctaccaccatgatcgtccgccagtaccgcccgttcaatcctagcaactttcctcagggcgccagtggcagtcagaac

SEQ ID NO: 6218 - DNA, 1916 bp, Oryza sativa
tagaaatccaaagatcaccatttctagcaaacctcattcttctcgaatccaaagacctagatgtcattcttgggatggattggctgaccaagtttaagggggtcatcgattgtgcgaatcacacagtcaccttgaccaacgagaagggagaaaccgtggtgtacaaatcactagtctcaccaaagcaaggggtctctttgaatcagattgagacggaaatcccagtcgacaccgtggagaaaaacttgaggaaattggaatatatacccatagtctgcgagtatccagaagtgttccccgaagacctcactaccatgccacccaagagagagattgaattccggattgacttggcaccgggaaccgctccaatttacaagagaccgtacagaatggcagccaacgaattagcagaggtcaagaagcaggttgatgagcagctgcagaaagggtacattcgaccaagtacttcaccttggggtgctccggtcatttttgtggagaaaaaggataagacgaagaggatgtgcgttgattattgcgcactcaacgaggtcaccatcaagaacaaatatcccttgctgcgaatcgatgatttgtttgatcaactgaaaggagctgaagtgttttctaagatagacctgcgatcaggctaccaccagttgagaattcaggaagaggatattccaaagacggccttcaccactcggtacgggctatatgagtgcacggttatgtctttcggacttaccaacgcacccgcattcttcatgaatctgatgaacaaagtattcatggaatttctggacaagtttgttgtggtgttcatcgacgacattcttatctactcaaaatccgaagaagaacatgagcaacatctccgtttggtactcgagaagttgaaggagcaccagctatacgccaagttcagcaagtgtgacttctggttgacggaagtcaaatttctgggccatgtcattacagctcagggtgtggcagttgatccgtcgaacgtagagtcagttaccaaaaggaccccaccgaagaccgtgtcgcagattcgaagttttcttggacttgcgggatattaccgccgattcattgaaaacttctccagaatcgcccgacccatgacttagttacttaagaaagatgagaagtttaaatggacagctgagtgcgataagagtattgaggagctcaagaagaaattagtatccgcaccagttttgattctgcccgaccagatgaaagacttccaagtctattgcgatgcatcccgccacggacttggatgtgtcctaatgcaagagggcagggtggttgcgtatgcctcgcggcagttgcgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatgagtattcactaccacccgggtaaagccaatgtggtggcagacgcattaagccggaaaagttactgcactgccctatgcatcgagggcatgtgtgaggaattgcggcaggagtttgagcatctcaacgtgggaattgttgaacatggttttgtagccgctctggaggcacggcctacgctcgtggatcaagtcagagcagctcaagtaaatgattctgaaatagcagagctgaaaaagaacatgagagtcggaaaagcccgggatttccacgaagatgagcatggcacaatctggttgggagaaagattgtgtgtacctgacgacaaggaactgaaggatctgatactcaccgaggctcatcagacccag

SEQ ID NO: 6219 - DNA, 710 bp, Oryza sativa
cgtgtcccaattaaagaagtgctaaagggtacctgaagaacaggctgattcggaacacattgatatccaggaggatctaacatacgtggaaaagccggttcgtatacttgataccagtgaaaggagaaccagaaacaaggtcacccgattttgccgagttcagtggagtcatcattcagaagaggaagcaacctgggaaagggaagatgagttgaaagccgcccatccgcacctcttcaccagctcctccgaatctcggggccgagattctgtttaaggggggtaggtttgtcacaccccaaagttctcctcccaagcctaaaatttaatttctaaaacgaccccaagaaaatgcaggtgaaatcaagagaaaaccctaagaaagtaatgcaaataataatcggatttgacatgtggaatttttcttgagttctacatgtcgaaattcattaacaggatttttagtggaattttcagagctctagaaataatttttaaccaattaaaattgagcaagcaatattttaattccagggaaaatcctttttcttttttccttttctttttcttctctttttcctccttttttcgaatgggccgccggcccattccctccttcctccccctcctccctgctgggccggccgcaggccgaggcccatccaggccggccggcttcctcctctccccggggtcgccgataggtgggg

SEQ ID NO: 6220 - DNA, 2711 bp, Oryza sativa
  unsure (1)..(2711): unsure at all n locations
nnnnnnnnnnnnnnnnnnnnnnnnnnnnnnnnnnnnnnnnnnnnnnnnnnnnnnnccaaatagagtcatggcctgatgacgttctgggtagaccagtgatgaaatccataccgatttcctcccatttccattcaggaatcttcaaaggctgcaacaaaccggcaggtttctgatgttctgccttgactcgctgacaaacatcacatactgctacgtactctgcgatttcacgcttcatacttgcccaccaaaatctttccttgagatcctggtacattttggtactaccagggtgaatggaatataaagtatcatgagcttctttcagaattgcatcttttaaatctttgttgtcaggaacacagattctctcgcccaaccatactgttccttgctcatcctccaagaaaccgatagctcttcctcttctcatattctttttgatttcttgaatatcaggatcattaatttgggcttctctaatttgatcaattagagtgggcttcgcttctaaggctgcaacgaaacctctactgacaattcccaaatttaatctttcaaattccttgcataattccaatggcaactgtcgtccttccgtagcattgcaatagcctttcctcctaagagcgtctgctacaacattaacctttcctgggtggtaatgaattcccatgtcataatccttaattaattccaaccatctcctttgtctcatgttcagatcccgctgagtaaagatatactttaaactcttgtgatcggtatacacctctgtacgagtaccgaaaagataatgacgccaaatcttcaacgcacgaactactgcagctaattcaagatcatgagtagggtagttcttctcatgcggacgtaactgacgagatgcataggcaaccaccttcccatcttgcatcagaacacaacctaacccaagtttggatgcatcgcaatacacttggaatcccttctttggatcaggtaagatcaaaataggagctgatattaagcgattcttcaactcttgaaaactctgctcacattcttctgaccacttgtacttcacatctttctgaagcagccgtgtcatgggcttagcaatcttggaaaaattctctataaacctccgataatatcctgcgaggcctaggaaactgcgaatctctgaaacggtctttggttgtttccagttggttacggattctacattactaggatcgacggcaactcctcctgctgagatgacgtgaccaaggaacttcacttcagacaaccaaaattcacacttgctaaacttagcatacagttgatgctctcgtagcttctccaatgcaaggcgaaggtgttcttcatgctcttctttggttcgggagtagataagaatatcatcaataaagactaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaattctgggtagcgggtacttattcttgatagtcacatcttttagtgcacgatagtccacacacatcctctgggtatgatctttcttttccacaaaaataaccagagctccccatggagattaactcggtctgatgtaccctttctgaagcaaatcgtccacttgcctcttgacttctgccaactcgttggctgccattcgataaggtctcttatggatcggagttgttcctggtaccaaatctattctgaactctatatcccttttaggcggcataccaggtaaatcatctgagaacacatcgggatactcccggactataggaatctcttccaaagttatttggttcagtattgaccttaaagactcagaagacaatgcatgaacagttacaactcgaccatcattgctggtgagagttacttttctgttagcacagtctatcacacccttatgcctggctaaccagtccatccctaggataacatcaaggtctttggactctaacaagataagattggccagaaatggtactccttgaatttctattctgacagaggggctacgttgcaaagagagtgcttgattacttggggtactaaccatcaaaggacatctaagatcttctacttccatcccatgatttcccgcaaaactcatagataagaatgaatgtgtagcaccagaatcgaaaagcactgttgcaggaactgagttaacaagaaacgtacccaaaatcacatctggagcaccttgagcttctgcagcagcaacatgattgacacgggcctttgatgctgatacggtagagttgctctgggcagggacaaccttcacgcatcggggcttcggacacttgtcagcgtaatgtcctgggtctccacagttgaaacacaccacgggcttgctgccttgctccctcttggcaggttgttgctgtgtcgaggctgcaacaggacgtggaacttgattgcggatgttgttgccagcattgttgttgaagaactgacgctgcggacgaacaacagacgaataacctccctgtggcatggactggggtcctaaagtaagatggggatcc

SEQ ID NO: 6221 - DNA, 1009 bp, Oryza sativa
  unsure (1)..(1009): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgggtgagcgacctaaattccttcttcttgagagacaccactcccgatggtatatgcatcttccggaaagcagcggtgaactcaagccaagtgataggttcagcagtagtcctattcaggcggaagtgatcccaccattcagaggcagggccatgcaactggtgtgatgcaaatgagaccttctcctgatcagtgcactgaagcaaatccaacttcttctctatggcatgcagccaatcgccagcttcaacaggattagtggtactagagaaagtaggcggcctcacacgaagaaattctgctaacttgttctggggaggtgcatggttatttccctggttctgctggttctggagttgctgcatcatcatgttcataagctgtgcctgttgagccaggacttgggcaagtgtgggattctctccattgttgttgttgttattgttgttgttggggccattcccgttgctgcgagtgaccaccatctggcatggacagggcacaagaagagaaaccgggggaaactacttaggacagagaattaatttgacttttattggtcttaagtgagtttcattattacaaactgaagactctcacaccactaagctcaccaactacctaacactcgaaagcaaacaaacgcatgcacttacatcccatcactgatgtaatcacatgcgagacacacacaaccaaacttaaaacaagcaaactaatacaacgatctaagacaacggcttgacaag

SEQ ID NO: 6222 - DNA, 683 bp, Oryza sativa
tagggcgaattcgagctcggtacccattccgctgctgttttcttttcttttgtaagtatgtaacgttattattaagatggatttgtatattaaattgtcagtttgtgtacctcggctgattcctggacgaggattttatgcacaaattagttcggaaattactacagaatttccgggcgtgacaatagccagctcctgacgcgtcaagtcaccggtcgggcaaatcgggtttacaatggctgcccctagcgcgccctggcgacgcgctccaacatgccggggctgaggacgacggcgaggtcctcgaaccactaggtgcggctggtgcaccgcacgctgaggcagctgctcttggtgtcgcacgagaaccggaacaccgagctctccggcgaggaagctcgtcagggtggcgtcccctgttttgcttgtgcttttggtttctgatgtaaaatactccatcatgttcttgtttggtgagatgaatcttcaaatctgcaaagttgcagatcggttgtttgagcttagcatgattgattggggtgggtgggggagacgtgtgtatatcgtactgtatattcgagttttgggtgggctcacaaggtcggtagcgccgaaaggtttttttttttatccgaagcgctgattgcgacgttctgaactggagcccgatgctggtgtggcat

SEQ ID NO: 6223 - DNA, 2118 bp, Oryza sativa
tctgttttgaataagacgaacggtcaaatatgtgctaaaaagtcaacgctgttacacaagtgaccatgtgactcctcctccccccacccctctgaacttagggcatgcagatgactgctgttttgcaccatcttttttatgtagtatttgctacgtctttcgttaatggcaggtggatataggccctgatatcagtgagatgtccaaggtaaatagggatcccgagaaattacaaatgacaaataagaaagtggcacgtatacataaagtagttcgactcacacataattatttggttgcgtcacaatttcagaacacaactgagcttgcacacgcttattccaagcctcagcagcaacaaattaacagacatgctccacacactacaacagaaacatcatataacacttttgtagaggcgctttggaaattgcctcttagatcatcagttttatagtgtatagacactttacagaggcactataaaaattgcctagaaaatttttactctagatatactttagaaatattttcagtatattttattagattttatcttgtagagatattctttcggcagtttaaattgtgcctgatatgtaaaggcattttcttgagacactttaaactttgtaaagacacttcttagaataaaaatatgtactaaatgactaatataagtaactcaaggcaaaaacatacaagtaatgagtggggttgagttggttagtgccttgaagataagtatgatttgtgcaattgatcataagtttaaggattgggaaaaacagggaaaatattttattttatactagtttttcatatggttgtagtacaatttaatgtctctagaaagacattttacaaaatgcctcttttacagatacaattcacataaggtacttattaggtattttttaaaatgcctctatagtattgcaaaggtatttgaaaagtgtctctacactgacacttggcaataatcattgtcttttttaagggtaaacctcaatgattgacctggagcctagaactggcatgatcttgtagtcactaaacccggcttcgacgaaaaccttcttccactcttgctcgtctcgctccacaccattgataagcatgatgtatgcatcaaacaaggtctgcatctctaaatgcttttgatcaggtgcccctactccgaccaccatgtctacgactattacctttcctccagcatctctagatggaatggctttcttgcagttctttagtatcttgacacattcatcatcgccccagtcatgcataatccactgaatatatatagcaaacataatgagagagtcacgaggtaaataaataacattctgtactatttagaaattacaaattatggcttaggttaaacaaaaacaccatactaattacaaactgtcaattactgatctcgaattttcgctatgatcaaattaatacaataattaaattcagaatataagaccggaatgacttcatatttatgttatttcgatttttctagaaaaattacgtaattgaagcaataaaattggccctccaagctgagtcatgctttgtaattgttaacttcgatttatgaaattagttataaataataactaagattaataatgagtcgtgatagacacgatttggcaattaacacttcaaaaattggttattcattaacaaggatactaattgagagtccacaacaagtagcacggtgcttagcaatttttatcttgaattatataaattattgttgtacagtccaacatgatgggaaggtagagtagtagaatggtagaaagtgtttttaatcccggttcgttacccccatatgtagtcccggttatacaaccgggaccgcgaatccgggattaaaggtacccatctttagtccccagcctggccgctgcagcccccgcccggcgatcgccaccgcttctcccggcgtcttcccagcgcggccgccaccgcttctcctatcgagcccgttgcgagagagcgagagagagagagagagagagtaagagagacggcgagagaagaggcatggagaatggctggatttttcacattttgatccttttgaaaaacttatttcgcaaatag

SEQ ID NO: 6224 - DNA, 1009 bp, Oryza sativa
  unsure (1)..(1009): unsure at all n locations
cggcgaattccagctcggtacccgtagtcactaaacccggcttcgacgaaaaccttcttccactcttgctcgtctcgctccacaccattgataagcatgatgtatgcatcaaacaaggtctgcatctctaaatgcttttgatcaggtggccctactccgaccaccatgtctacgactattacctttcctccagcatctctagatggaatggctttcttgcagttctttagtatcttgacacattcatcatcgccccagtcatgcataatccactgaatatatatagcaaacataatgagagagtcacgaggtaaataaataacattctgtactatttagaaattacaaattatggcgatcctctaaacaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6225 - DNA, 802 bp, Oryza sativa
atagggcgaattcgagctcggtacccacttttgggccctgtagtccaggattcataaggcttcccttaaacccatgccgactacatgtttcttgaacacgttgagtgataggcctttcgtgagcggatccgcgagcatcctttctgttctaatgtgctcgagactaattgtttgatcccagactttgtccttcacaacatagtactttatgtcaatctgtttggcagcaccacttgactgattgttgtgagcgtacaaaactgcgggttcgttatcgcagtataactttagtggtttctcaatactatcaaccacctttaaaccgggtatgaacttctttagccagttcacctgcctagtggcctcatagcatgctataaacttggcatacatagtagaccctgcagtgataatctgttttgagctttttcatgaaatagctcctcctgccagggtgaacacgtatcccgatgttgactttgtattatcttttgcaaagtcagaatcagaataccccactatctggagcgattctgatcttctgtaagacagcttgaggcctttagttccttgcaaatagcgcaagactttctttaccaatttccagtgctctgagcctagattactctgaaatctaccaagtaacctggtaccaaatgctaaatcagggcgtgtgcacacttgcgcgtactgtaggcttcccacggctgacgcatatggttttgttttcatttcattgagctcatactgatttgtgggacattgtcatgccccatacttttccgctttgactataagagca

SEQ ID NO: 6226 - DNA, 1992 bp, Oryza sativa
  unsure (1)..(1992): unsure at all n locations
gcnnnnnnnnnnnnnnnnnnnnnnnnnnnnnnnnnnnnnnnnnnnnnnnnnnnnnnntataagagcaggtgaagcactgcatctgtacatgttgaatttcttcaacaccttttctatatatgtcttttgataaagtcccaatgcatactttgttctatctcagtgaatctgtatgcccaaaacatatgaagcctcaccgaggtctttcatgtcaaagtttgaggacaaggatttctttgtttcctgcagtggactgacatcactactagatggtagaatgtcatccacatacagaattaggaaaatgaatattccattcttaaattttgaataaatacagttgtcctcgacattctcttgaaacccaaatttctttatagtcccatcaaacttcaagtaccactgtctcgaagcttgctttaatccataaatggatctctttagacggcatcccatatttttgttccctttcatgacaaaaccttttgtttgtgccatgtatactttttcctctaaatctccatttagaaatgccgtttttacatacatctgatgtaattccaaatcataatgtgccaccagtgccattattatcctgaaggaatctttacaatagactagagaaaatgtctcattgtaatcaatcctttctcgttgcgtgaagccttttgccacaagtcgcgccttcaaattttctatattccctctggagtcatatttggttttgtagactcattcacaacgtactgttttggctcctttaggaatttttttcaaatcccaaacatcgtttagtttcattatttcatttcatcttacattgcttccaaccattcagatgagcgagcgcttctcatggcctcttcatataaggtgggaccagcctccatatgcgactcttctatactataaacttgatagtcatcacgaatagccgatcttctaactctttcagaccttctaggggcatgctgttccggcacattatctgtttgaggctgttgcagctcctcctctggtgtggcaataatttcggttgaatcctgtagaacaggttcctcactttcattcattgttgccacaggagaggtaacaacaggtgttggtaccgcaacgtcatgcattgcaggcacaacatcagcaagtagagagaagaaaggctcttgaatcgacggagcaggtacagacaccccctctcctcaagatcaatttctcgaacaaccgagctccccctaatcatttcgtcttccaagaagacagcgtgtctcgtttctacaaactttgtataaatgtttggacagtagaaatcataaccctttgatcttttaggatagccaaaaaaatggcaacttattgtcttgggatctaatttcccaaggtttgggttaaatactttagcctctgcaggactcccccacactcggaggtgagctagtgagggtactcttcctatccatagctcatacggtgttttgggcaccgatttgcttggaacgctgttgagtatgtattgttgtaaatctgagaactccaatggaggaagaattacactcttaactagtctctcaattctccccctcgaaatatggcctaaacgacagtgccataatttcgatgagacatcaggagttcgctttcttttcttgttttcttatatcaacgaggacacaacattcacattcttagaaagagataacaaataaagctcgccgacgatgatctcgtatacaagccaacacatgccccccggcatatcggctcgaccgacgacactcctgcttcaaggcttcgtcgatacgttgaccgatgccttcgagctgggtgctagcgccattcagccacgagatatatccggccgccgattcctcgggatccccgcggggtactcggagctctttacagactctcgacatggatgtgcagcaactcttcagannnnnnnnnnnnnnnnnnnnnnnnnnnnnnnnnnnnnnnnnnnnnnnnnnnnnnnnn

SEQ ID NO: 6227 - DNA, 683 bp, Oryza sativa
  unsure (1)..(683): unsure at all n locations
tttttgtcccaagctccacaaaatcaagagcgcaagctctcaacatatcttccaagatttgattgacccgctcggtctgaccatcagtttgcgggtgatagaccgtgctgaaatttaaccgggtccccaatttttcatgcagcttccgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacgactacccagatcgaatcgtgacctgacgatgtccggggcagtcccgttataatgtccattccaatctcctcccatttccattccgggatttgaagaggttggagtaaacctgctggtctttggtgctctgccttcactcattggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatnnnnnnnnnnnnnnnnnnnnnnnnnnnnnnnnnnnnnnnnnnnnnnnnnnnnnnnnn

SEQ ID NO: 6228 - DNA, 689 bp, Oryza sativa
gaagactgacaggtgggacccacctgtcagcgacagcgagcgcgcgcgcgcgactgcggactagactgggccgacttggcccggaaagagagagacagaaggttttgggccaactttcggcccaaagccaaaagagacttttaaaaacatttttcaatttaaattattcattaaatgcaattccatttattaaaaatacttccttagctcaaataaatcccataaaaatctaggaattatagaataaagcaaagtatttaatgaaattttatctggccccattttatattggaatttattaattaaaattagatcttctctcctagacttttaaaatcatttctaaaaattccaattaaacaacaatttatacatttaggatttttagggtgtgacaaacctaccccccttaaacagaatctcgtcctcgagattcggaagaactggtgaacagatgcggatgagctgacttcaattcatcttctcgttcccaagttgattcttcttccgagtgattactccattggactttacaaaaacggataactcgatttctggttcttctctcatctatttccaagatacggattggtttctcaacataggtcagatcctcttggacttctatctgttcaagattagcttcttcggtaggtacccttaaacacttcttcaattgcgacacatgg

SEQ ID NO: 6229 - DNA, 680 bp, Oryza sativa
atcccacacttgcccaagtcctggctcaacaggcacagcttatgaacatgatgatgcagcaactccagaaccagcagaaccagggaaataaccatgcacctccccagaacaagttagcagaatttcttcgtgtgaggccgcctactttctctagtaccactaatcctgttgaagctggcgattggctgcatgccatagagaagaagttggatttgcttcagtgcactgatcaggagaaggtctcatttgcatcacaccagttgcatggccctgcctctgaatggtgggatcacttccgcctgaataggactactgctgaacctatcacttggcttgagttcaccgctgctttccggaagatgcatataccatcgggagtggtgtctctcaagaagaaggaatttaggtcgctcacccagggatcccgctctgttacggagtatctacacgagttcaatcgtctggctcgttatgctccggaagatgtgcgcactgatgaagagcaccaggagaagttcttggaaggacttaatgatgagctttcttacccactcatgactggggattatcatgatttccagaagttagtggataaggctattcgtcaggaggacaagtacaatcgcatggagcagaagaaacgccggattgctcaattcaagacacaacaggggaataat

SEQ ID NO: 6230 - DNA, 497 bp, Oryza sativa
cgaattcgagctcggtaccccgagccccctagggtaggattgagcacgagtgacctatttcaagtcaagattcttcaataggaaacaaaagcacagacacagcctttaggaaatcgaaaatgcttttattgaaatacgaaagagaaaaaagataagcccccggccaaccctgcacgcccgggggggtgcggggttggcccgagcccaagacctgacacccgacccccactaggggtagaagcgacgaaggtgttcgatgttccacgggttaggcagctctgtgccgtcgcccgtggccagccgaacggagcccggccgggggacgccgatcactcgatacggacccttccacattggtgagagtttgctcagtccagcacgtgtttggacacggcgtaagacgaggtcgtcgacgcatagtgatcgggcccggacgtagcgctgatggtagcgccggaagctctgctggtagcgcgcggctcgaaaggccgcgcgcc

SEQ ID NO: 6231 - DNA, 1193 bp, Oryza sativa
  unsure (1)..(1193): unsure at all n locations
nnnnnnnnnnnnnnnnnnnnnnnnnnnnnnnnnnnnnnnnnnnnnnnnnnnnnnnagagtggattcttctagccaaccatatacgaagatactaaagaattcattcgaatatgttggaaatgccagaagcatggagatatcaccactcaagatgcgattcccttgacctacaactttcaagtggagttatttgatctatggggacctttcccaaagtcccatgattgtgagtatatcttggtgcccatcgactatgtgttagagtgggtagaagcagtgccgtgctaagtcgctgacaccaagcacgcccgttggatattccacgaaatcatcttcctccatttctgaacacctcaaatggtaataagtaatggagggtatcactttattgataagatcttccaaaaccttttacaagagttagaggcacaacacatcattgcaatttcatatcacccccaaacaaatggtcaaagtagaaaccttcaacaaataaatcaagaacatactgtaaaagaccatgcaaggaatggggaaggcatgaaagaacaagctaccaaatgcactctaccaagaacacccttcagcatgtcaccttcctagctcatctgtagaaaaatgtgctattttcgtatcgcgctggaacacagagcacactaggccatgcggatgtggaattgaaaaggcggacgacacaaacaaatgctgctgtcggagctacaagagtagagggaaaagaccaattacaatgacaaaatatatgaagaaagaacaaagagatggcatggtaagataataaaagggaaggagttcatggcaagagataaagtgatgctgttcaattctatgtgaaactcttcgggcacgaaaaacttcgaagcaaatggatgggaccattcaccatcattgacacctctgcacatggagtagttatgcttcaagacggctgacacaatctttaatgcaaatggtcatcgtttaaaagttttcctagaattaattgctcgaaaaccaaaataaaaaattacacgtggtaaatttagtcaattttgacgcatttaccaagaccagttatcatgactcctgagctgaggaagaagggagccctccatggttcggccgaaccccttgttcgttcgacccatgggttgggccgcccctacacagccttcgtgcacgtagtccccaggagg

SEQ ID NO: 6232 - DNA, 2176 bp, Oryza sativa
  unsure (1)..(2176): unsure at all n locations
gactatataaaaaagtcagcgggcagttatttaaagctttactggttggcaccttttaaaatgcattacaccaactcctaaaaagttgagtaactgcggtataaaaggatttgaaggtattgggcatataatcacgtgcacttttgcctaagcaaaaaatgcctaagtccctaaaagaacgtgacaggccacacctaaaaatatgggctgcagacatattaggcctagacctaaagtatgtctaccgatacccttaaatatgacgtatagaacacgacaattaatatgaccccgagtgataaatatcttgggtgatgtagatcatgcatatctcatctgagtggcttctgatccgagtaattatccctcatggagaataccaaagtagatgtgataattgaatcccgactagcacaagcactcagctaatggccctcgtggggaataatgaatagttcaatcgttgggcatgagaaatcgactcgtaatcatgaatccatgatgaatgtatccggaacaagtccaaattaaaaatataatcctcgtgcttatgttgatgagctcctaagcatgtagcatatccttctgctgtagtaacaattgtccattggtagtaactgacgcagttggcatgaagatgaaatgaccactatgaagatgatatcacccannnnnnnnnnnnnnnnnnnnnnnnnnnnnnnnnnnnnnntatgtcactctacccttggattatgttaacccctgcttagaatatgattatcacaagtaatatataaattattagtcaagttctctgtcacgaccggaaataacccaacgggcgttccttacgtgcgtgcattattccttgtcccaggaggcaaggtacaccaaaagttgatacagttcagagtttaacaagcggaagcgtaaatagataatttattacatgggcagcgaaggcccagcacacacaaagacaaacgagaaacagcggaagactagggcgacgaccacaggcgcttgacggcaggcacgagctagacaccaaagccttcatcttccagggactcctcttctgggtttgggaaaaattgagcaagactgagtacaaccaccgtactcaacaagacacacccacaagtgcagaataaatgcaagggagtacaagggagttataatataaagggttagggtttgcagtaaacagcattaaaagacacttagttgctcaaagctattttgtaaatacggtcctagagctatacaatattattaaacaaagccgtgaacccacacgaacctgccttaacccaaggcctacgaagattcagaccgaactgggcaacccgaccctgggtcccagctcgtcccaagccaacccaggccaaccattccacattttagttgttaaacaggttttaagaattaaaacactaacttgggtacattgctcggcttgcccataaccgagggcgcgactattcgaatagattatactctgatcagaggtgtacatctttacccacaggacacatcttcctcacgtgtagccacgtgccacataccaccacggtatacggacggaagacgtgacatagtttccaacccatcctagccatagacaagagtaccgacccaatcccacctacggctggaacccccgggacaggtaggcaggactgagcccctagcagcaggacaccggccctgtgccatgacatctcgactaccgggccgcagctcatgtagccttcatttgccctagagatgtccatcgacccccgacttcgtccatctccatccgtgtacttttgtttataaccaggctgagccacaaactaagccttaccaactagacatgtggaagtacggtagtgctttgcaacagaggcccgaagaccggtccttatatcgccgaggtgctactatcaaaaccatgcaccccgagcccagcctaaaaccattgtgggaattttgaatagagggggcggggtgaatccaattccacaataatcaaaccattccatagtgtccaggtgatgagaaaattcccaaagtctagagatgtaaaaccacctaatgttgcctaattaaccagcgaagcatctacctaaattcataccagtggtaccaagagtagagtgtccacttgttggggttttgtttatgtaccgagctcgaattcgccctatag

SEQ ID NO: 6233 - DNA, 557 bp, Oryza sativa
gtcgcttgggctctcaccatccaacatcacaaaccgctcaaactgccccttgagaatgtccaccttgaactcgctaacactatccgtaacttcatgcaaactccgaagcgtgtcccaaatcactttggcactctcaatgccgtccacacggttgaaatcacttccactcaaggcgctaagaattgcattagcggcttgagcgttcttgtgctcgttcttgtcgtcctccttggtgggttccacgggattctgcaaaacatagcctttttcgactattctccaaatcaaagggttaatagatttcaaatgcatcttcatcttatgtttccaagcggcatagtccgtaccattgaagtacggagctttgccgctataggtgctcacataagatgcagatgtggagggatagtcataaggaaacgtagctcccttatcaccatccttgccattccccgtttgacccgacatgatctctccaagcggttaagcctaattaggagattaggctctgataccaattgaaagggtcaattaggcctaaaggggggtgaataggc

SEQ ID NO: 6234 - DNA, 1512 bp, Oryza sativa
cttgggaggtgacagagcgaccctatgggtgtaaacctgtgggatgcaagtgggtgttcaaaaagaagcttaggcctgacggtactattgaaatgtacaaggttcggcttgttgctaagggctatactcataaagaagacgaagatttctttgacacttactcacttgttgctagattgaccacaattcgtgtgctactttccctagcagcctcacatggtcttctcgttcatcaaatggacgttaagacagcttttcttaatggagagctggatgaggagatctatatggattagcctgatgggtttgtagttgaaggtcaagaaggcaaggtgtgcaaattgttgaagtctttttatggtctgaaacaagctcctaagcaatggcatgagaaatttgacaaaacattgacatctgcagtcttcgcagtcaatgaggcagataaatgtgtgtactatcgccatggtgggggtgaggaaggtattttatgcttgtatgttgatgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaattggttttggctacattgatagtaagccttctccaacaccttctgatcctagtttgttgcttcgcaagaacaagagaattgctaggaatcaactggaatactcccaaatcattggctcgatgatgtacctggctagtgcaactaggcctgatatctcttttgctgtgagcaagttgagccgatttacctctaatccgggatatgatcactagcgtgcgcttgagcgagtaatgcgctatctgaaagatactgtggaattggggcttcactatactatgtatcctgcggtactggagggttatagtgattctaactggatatctgatgtggatgagatcaaagccactagtggatatgtcttcacactgggtggtggtgctgtttcatggaggtcttgcaaacagaccattttgacgaggtcaaccatggaagcagagctgacggcactggatactgctactgttgaggtagaatggctgcatgttctattaatggatctgcctattgttgaaaaaccggtgccggctatccttataaactgtgacaatcaaacggtaattgttaaagtgaatagttctaaggataatatgaaatctatcaggaaattaagaaactccggagttataacgttggattacatccaaacagctagaaacctggcaaatcccttcacgaagggactataacgaaatgtgataaacaatgtatcgaaggagatgggtttgagacccatgtgagttatactatggtggtaacccagtctatgtgatcggagatcccgtgaattagaatctgggaagaacaaaccattagtaaactagaggagagtacca

SEQ ID NO: 6235 - DNA, 520 bp, Oryza sativa
  unsure (1)..(520): unsure at all n locations
nnnnnnnnnnnnnnnnnnnnnnnnnnnnnnnnnngggacacgtggaacacgtcatggatgccgatcatgttggatggaagttctaactgataagcaacttccccccttcgttccaggattttgtatggtcccacgaatcgtggtgccaacttgcctttcgtctgaaaacggtgtactccccggagcggagtgacacgaagatacacgtaatctcctgcctcaaaagtgagcttccttcgacggttatccgcgtagctcttctgtcgagactgggcaatcctcaacctttccctgatgattctgactttctcttctgcttccgctaatacctctgttccgaacagttgacgctcgcctgtctgatcccagaagagaggtgtgcggcacttccggccgtataaagcttcaaacggtgccatctgtagactggcctggtagctgttgttgtacgagaattnnnnnnnnnnnnnnnnnnnnnnnnnnnnnnnnnnnnnnnnnnnnnnnnnnnnnnnnnnnnnnn

SEQ ID NO: 6236 - DNA, 522 bp, Oryza sativa
gaacaggaatgataaaacgaagcgacgcattacgaagtgaatccaaagagttttcatgtgaactgaaaatagtcactctgttgttatgttacataattaaaaaatccatccattttgctatgcagaacaagcagaatggtttacttgaaatctgtagtaacgcatgggcactatattattcatatgagaaataaaaccctgattgttgttgcagattttaaccagtcattgcaaatggttaggaaggatacttcagggtatatggattaaagaacatataccgagtaattcagatactaaaaagttctagacgaagaaaaatcaatcgagccacatctgaagcctgggtcaagtgaataaatcatttacctgttgcaatgtcacgattggtacccatggcaatagttactctcttccctggttctagcatttgctcaaccagaacattctgtgatgaaagacaattataggaagtttattggatgagaacgtacattatctaatacatgatccacaaaggtg

SEQ ID NO: 6237 - DNA, 3011 bp, Oryza sativa
aatttacagattcaaaatcagttccaaggagatgccatgatctgcaatgcaaggggcatcaatttatatagattctaccattctagcacacccatgcatgctcatatattattctccatatatacttcatacaagcttaattaattaagcatataacactttggtgatagtaattaaactcttccataaatatcactccatgaaaaagccacatatatatgcatatggtaaatagaacactgttaaaacctgcaaattacaccccaagttgaaacagcagccgagtaacagtgacagacagcgtgaactacgaggcaagaagaggagaggctacgccgccttctgcgccacggcggcgctagagccgtggcgccgggggccggcgccggcggccaccgacgagatggcgctcctcaccgtcatggcgacgcggcagttcttgatggccctgaagctctcgtgccgcaccctgaagcacgccgtcgacgccgccatgtcgtcgtcgccgccgtcgtcgtcatcgtcgtcgtcgtccccgaacgcgcggccgccgccgccgtgcccctgcaggctcctcatcgacgagcacgtcggcgactgcgtgctcctgaacgacagcgagtacgacgagtagaacgaggccgacgacgacgacgacgaggtggaggaggcgcaggacgacgtcggcgagcccgacaccggccggccgcctctccgcagcctgatcttgggcagcacgaacaacctgaggatgccgtgcttcccatacttcattcatcatccactgcagctgccgcagtcgggcactttgcagtcggtgtagtaggacgcaggcggcgtgatcggcggcagcatggcgtcggacatggcgttcttgggcgtgcccggctgcgactcccacaggaagggcacggagcccgcggaggcgacgccgtagtacaccctgaacgacggcgccgcggcggcgctctccctggacagcagcttggagaacaccttgctccccgccggcttcagctggagcttagacgcctcctcctcctcctccttctccttcttggccgccgccatggatggacgcgatcgaggaggaggaagagatctcgagctcgaggagagggaagctggagagagtgaggaggaagacgagagagcgcggcggcgagtggcttcttcttatgctgcgctgcggtgtcagtggccgggagtaatacggttttattagtggagattagttgggtgtttaattaattagttaattaatttgcacgtcctcttaatataattaatccgcttgctattgctatactactgctgctcacctcttcactcactcagatccgaggtagcagagttgactgttgacttggtgttggcctactaggatttattaggagtaggatttcccagctagaatttcagtgggaattttctgctcaatggaaatggttgagaatttaaatatttttttaaaacattgtacaaattcgtagatgctcttaaacatgtaagcacactcacccttgtaaacgcatacatacatctaggggtgaaaacggtacggaaactttccggatttcggacctattttcgaaaacggaatatgtcggtcggaattttttcggaatttttcggaaacggaaacgaatttggaaatattttctcggaaacggaatcggaaatgataagggcagtttccatcggaactcggaatcggtcgaaaactttccggaaattttctcggaatttctggaaatttcctcggaattaccataaattttgtgactgaaatacccttaattccttttttaagcactaaatagtgaataccatggtgtttggctgttattttttaaaaaaatatttgttatgcaaatctaaaattacataagaatattttttgtgctacattgggatttatcaacaacattactcttttaaacatagataatttatttaattagatttattagtttgaggggttttttattccgataaattttcgttaccgtattcgcgccggttcgttttcgctccgctttcgatttcgataatattcgattccgttttcgtatccggggtttccgattccgatttcgattccgaaaaaaaatatgaaaacgaaaacgataaagatggtttccgtccgtttccgtaccgttttcaccccctacatacatcttaccactatgagcatatctaactcttcaagaaattagagtgacatattttaagatcggtgaggttatgataaatgttattattgttaacatgctgctgaaagaataattattacaaatacgaacacccatttcatgtttaggacttgcggatgagcaagttccatcctaagaaatctgtaatcagctatgctatgttcagtttgcgtgagattttaaatattagaaaacaacgttatttttggtccagtgtattgtttaacctttttccaatcatcatgtacaaaaactacaaggttaaatttttaaatgaagtttattcaaaagataattttgaaacgagatatatctgatctattataattcttttatatatttagaaacatatggcacaagagttagtagtacccactagtacattagtacaaaagcgaactggtactaaaactttttaaactactcatttcaaaaccagcagcgacaagaacaaatggaaagacaagcatatcaacacaaagtactctatccgtcccataaaaaaccaacatagtacttactctgtttcacaatgtaagtcattctaacattttccatattcatattgatattaatgaatttagacatatatatctatctagattcttaacattaatatgaatgtgggaaatgctagaatgacttacattgcgaaacggagggagtatgaaatatgatacatactagtattttgaatctcgatatatctttgtccagattcattgtggtcttatttagatttcaacttttcttttcaaacttccaacttttccgtcacattgaacttttctacac

SEQ ID NO: 6238 - DNA, 11514 bp, Oryza sativa
actcattttcatggatatgaagtacagagatggcggagaaatgcaaagattggtggaaagatgtgaggtgaaacaagtggtggatctatttctcaaaaaaaaaaaacctcagaatatttccattggcattatacacacctttcttcatattgccttcttcctccagaaccacccttgccttctcacggagctgtgactaatcaagactgacttcccagatccagttcgaaacattggtggttcgtttccacggtctatgtattcttagaaaaaaggtgcatgttaatggaacagaaaacaaatatacctggtttgcttttattttttctgaacaaaaatttgaattaactgtgcaaagacacgctaaagcgcaacccagcaattaaaaatttaccttctttcatagagctcccttgctccatgagggtgatcgccttatgacttgagtttctattttggggtgcaaacttctgcattccagcatggagcattggagcaatggcttctccagtgtcattatttactgatatgcacatatgaaatcaatattaaactgagagttagctgtgaaaagctattcataccaactttttttgtgaaggagctatgaattgagaacatttatttaccattttttactggttcctcgccctctaagacaacgtgggctttctttctagaattttcacttgctgtgatagaccttcctgatccagttttgaacattggagtggcacagccatcatctgagtgagcttatctaacagatgaactttttgttaacatgctacatgcctcctttatccttggtagactaataaaaacacatttcaatggcaaaaccacagtaagcaacatgttgagtgaaacctaccttccagttcttttgtaatgttccttggctccagaagtgcacttgctctcttaattgagcctttacttactgaaatggacctccctaacccagtttgaaataatggcaagtgaccatcagcctccaaaaaatttcctgttggatgacagtgattagtatggcaaatatctaaaacgcatcaacagtaaatatttttattgttccaaatttgactagatagtaacacaggtttaaatgaaatgaaaaaaaagccttttacaggaaacttcagaaaaccatgtaccttgcattgaaacacccccctcaggtgtaacagatctatcattcatagtcaggccaccactcatcagaacagacgttggtgtttcagtttgaaaagtagtggtggagacattagtatctccatgtcctgaacccaatagaaaaataagcaaagctgatgaccttgtgcattatgcagtaaaaaaatacaagcctgcacacaaagtttcttaccacttcttttggcacattcttgatctaatactgtccttgccttttgaattgaggtctggctcaccacaacaggcctccctaaccccgtttggaacactaggaattcacggtcagaattcaatttccttcacacagagaagaaatcactaataacaacagctacatttacataactccaatcttaccaatattttcagcacctccatccttcaccacagagctagatctttcactgatcaagactggtcttcgcgaaccagtttggaaaatcagagattggtcaggcctaccaaaatcttccgtgttttctactatgggaggaaagttcattacaaccagaaggcgcacatttctcaataattaggtagaagtatttaactcaaaattaacaagcaggacaatctaatcttatcctcacctgtattattttgctccaggacagccttagctttctggatagatgctacactgaccgatacagctttacctgaaccagtttggaacaatggaaaattttccttgtcatacacatctgccacatctcctgaaagatcagccgttcaaaaagtaaaggcatgattagaattttgtgtaaaattttgctagatgaaattatagaatattctgtcaacagaataaccttgttttggatttgtttgtccctccaaaacagtcattgcattatcagtggagctcctgctgactgggtctggcctaaccaatccagtatggaacatagactgtacagcaatgacagaagaattctcggcatttcctgaataatagattacgaagattcattatcatgatagattgtcgagtgctacacagctcaaactatcctaaattaattagagccaaatatatgtcaccatgcccaaagaaatgaaacattctgcgtaattacacagaaagtaagcagatgacaaacttcctaccttctaaaacagctctagccttctgaattgagcccttgctcagtgaaaccattttacccgatccggtttggaacatcggagacaaactatctttatgtacaccacctgaatttcataagatgcaaaggcgaattataccattgaacctcgagaatgtgtaactaatcagaactttgtacttctacctacagttgaatcatccaacctgatctccaagaagagagattgaaacaaaacttacctttaaatgaaacattactttctcccaatccgcactccaaattagaaccatcaccaaatggttgccctgcaatacatacaagtatcagcctggtatgcaagtcttggagaaagagaacagaaagacattgaattccatgctatcaacaaagcaagaaatgcaaaacttcagaaaagataggcagcaacttttaagaaaaagaaaagtgtgtgggtatcttcatctagtagtagcccgaggaaatcatcacagcaactaaagaggaaagggcatgaccagaagattggaaataattcaaatttattgctccatttttctcttgtttgtttgtaattcagtggactgcaatgacttgttgtcttcgtttcttctaatatatctaagatgtgcggatattatgtgtccccaaaagacaaaaggagggccacaagaccaataaaattgttgtgagaatgtaacactttgaaaaaagcaaaccgcaaaacctcttacttctctcattacttatctcctccgcgacctccccaaccaatgccttggccctctctacagccctctcgctgacggcaactgatccccccaacccagtgcagaacaccgcacctttccctgaatcctcgatcgcttcggccattccatcagcagcaaccagcttatccaaagctgcgatttccacatccacagcaaacaaacatgacacttagtacaatgcagtggcataacaagttcgtaaatgggaggcaagcacgcgcgtgcccgcacacggacgagtggagatgagatgggtggacgaggcggcagtgcggcaccttggttgaagaggtcagccatcgacgggacgctgcatccatcggcggcgccggggcctagggtttcgaggcgaaaggggatcagtaataatgcgggggctcattccacgaacgaatagtacctcgaagagagagagagagagggagagaccgaaccttcgggaatcgcatcgccggatcgcgcctctcccagctccgtcgcagccggctgcggatcgggacgaggaagcggcgcctcactggccgccgccgccgccggtggcggcggcccgtcggaggcgggtacccagacgaggctcccgtcgggcttcccccacacctgccacctcctctgcatcccggcggcacagccagaaatcgctcgcggcggcggcggcggtgagaggatgaggaagagacgagcaaaaaaaagaaaaaaaatggagaggaaaaaattcaaaacgggaggaggcgaggagggaaaggaaagcgcggagcggaaatggcgaagcggctgtcggtgggtgggctgggcccgggtagattcgagacgggccagcccattagcgggggtgggtgacagcccatcaacatccatttggctggacgccgccgccgccgaggaggattgctagggcggcacggcacggcacgacgcgtcgcgtctgttgcgtcagcgtgaacagatcagccaacccgccgactcgtctcctatcaccacctgtaccgaactgccgccacgtagatcagcggccatggtatacacatcaacgctcaacgcaacaaccaggtcaaacgctatatcaacagtccaatttgcaccctccgtattattaggcataactaaaatttaaaattttaaaacctatttttgtgtttatttgattatttatttatcgtagtttattttttatcatttgatttttaagtcatcagtacacacaatatataaatgttgtactcataagttcttttcttgataatgtgttcgctaccagggatgggaactttgcatagtgcgtacggaaaacggggcggcctattagcacgtaattaattaagtatttgctatttttttaaaaaaaatggattaatttgattttttaagcaactttcgtatataaactttttgcaaaaaaacacaccatttagcagtttgtttaacgtgcatataaaaacgagagagatgggacgagaatagtggcatccgaacacaccctatagtcttataatcaactgtagacgaacgaaacgtaatgattttccccgttacacggaaaacatacaacaccacagatacctattatacgcgcacacagtcacaaaagtatacccttttacacacactcatttttctttttttaaaaaagaacatactcccttcgtctaaatataagagcttatctagattcataatactgtaaaatgttcaattttagatttaactgcgatgcattcgaagttggaatttttcaaggatgaatcgacagaccatctgtcggtgatatgggaccgggagtatcatgaccagaggcttgaggcagacgcaatcgcccacgtggcctggcaccttcggggacgtcgggcccgagggtgaggtgtccgccctcctcgtgatttcccccgagggggggtcgggttgcgcttgccccggccccgagggccgaggcaccccgaccccttaaagaagtctgcgccacatatatgggataagtgagcacagctgtgctcacctaacagcatttattgcagtctggtcaagcgtgtcacgctgcgtgcaacgcagtacagcacgctcttttatccggtctgtgaccagtcacagaccggtcagatcaacggttaggtggcgactggcggtctgacgcacgcctcgccccgtcccgtcaagacgagtgcctctaggcacacgtctccaaccgaagctagcgtgttacctcttagagatggcacgttagccctggttagatgaataccaggcttcatcctaaccattacaggcaaggtgttacacgaagaagggcaaacatgcacgttgttaatctgacgcgtggtggacaagaatgaccggtctgacactggtcgcgtcagtaacgggcagccacgatctcacgttgcgcccgtctccgccgggagtggaggtaggtgtgggctgtcccatcgaagtgtgattcggacggcaaccataccagtctctgttcataaagagaagaaaagtccagtttggaaaggaaagggtgcatgtggtatccccttgaagtataaaaggaggaccttgcccacagagtagagggttgattcttttccagattaagagcttagaacaggggagaagggggcggacactttgtagctcattcatacacaaattcacaaaaacacaggagtagggtattacgcttcgcagcggcccgaacctgtatacatcgccgtgtctcgtgtgtcttgccggcgagtaatctttccacatacagagagagcttgagattgcaccctaagcccccggccgaaccggcaaaggggggcctgcgcggtctcccggtgaggagccacgagctccgtcatctggcgcgccaggtagggggctcagcgtgtgctttctgagctctcgcactcttccgtgtgcgccaagtttcccttgttctgcctaatggccgagcaagcaaaggcgcacgacctctctccgagtgtgagcggcgacgacggggagccaaatccacgccgtcgagctcgtactcccccacctcctccgcgccgaagccctaagcagggggaggcgcttgagagggtcgacaaatccgcggcgtcaccagtcgcgggtgatgcaggagaacgccgagatggggagcgtcgcctcctcgtctacggcgacggcagcacgcctcagggtgcgcttcaggctgctggcgcgctcctacgacacccgcctgtcgtccacgacccggagtctccagcccaacgatggctggaggacgtggccaacttggtcatgacggcacagcagcgcctgggtgctggtggacggtccgctaccaccaaaacctccggcgccgctaccaccggctccgtgtcgtcaaggcggagggcgcggcgagcggcggcggctgcacgtcattcggctgccactccctcatcgacaccgtcgactcgggaggatcagcatggggagccggatgcccgcctcaacatcgagcgccggcgtaatagccgacgtactccccgtgcaacggagggcgcctcctcgtccagagtgtcacctcgacatggacgtgaggatcagccctccgtgcccccggctggtggtgtcggctgtagatcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaggatctgtgccagcagttcactatgaactttcaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacatggaactccttcggttccggagtggcagcttcggccgcccccggatccgccgctcagactgggcggcgtgacaggaggaggaagaagaggtcggaccgttccggcgacgagggtcatgtcctcgccgtcgagggcgctccgcgggccacccgaaaggggaggcctgcgagcgacaaaaagaaagaggctggtactcccagcaaggagcgccccgccggcaggtggtgctccgtccacaacacctccctccacgatctcgcggactgtcgcgcagtcaaaaatttggctgaacgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccatcgccaccgtcgatggaggagcgtgtgctcacgtctctcgccggagcttcaaggctatgaagcgagagcttctggccatggcccctactcatgaggcgacgcgtcgggcgcggtggtcggaggtggtcctcacctttgatcagaccgaccacccaccgtgtgttgcccggggagggcagattgcgatggtggtttcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactatgcctacctccagatgaagatgccgggccccggtggccccatctctgtccgtggcgaccttaaagtcgcgctcgcttgtatggagcagcgcgcggaccgcctcgctgctgcgtccaagcccgagggtggtgacgagaggcttggcccctctgcccccaccgccccgaggcagcggatggccacatgcgacgaggtcccggtcaaggaggttgccttgggcgacggcccatccaagaccacacggatcggtggtcttctggatggcaaataggaagacgcgctcgtctccttcctgcgggcaaacgctgatgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttatcatcagatttgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtttgtcgatgacttggttgtaaaaacgcgcaaccaagaaactttactttcagatctagcggaaacctttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaggcgttcggggccgttcacttggacggaggaagctgaaaatgccctcgcccagttgaaggcgtatctcagctctcctccggttctagtcgccccggagccaaatgaatccctgctactttacttagcagcgaccccccaagtagttagtgcagcgttggttgtggaacgcgatgaggacaatcctcattctgcgcacccccattctgtgctaacttggcccgggagcaagcagggaggagaggcccccgagtcaaacggtggcctaaggcccctgacgaccggagacggccctctgcccgcttgtcagacggtgctgggtgcccccgaccctcaggaaggccccgaggccactgcgggaaggccgcacttaacgccctttgaccccgaggctaaccctgtgctgactcgacccgggaaagagcagggagaagaggcccccgagccgaacggaggccagaggcccctgacgaccggagttggccctttgcccgcttgtccgacgatgccaggagcccccgacccccaggacggccccgaggccactgagggaaggccgctcctgtcgtcctccgaccccgaggtcatcggcacagaagacgagtgccccccgagaggccacttggacgaagaacgccccgggggtacggcccctagcagagaggatcggccccaccgaagggtgcagcggcctgtctactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcacgaacccctcacagctgcctcatgccgcccactgggtgatgcaattcgacggttctctatctcttcagggcgccggtgcaggggtcacgttgacctctctgaacggggacgtcctcagatatttggtccgtctcgactttcgagcgactaacaatatggcagagtacgagggactccttgccggactcagggtggcagctggactggggatccgccgcctcttggtattaggcgactcccagctagtcgttaaccaggtctgtaaggagtaccggtgctctgacccacagatggacgcctacgtacgccaagtgcggcgtatggagcgccatttcgatgggatagaacttcggcatgtacccagaagggataacatgatagccgacgaactctcacggctcgcgtcctcgcgagcccagaccccaccgggcgcctttgaagaaaggctgacccagccgtcggcgcgacccgatcccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcggtgcagagcgtgtcagttccacgccaagcaaatccatcagccggcccaggccctgcagatcataccactgtcatggccatttgctgtctgggggcttgatatcctgggaccgttcagacgggccccgggcgggtttgaatatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactctt

SEQ ID NO: 6239 - DNA, 4818 bp, Oryza sativa
ccatcagcgccacgtccgggcccgatcactctgcgtcgacgacctcgtcctacgccgcgtccaaacgcgcgctggattgagcaagctctcaccaatgtgggagggtccgtatcgagtgatcggtgtcccccggccgggctcggtacggctggccacgggcgacggcacggagctgccaaacccgtggaacattgaacaccttcgtcgcttctacccctgaaaggggggggtcgggtgtcaggttttggctcgggccaaccccgcacccccctcgggtgtgcggggttagccgggggctaccacacatgcacatatattcctttcagcatttcaataaaagcagtttcaatttcctaaaggttgtgtctgtgctgttctttccttttgaagaatcttgacttaaaataaggtcactcgtactcaaccttgccctcgggggttcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgagccattcgaggaccgggacttgggcgcgagcccttatttcaagctaaggcgcaaaaggaccatggcacagatcatcctcaactcatatgcatagcaaaataaagttaacatagaaaatttttcatcatttttgattgcagattaagttgatctatacacaaaagaggcatgaaggccttagaagaaagaaaaagaaaaaaagtaaagattggcgggggcctgggggctcattcaaatgcacccgggtcgctggcctcgtcgccaccgtcgtcctcgccgctggcgtcgccctcctcgtcggaactgggggcgaacgcgagccgaggggccgagccctcgaagccgttgacgatgtggtcggcagcatccccgacccgcgcgcgcgcgtcatcctcggtcccgggagggaactcctccagcgccatccagggagagaagttggggtcccgggcctggtaactcgctagcacgagttcgaccgccccccgggcgaggtccctcgaggatgccttaatggtcttctcgagctcctcggggagttgctcgagaacccaagccatcctgttgaggtgcggagcgaggccttccagattggtggggggcaccgacgtctggcctccccagagtcccgcttgccgaccggcgcgcttcatgcgggagaccgcatcccaaagcatgtcgggcccaatctcgcccgccaagcgaagggcctcggcctccccggtggaggagtccagcgctcgctgcatctccgcgacggtgtgttcggcagctgcgaggcgggcggctaagccgctttcgcccgcggccgccccgccgataggcgccctcgcgtctagctccttctcccgtgcctcgaggccagcagcccgctgctccagcgcggctctctcggcgcggacgcattcaagattgcggcgcgcctgctcctcctgcgccgcctcgcgaagggataggctgtccgccagccgtttggtcgtagcctcggcctcctcgagagcccgctcccgctcggcgagtgcatcctcgcgaaggcggagcgcggactcctcctcggcgcaggcggcctcgtgcgccgccagcgtcgcctcccggagagcagtggcggcctcgcggtccgtcaagcccctctccacggcgccggcatgttcttccagcgccatggcacgggcctcaagggcctcctcgcgccgccgggacgccgcttcggcttccgttgcccgccgctctcgggcagcggcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctctcgggcgatctccgccagcgccgccttgcgggcttcgagctccgagatatggcggcggtgagccttacggcccacctccaccatggcgtccaccgagcgccgcccctcctcgacgcgcgcccatgcggcctcgagctccgctcgttccgctcgcaaggcctccacctgggcgctaaatccatctagcaccgcggtgtttgcgcggccaaggcctgcataatgggctcggcgctcaccggggcgacggaagaggaggagaaaagccgccttggagaaaaggcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccgagggagtgggcccaagtgacgctgtcgcctcagcctggcgagcccgggcggcctcctcccgggcagcttcttcggcttggcgggcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggattggccggacttggggtggcgggaggaatgcgacgggacatctctgaagcagaaggaaaagccagaagacgaacaaagtgagcaagaaaaaacttctttttggagaaagatggttgcaatgagagtgagacgaacctgcgagggggtcggttgaatgaccaccttgggggggaaattaggtttccccgggctggttccgtctcccccatcttgcggagccgcttcttcttgcgctccccctcgggctgagacgtcggcgcggccccctccgggcgccgaccgctggtacgcaccgccccgccccctcggggaggagatgggggaggtgttcctcccagcttcctcttcccttgggcgtcggcagggcggctgctccccgggcccccgacgcgaggcccagaagcacgaccccctcctggggcagattgtttcccccggcggctctcgcccgcgccgtcgtggcccttaggggctctctcctctgaggccccgacccccaacataatggatagaatggagacgcggtcgggatcaatgcagagggggaggatctcctgaggaaggcaagacgcctccgcggagctaaggttcagcaccctttggactacgatcttgaagtcctcaggagcccaatcccatctggctccctggtgggtccgcgtgtagtcttcaggcccagtgtactcccaggcgctccgggcgcgccgttggagcggcgcaatccggcgacggaggtaatcgccgaacaccatggccccggtgagcccctgggatcgcaggcccgccaggcggtcgaggacggcgtcgtactcctcccccagatctaccggcgcccgccagctggagacctgcgccgggggctggcttggaaggcggaggcgcgcttcgtcggcaaggggggtgtagaaccagtcgctcttccagtcgtcccacttcttgcggaggacgcaggggatatagcggttcagcaccggcccccgcggctggaagtagcagccgccaaccaccgacggcggtgacaccgactgcacggtgaagagccaccggaacagctgaagagaggggcgcaccccaatgaacatctcgcacaggtgcgcgaagatggccagtgtcatcaccgcattgggggtgaggtgcgccatctggagatcgtagaactccagaacatccatgaaaaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggcagcacactgccgtcgagcagagcagagccccgtgccatggtggtggaggaagagatgattgggaacgagcgtgtgtggcgaaagtagggcgtagcagagaaagagttagagcttaggcagcgaaggcaagaggaacaatggcgaaaggaagggagcaaatccttttctcgatgcttttatacccttgccatcgctgggcctggctcctcgtttctcgcgcccactacttcgctccctcgtatctcgctatctcgctccctcgtatcccgcgcccacgcttccactaatcccattcgcccgtttacggcgcgtgaagtggatatgcggttgtggcaatcgaaacggattgtatcgtgcgcgcgttaattacgctcgccgaccgaagcggcgttaccgtatatccgagcgagacaaatctgctcacccagattcgcgcgctgctcaagtgatgtggcagtcttaaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggagattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcgtgatttcccccgagggggggtc

SEQ ID NO: 6240 - DNA, 1131 bp, Oryza sativa
atagtgacacccttgaaattgaaattgagtgggaaatcttctgtgttcttggcggtgcacgtgctgttgcttgtggaatgccatcgtggcgcaacatgaaaaagaaaagaagtattttattcttagggccgcttaccgttgattgctgatagcctccttgatttttggacaaatgaaaaggattccgcttttggtttgttgtttttcataatttcaattgcatgctgtttcgatttgtgtcttgcaatgttcagcttgtggaattattgagttacctcattgggtcaggaagaagagaacgcgaaggaaaagcgatggccctgattcaatcgctgaaaccatcaagtggtggaaggagcaaaaccagaagctccaggaggagaatagctccaggaaagcgccagccaaggggtccaagaaagggtgcatggctgggaaaggaggtccggaaaattcaaattgtgcttaccgcggtgtcaggcaacggacatggggtaagtgggtggctgagatccgtgaaccaaaccgtggaaggcgcctatggctaggatcatttcctactgcgctggaggctgcgcatgcatacgatgaggcggcaagggcaatgtatggtcccacagcacgtgtcaattttgcagataattccacagatgccaactctggctgcacatcagcaccttcattgatgatgtctaatgggccggccactataccttctgatgagaaggatgagctggaatctcctcctttcatcgtggctaatgggccagctgtgttgtatcagcctgataagaaggatgtgttggaacgtgtagtccctgaggtgcaggatgttaaaacagaagggagcaatggcttgaaacgtgtttgtcaggagcggaagactatggaggtatgtgaatcagaagggatcgttttacacaaagaagtgaacataagttatgattatttcaatgtccatgaagttgttgagatgataattgttgaattaagtgctgatcagaaaacggaagtacatgaagagtaccaagagggagatgatgggtttagccttttctcctattagagtagtagtcatgctgcgggtcaataggaatatttcattctagctgctagtgatgaagtactgta

SEQ ID NO: 6241 - DNA, 1392 bp, Oryza sativa
tgtttgttaggccagtaggtcagccaaatccagcctctaatctcccagtccatggtcttccctaatgctgcaccacagatcttccaccagacgctgtctccatattcatcacgtgcgaaaatgacaccacccttcttcgtgaatgggcgatacacggtcgagtacctgtcacgaaaccaggcccgtggctgaagcagggagagcttggaaggctttgaagaataaacctcccttccgtttacaccatcatggagaaaccagttcaaggttgtagtgtttccatgcacagactgttcaaatttccagggtttcatggtcagtgtgaggctttcgctgaccgatgcctttagtccaaatgtgtttgggggctcgaatgaaccttcaatgcccttctcaaggccaaactcatgcgtggggttgtcggaggacttgctgactgaaaccgacaggacatctgattgttgcataggtgtgatttgcagcataacacgtgatggaaagtgcttctcctcagagccatgtccacgttcagtcatgaggatctcggagaccaaagagtccacatcacacctgagatgaatccactgtaagtgccgctcttggttttagatgatacacgtatggttgtttttttttccttgtgcagttaattgtaactttgaaacaattcagtttgtagatagactgcttttcaaggtctagaaaactctgattaactacctaaattgagttcttcttcagctggtatacagggagaaagcatgttaccgaactatgcataattgcttgctcaatgttaccttactgtaggcaccaaccaaattatttgctagttaaacctttagctttttttaccaaacatatgcagctacgctttgcatgccgcaaacttaattggttcccccgagtgatactactgtcacctcaggatgagtaggttttttattttcacctaaattagtaagtgtgtatacagttcatatgagatagaatcaaatccttgaataaattactgaccttatgttgtccacctttatctcgacatcaatccagttgtcccttctgattgttttgtaggcgagctgaatcacaccttcaagttgctgataagtaagcgagaagagaaggcgctcatcctgtgttggcactgcaggatcttccatgctcatggcaatgagtgggcagtatagctggaccttccagagcccacttgctgaaagagcatatgagaacagtggcgatggcaccccaaatgaatggtgtgaggatcgttgctcaacaatccagttagtcactgcaagattcattgtctgcatccattgctcctcaaggtttgctcccaacattctgacaaaggtctttgcagcatctttgcactttggcccagtcagc

SEQ ID NO: 6242 - DNA, 4431 bp, Oryza sativa
actgctgggtgtatgatttcaggtggactggttttgacgtccacagagaaattggcacacggtaatttgcaaagatggagaaggtgacaaaggagggctgggtgggaggggttttgacaactgataggttcaccgatggctgtgatgattctgatgctgatggtgtggggcagatgcaaagggacatggcgttggagcgccattgggagaacggaggcaggttggtgatccaaccccatacatcaagaggtaagctgtgagccattacgttgttgaaaacttgagcttgttttgcaatgtgggagtatcccagtattggtgtggttttatagatggaagagatgatggttccgcagataaaattttggctcatccatgactgagtctaatgaagcacggcataatttttggtaaagcggattcttggttgttagaagaggaaatcaagtcattgagctgaggaatctttgttgttaattggagtttgaagaatcttcatttgtgctttgcacaggtgctaaagccaaaagttaactgctatacggtaatatgatatatcaaacccaagttggttggctaatgttgtagtgaagagaatataacgtggctctaaacaggaaagctggaaagaacgatatggttgggtggaatggattagtttggatggattctggataactcggttcaataagggcctaacgacaccaaatttgtgacttgaaggttagcttgtgtgtcgactgggaattggaacctgatgcatctcactctttgcttccgttccgtcaagcttcaagatttacctctcaatcgagtattgctttatacttgtctcagttgtctgatcttattgagaattgtaggatccaagctcgtgcatctcggagccagcatttggcaacaggaaaaatggctctaatgaacccagaaatgcagaaaagcggttcgcgtcatggtcctgtttctttcagcttgggattattataatccagattattagtagtaagctgaaagaatcagacaacttattgaagtagcttattataatctggagcccagcttattataatctgataagctcatttaggtgagctttttctagattattgggtgaaaaattacccaccatatgccaccccactccctcattatacttgcaaactcaataatctaggctctaataatctaggaaagaaacaactaacagcttattctactatagattataacaatctagtttatagtagattataataatttcaagctgaaagaaacagggcctatagttagagagaatcctccacctgaatttcgtgtactacctgcctctgaaatctcgtacacgcagcttgtccttcaagctcgagcaaaacctttgctcctgtgctagtactaggcagttaggcagacctgcagctgcaggttaggatatgagaggttaggctcatattcgttgcttagcatcgttgcactgcattccacaccaacacacgaacactgcattgttccacagtccagattccccacgaactgatctgcctctgactagtacacggcgcaaaggagaattcagcaccgccaacagtagcagtaattcactggattactggcgaaattgttgcagctattattcccgcctgctcccagcaagcagaacctgaaaagttgcttcaaaaaaaaaatcaaaaattataccagcttccaagcctcccatatgtactgctatcaccagctaaagtttgttcattcgaacttctctaagtaactagtgtcctgtagacagttcagtttgctccgctacaatcaggtgacaaccaacaacacctatcttcagtgagaaacaacaacgggcagagttaacgcataccagaactcgctacggtgttgtttctaaaatgtaaaaaccgtatgactgggatgcacagaatgagatggccgtcaggcgtcagtgctcagcaatgagcggcaatatttcgcttgagagaaaggtaatactgtgaggcggggttggggcccggtgctgtacaaaaccggcccggggcctcatctgcacttctgcaatcctgtcaaatggcaacggcgcatgcgaaagctctcttcccggaatgccttggaaccatagatggaccagccttggccctccttgtaaacctcaacctgtgaaataaaaaacaaaacaaaataaaacgagagaaggatgtagagttcggcgagttgaagctacagcaatggatgatggagagagtgatcttgggaaagaactcacagtttcaacgtattcttcactgctttggataccaccaatgaggtatgcgttgccgtccaatgtaaccgcacatccgtgtgctcttgggacgctgagtgggctcccccttctccatgagttggcacgggtgtcaaaaatctctacgctggaaaacgtggtatttctattcaggccacccagagcatgtctgaaaatgaaattcccatgttggatgttaagtcgtatattatcaggtttatatcgagacgtcaaataaaagatagtgatataaggctaatagtagcatctaactgccaggtggaatctgtgtgtgtgtttttttgaaatcacatgacctctctgttgattacacacacagataaagcgagcgaaactcacagtgaatcccccaagacaactactgaatgggatcctcttcttgtccgcatacgtggaagttgggtccagaagccttcccttggatcatacctttctgctgacctgtgcatatgaggatcaatcattcaataggaaggtctcagaatcaaaatcaagtaaagcatggagagaatggtgagggtggatcgtaactgtaagtacatgttgccatcataaccaccaattacatagagaacgccatttaattcagccgcagcaggagcacatcgctggaacaataaaatacatgttggtgaggtgggtatattggtcaaaaataaaaatacattaaaaatatgggataatatttcatgcaaggtgaactggaaagttacaatgtatatgcctcataaatcccatgaaattacatgaattgcaatttgcattccataatttgaaatagcctgggtttgaaaaatttttattgcctattcaagtgctcaaaatgtagcttagattaaatttgcaaatggtccaaccaaccctgtaagactagtgctcaagcgaatgtccaactcacagtcagcttgcccactactgctcaaacagctatctaaattctaaatcactcagcatagttcaccacgagaacaaacttttttactgatttacgacacgtaagaaatgattgaaataatagtaaaactgttctgtgagcagcactattcatcttgtaaaagattaagaacccaaagatgtaagtgattataggaaatgcagttcaaacagcctctcttcacaacatgtttttttcctgggccatctaataaatcttgagccttatcaagaaaatcacagtgagaacatagcgaagaccaggaccctattaaattggccaaaaaggctggtacattctactctatacaagtgttataagggagtagaagtagaaccatacaggcggctgcatggacaaactgtatatccatttccccactgctggatcaaacatctctacttctgaaaaagactgagacccatcacccccaccaatagcaaatattttaccattcaaggtagctccagcaagatgccctttctcatgattcaagcagggcaatcctatccacttattggctcccctgttgtagcactccactgcaataaaacaaatgcagatggtcaacagcttgcttatatagagcactacgtttggcatgttgaagaatgtttacctgtgttgtaccacaaactgcgaatgccattccaaccaccaaaaatgaagacatggtcctttaatgtggcaacagccgcatatgcacgggctgagctcatcggcattagagtttctagtatgtccgttgcagggcaatatgaatcaagggatgacagccagttaatgccattatggccacctgttaggagtattgatggcccttctacatcatcatttgttacaccgaagagtggtgctgaagagctatgcgatttctcaagctgctgttccagatgttcaacttttctttccataacctttaccaatttcttcaacaacaaaatttcttgatctgaatcaacctagaacgttcaaaccataatcaagatcggagtttgcacacttgaacagcgtaattaactcaatatcaaacacatatatactagtttggttttccggttaaaatttgaacatggtttaaaacccacaaaaccagacatactgacaagagataaaaccaattaggaaaacgggttcatctatttataccttttcttctttaaaagagaagatcctactgattttaagcaag

SEQ ID NO: 6243 - DNA, 12919 bp, Oryza sativa
  unsure (1)..(12919): unsure at all n locations
gccgcgatcgagctaggaatctactgcagtggatccacatgagtagccataacaatactataattagattccgttctactccttccgtttaaggttataagtttgactaagtttataaacaagtatagtagtatttataatactaaattaatttcatcaaataaataattaaatatatttcataataactttgttttgggttgaaaatgttactacttttttctacaaatttagttaaacttaaagcaatttgactttaaccaaagttaaaacgtcttataacctgaaacagaggggtagtatattgtaaacattaactctcatttattttccgttagcatatttccaaactgttaattaaacgatataatttttaaaaagtttatataaaagtttttttaaaaaaaatgaatgaacattttttaagtttataatagttaataattaattaattataggtcaattgcttgctttggtttccgtgccgcataaaagctcagttcctacgcaggaaaggcagcatgtggaacaccttattttttacaataaaattcactgtatttatatatacacatattctaatatatgaatactttccatttcaaaaagtttttttaatcatgtatagtccatttttaagtaattcttttttgcgcacaaacttagatgtacacaaccatatttataaataccaagattatattaatttatacctagtagtaaggggtgtcatacatttatatatgaagttgagccataatagttctcctagcttaattcgccctgcctctacttgcatggatggaacaattatgcaggtcgtcggctgtggtcgatctgtcgagctaaattgtaaagctagcgatcgagcaatgcaaacttgtcatgcaacgcaatctagctgaaacacggtggcaacaagcatcaacgcgtgcaatgcgttgaccgcactgatgatctaagccagagagctactactctacctgcacaataatttttgtcacagcttggcttgtcgttgcgttcagctcgactaatcactcgattagttcagcgtatggtagcacgtcgaattaacatactaactaatcatcgtctcaaaaagctaggtagccattatatatacaatccatcagaagtaacaacactatagctttcttagcttgtaggctagcatatggtctgttccatattcaccttaattctactacgaaaaaaaattaagatgttgcacggccaggttcatatgttaattaacttatatagatgaaggcaccaaacaactaatcaatggaggcccttaaacaaatccatgctacctaaactcctatatatccaattgagcattcacactcgtagtataatcggctagctagcttgcagcactcatgcatgcatgcatgcatgcaatggaagcacactcatcagagggtagcatggcatagcatattagcatacaaccaaggtacagcaaggcagcatggctgtgtccatgatgctcgaatcattgcagccagcagaagaaaaaaaaagaaaaaaacacagcacaattaactaattaaggcactagctgctaatcttgaaaaaaggaaaaaaacattagaacatgggttagtacttagtagaacccagcatctctccatgattagacaaacctaattgttgtttaggatctagataaggtcatggcacacatgactgatgagtagtagtgaggtgagatgaggtgatctcaccaaacggtgaagtgatgaaaaccctactgttaatggtgttaagtctctctctctctctctctatctatctctctctcttttgcttcttttaggcgtgtttagttcccaaattttttcccacaaaaacatcacatcgaatctttggacaagtatatagagcattaaatatagataaaataaacaattaattgtacagtttgcatggaaatcgcgagacgaatcttttgagtctaattagtccataattagtcataagttttacagtaacccacatgtgctaatgatggattaattaggcttaataaattcgtttcgcagtttccaagcgagttatgaaattagttttttcattcgtgtccgaaaacatctttcgatatccgttaaatgtccgatgtgacacctaaaaattttcttttcgcgaactaaacaagtccttaatttgtcattttgtcctctcctatatatacaatccatggccaacctcaccgagctcaacacagtgaagagaagagaagagaagctaagctagtaggtaggtggtgggttagctcgatcgccaagtgttcgaccgaggagcgaagaagaaatggggaacaacctgagatgctgcctggcgtgcgtgctgccgtgcggcgcgctggacctggtccggatcgtgcacctcagcggccgcgtcgacgagtacggtcgcgccgtgtccgccggcgaggtgctggcggcgcaccccaaccacgttctgagccggccgtgctcgtcgcagcagggggcggcggggcggatactcatcgtgtcgccggagtcggagctggagcgcggcgagatatacttcctcatccccgccgcctccgtccccgacgccaagaggaggacgagcaccggcggcggcggcgccggccgcgggcaccacgtccgcagcaagtcggagggcagcgccgtcgccgccgatcggttgggcagcccggccggcagcgcgtcgccggagacgacgaggatgatgagggcgcagaagcagcagcaccaacaccggcggcgcatgagcaccggcagccatgcctcgccgtggcagccgcacctctcgtgcatcaccgaggatccctgagctagcgcctagcttaatttctttttcttctctgaattcacagtggtttttttgcctggtgtgtaaatttcctctggtgcccggtaaatatttttattcaccttttgtgttagtgatgtgccgattttacattctgaaatcaacaactgtgtataattttcgaagcacaaagcgacttccattctatcttcttgtatcttcgaacaacattttgcaacttctttttaaagttcatttgggtttaccaaagcgaacgaacttgttcatacaaaattaaacaagtcggcagctctgattgatgcgaaattaaatgaaaattaaaccacttgcaagttatatatatatatgaactcaactcatgaagtgaggttgtgtgtcatgttggatcccccccccccaaccccggccctcttttttttttcttttgtacatgaaaaaaaaaaagaagttcagataaacagcaacgagacccatcggtttcgatgataccacggcagcaggcaatgctagatcgatggacgctgagattcccggcaatgatttgggaactaattcatgaatactccttggaaatcacgcgagctctgcatctgatcgtcgtcctcacgctcgattgatcctgattcctgcggtccaagttaatttctgggcctactatacctttgaagggcccagtttgaaccgctaccagttgtagacttgtagcggtctgattttcgcaggggataaagttcagtttatatcgctcaacttgcgttgagtttcattcagatcctcaagcaggtacaatagtagactattagtgagctgtaaacatattttaataagataaaagatgagagagaaaagtagtgggttacatatctgtagtcgcagactccaaaacacaatatgtgtatgacaggtgggaccatatattaatagtatagtaaacaactattgtatgaattgactattaaattaactatagataaattaaagctagtagtgggctatactattaaacttgctcttagagatctcttagcagctagggatgaaaacggatcggatacggacggaaactagctctaccatattcattttcacatttttttcggaatcggaatcggaaacccggatacaaaaacggaatcgaatattgtcgaatacagatacggagcgaatacgaaacgaaacgaatacggtgacgaatattaatcggaacataaaaacccctcaaactaagcatcacaaatcaacgaagaaatataattcattattttttctaatagaacatatcaacatttccaaattttagtgttaataattttgctatatccaattttgtggttgagggtgacggtgtatgcaaaaatcgaccttaattttctcatgcagctccttaagactagtttatcgcactcatatgaactccaaattggatgattctttttcctaaacgtttgtaaaatcatgctctattgtgttattgtgttcttactgctattattttggccatatttttcttgtgactttgttttatcaattaaaattttggatttcaaaaaaatgacaacttcaaataatattttgaagcggtaaataatttcagctgaaaaagtcatgaacataaaagttgtagaactcatcaagagctacaacttttattttgatcatttcttcatctgacaaagcaatagtaacattgttcacaaaatttacatatctctcttataacttatgaaaccatatgtgagatatgtaaattttgtaaaaaatgtaactatcgctttgtcggatgaagaaatgacaaaaataaaagttatagatcttgatgagttatacaacttttttattgatgactttttcagttgaaatcatttagtatttgaaaatgttgtttgaaggtatcatattttgaaattcaaattcaaactgtttaaacaaagtcacatagaaaaatgacccaaacaaaagttgtagatcttgatgcgttttacaaatttggtgttgacagtttttttcatttgaaaacatttactacccaaaaaattatttcaatttcatatattttaaaattcaaattttctatagttcaataaaactcggatggaaaaattaccaaaataaaaatggtagatgtcaatgaattctgcaactttgtttttgacaactttttcatatgagttcatttactacgataaaattcgattcaaagtttttcattggattaaagaaggtgggtcccaactgtaagtgtcctcttccttttctttcccttcttctcttcctctttctctctctttcttatctccttctctgttctcttctcccctttcttctcgattctccacgccagagggggaggggcgggcatggcgcgcggcggggtgccagcctggcgcggccgcgcgcacgggatggcgctctggcaaggggcgcggcggcggggtgccggcctggcgcggcgggagtggcacagcgtggcgggcgagacggccggcgccctccccctcccagatgtaaccttcagttgctgcctaaatcaaaatggggggaaatgctttcctagattcgttatttttgtcttctaatatgtgaacaagagaacaacctttattaattaagtgccaactattagctatgctggttttcagctgataaaagccacaaattatgctttgcactttctcttattgtatgttatttttgttcccccaaggggcaatatcctgaatggagtcctaaaaatgcttgttgacctgaaacctgacacttccactaaagttcctttcaaagtgtgcatttttacgcctggaacatacaatttttggaggggaaaaaaagagataatgtatcagtaaatgatcaacaattctatgtatcaatgtgctttgtacgtgcacgttcactagtatgtaataaatatatcacttcacgatacaataacaagtttaaatttgatttctacaaattgattaacaaatcaaactataactatgtaatttatccacaatcaaatttgttgataatttataatttttagaagccgaattttttgttaagtgatatatttgtgaattcctcgcacccttgcgttggcaacgattttggactttatctaaaaaagaaactgatcgaaggctccacaaagtggctaacacgtacaatcctgtagcaattaaggatgggagtacctatacatctttcgaaagatttttatgatcgtatcacacagatttttaatctttagattaaaatcggatagatataataaaaagcaaaaagcaattaagaaacaccataatggacactaaattaccatatcctcaagaaaaagaccaaatccaatacaaaatttaaaatttacatgcaaaaattcaaaaattacagtgtaacttacaaaagttacagtgtaagttttataaattacactgtaacttacaagaaaatgcactgtaaatttgagtgagaaaatcgagtgagagataagaaaaaatctttcgagtgagatatagcaaaatcgattaaggatatatttgtttgttgagagataaaactggccacacttgattaactctggacgcggtggatgcaaatatattaagtattcactctgcctagctacgagctcaggattacatatgctcactattggaaagttgtacaaacttaatatttcctaggccatgctgcatgccaggaagccgaacaaggctctcctggtacagcaagagacgtattgaatcgtcgtccccgtcccccgagctgtcaatggaggccaccgtccggagagtgccggagtccgggtcgtagacatgagcctcgtgcgccgtggtcgcgacaagaagcttcctcttcttgtctcccggcggggagccaccaaggtaggtgagcgggacgacgagccacggtgccgtgagcagctggcgctggcgctggcccggcgctggcaggtcgacgcggtagtccagcgaccagctcccggtgtcgtagtcctgcagcttccatatctccaacagcacgtcgtggtcgctgcggtggcggacgtcgcgtaccatgcacaggcggccgtcgagctccgcgagcgttttcccaaccggcatggccacttcctcgccgctcccggaccttatgcctttggctcgcaacagacggtagtttctgactccgttcaagtggaccggaacgaggtcgaccattgagaaaggcggctggggaacacggcggaaggactcgtcggcgagcgagaaagagaggacgccgtggggcttgtcgaggtagtttgtcctgaaactccagtggaggcacccatccgcgaacaccggctgcacatcgcggtcgatgctggcggcgtcgtcggtgaaaccgaggccgagctggaacgacgagatggccctccagcctcgggcgtcgccaacggtgagcacaatggcgtgcagtttgcccactacctcttcgtctatgcctaactgcaccaccttgaactctctggccggcgcgtggaagcccatgacagtggcacagtgaggtcggtgcgaccggggaagatgcagaatctcacctgtggtagggttgcacacggagtagccttcgcacggcctggcaatgaggacgaggccccagcagggcttggagccgatcactctcggacagtcgaagcaattgctgagccacggcaaagtccgcctactgagccttcttcttattcggtacgaccccatgtgcgtaggtgcaggctccaggaaggttaacttggcggcggcgagagcgtggtgtctgtcttggaagccgggcaacgacacctcggcgttccaggagcggcaggtgcagcggagcctcgcgagagacctcgccggcaggcgcacgagcacctccgtcacgacgtggtcgggcagcgtgaccgtgacgccacacgccgccgaccgctcatcgcccgtcttccttttcttggttcgcgggctcgccatcgcgttgctgtacgtactgtatgtcacacccacaaacggatcgatctatatatgtgcgcgcgtacgcgtacgccggcggcggcggcggacgaagcagcaggacgtacgcgacgcacgcgggatatggagatcgatcggtgcaggcgaactgatctatctatctatctatctatctatctatctatctatatatatatatatatatatatatatatatatatatatatatatatatatatatatatatatatatatatatatatccgtaccgaattaataaataagtaaagctttcgtatcgtacgcatttttggtctgtctttttttctttcctttttcgctgttttttagttcacacggttcgctgccgggccaaactctaccgcagctgtctccacgtcgatttgtcaaccaatttaaggagatcgagaaagattcagccggaggttgaagagggttgttcgaactgataccgtggcttcacttatgggctgggtcaaagagaaacgggttgaggactaatattttcattagtttatgggtaaaaacccatttttccttccttttcagtccaaaacaatgaagatttttcattaaaattttcaattataatgtttatagcaatcataatgctttaatttataaactttttcattgactttttcttcatattgtgaattcttatattgtttgaaccctattaaagaagctaagtgacgaaagtcactcaagtagtaagtttgagagtgaccattagagcgaccacttgtacttataggccttggcaacctatagtcttgttacgcaacacagcttcactcgattcagtaaattaatagttcaaaccagcctcgctcttccttgaaagaaaataggaatctatgtactcagcaacattctagtagcataaaaccttttgagtgaaatacatggccggcccctaaacttgtgtggtggtgtcacttaggccctgtttgattcagcttaggattattataatctggattattagatgtaagctaaaacaaacagatatcttattataacagattattacaatctataagccagattaatgtaatatggtaatctactctaaaggtgcctttttagattattgggtgggtaatagctaacaagcacctaataatccagagaaacaaacagctaacaacttattttatgtcggacttattatagtctaggttatagtaacctggctcgattatctagattacaataatttttaggtgatacaactagggccttaggtcagtgaacttaaaaattgcacgtttagatccgtgaacttggtttaatgtaccaccttggtccaaacgtcctttgattgcatttgaccgccaacgtggcatgccaccgtagtaacacttttgctctcaaccgccctcacatcacaacacgtcgcatatatctccttgtagctatatagtaacaccagaatccaaaaaaaaaaatcctcaaatcgttcttccctctcatttttctccttgcatgtatagaaaatgcagtcccgattagcaattgccattgcactggctcccgccgctaattcagccgcactgtaccaccgctaaccccgctgcactgcgctgcctcctgccgctaatctcaccgccgaggccgctacaaccgctacctctcggcctccttccgctaacctcaccgtcgagaccctagctgatttagggatattttgggggatttgggttgaaatgcattggttagggtaagttatgtgtagggatggcagtcgggcacgacaggcacgggtggtgactacccatgcccgtgcccgcgaggtaatttatgctcgcgagcatgcccgttactacatgacgggaaatgagtacttcccatgcccgtcgcccgcggacgccatatgcccgcgggcatgcccgtttacatgtccaaatatcagttcaaccatatcccacaagcaaagacaatgtcacaatttaaagaaaaggtacagtagtaccaagttcaatacaagcattacaagttaatcaatctgatgacgctctctcttgtggcccgatcttctggtgaggggataactctcgttttgatcgagtgtgacatttacgacgtggctaccaaccagaacaagtccaggatgccgtgcaatcggtacaccacaaacgatgtcgtaccaaccgtgacgcgcggttgatgatccctgcaatgcaaacgagagaacactgcaagaacaagataagatgcaatctaaatattgcgaataggtaattaagcacaaagaaatagttgcgattgaagtggtagatctaatcgacccggcaaatcaacacaccaactattgggggctctgaatcaatagtcgccgactaatcgaacgaggactagagacaaggtgaatggcacttggcaaaattcaactaaacaaaacccaaaagtttttgaggatgtagaaagctatttatagaggaaaataaagctagggttaagtgctaattcgtggaggtggagggagacacttatgagatgggcctagtctattacaaggcccaaggcccaagttcggtttcagcaacagcactgtcttgttttggctattcccgtttactcgagatgaatttggatatgagaccggatgcgtttgaaggtagcgagataagctttccacgaagtccaagatcacccaaatcagagttggcatgaaggcgctaggtccgtttgaagtcagtactgtctccgaaggccgaactggacttggacttggaattatcattgtaacgtgtgaagttatgagcgtatccgatgaagtgatgtcctcatcatctatataccaatcatgtactatggataaagcacaaaatcaaatcaaagatctacacagactgagaacctgaaaaaagtcatcctatcgaacagaactacaccggactgagaacctgaaaaaagtcatcctatcgaatagaactacacggagaatctaaaagaataagaatcatccaatcggacagttacacagattgagaaccctagaaaaagggaaaaaatcacacaaatgagcgagtttcccgtcggatccagttgttccgagctcgtcaccattgccgtcgaccgcgctcctgtcatagcctggccagccgggcacggccacattcaccacatccccaactgcgctggcaccccctccctctaccccggggccccaccctccagcgctctncttctgtcggaaacagaggagaaagagagaaggacagccgtcgccgccgtctctgcgccgtaagctcgtagccccaccatcgaggcccaccgggagaggggaaatggaaggatggtcgtcntaccctcacctcgctgcattgcgtcgagcatcgccaacatcgtgccatgctagcgaaacgggagggagagggggagcggcggagggggagaggcgccgctgacgccgtcgttntgagagagagaggggggaggggaaatgattntagggttagggtttgggctgccgactttatatatatgtcgggatcaatcgggactgttgatcagatcgaacgggtgcggcttctcccgcgtcgggttgccgttcccaggtcgccacataattgggccacctcatgggccatgtatacactccgcacagataagttcaaatttggtcccgcaagttgtccccgaatttgaaattcatccctaaaccacaatgctaggccaaaatcagtttatttttctaagcaactgatttaattattttttatatttacataaatttgtttgctactattttaagccatttaaaattactgggaaattacgatcaattatttaatcactcatagattatttttagataaatgaaaccaacaaaaaaattatctagaaagtattaatcatatgatattgtatttgaccaacgttaatatggtttcatgtcaaaattcgcacatattccactaaagattttttagtgaattttattttgatactacaaagtgtgtttctttcccattgcagatgcctttacctttttccttttgtagagcatggtgaaatcagagctataactgcccctgtttatgaaattttgtgaaagttggaatatgttctgaatgtgtagaaaatttggaatatctcacgcatgtattataaaatttgagatacgacctgaatctaaatatgtatacagtatgagatatgttttgatatttccatgtataaaacttggagatatttgcaaggtatgtacaaattcaatatttttgtgcacgtgttataagtacacaagtaatcttaaccatccatatttgtttgatattcacccggtgcaacgcacgggcatatttgctagtaaatgaatattatatttttaaattagtttctattgctactcggccgcataaaactacacatgggaattataggaaaggtagaatggtggaaatgccagagattagaccctttactattggcaaaatatagtaagatctggtaaggttgcaaagttgtaaaccaaatgcatctcaacaccaacaacatttggtatttaccaaaatgtgttaaaattcagtattacattggacgcgcctcaacaaattatgcctcaaaggaagctcccttgttttcggtcacggtaaaatccggaccatctcgacagtccagtagcaatacatataaaaaccttaatgcagatctataaagaaactttatccttagatttttttgagggctatactaacgcgagccaatgtaaatcaaatggaaaaagcattttcctgggtattactagcatgcaaccatcatctgtaagaacgaggtttaaaaatgttgaaacaacagagcacatcaaatcttcgtatgttgggtggtattcttctcatgtttacaaaagacaaaatgaacacatctatccagtttacgcagtccttttcctactagatggagaggatccatcttgccgcggacgcttcaacttctgtatgcattctccatcattcctcgtatgcttcaaagatgggtcgctgacatagtgaaaataatccacgtaatacagtgcattctcgtcctgatgagctagaccaacacttcttgagtccctctccactgaatcttgcatttgtgagcaagccttgtacatgaat

SEQ ID NO: 6244 - DNA, 9353 bp, Oryza sativa
ctaacgcggcttttttttttaaactaatggagtgagtggtggattggatttctaacgcggcggaccacgccttccaggcttccagttccagccaaggtggggacatggtggtgtatcggatgagtgggttgcacttgcactgtgatttttactacattttatttgttcttttgtttaacaatgttttttttaaatgagtctttacgaaaattgatttcgccaatgctcctttttttttctctatgccacgatcatcgactccgatgttttagcgtctccacgctaatgatactgtcatctacaccctcgatctctatggtagataagtcatggatacgatgagaatcagtgctacataaacaaccaacctcattggcatcgagcctatggtgccacagcggtatgagtctcgctgccaacgtaattggtgtcgactgtcaagcctaatgacctcggcgccaatgaggcccgagctgaaaaaggatctatttctaaaatagtttttctaggcgccgtcacaaaggcatgctactgatgattctaccagtcatacacgcgcgacaaggcaaacccacaaggaaaaggtcactttgactctcttaaaagtcgaccgaatctaattcatgcccattaaccaaaaaaccagatagaaatatagaataactccctgaactaatgaaaccagtgtaatttcactccttagtggttttggagtacggtttcgctgatgtggcgctgacatgacggtgttgattgggtctttatcccacatggtattgacgtgacgcttatatagcattaaaattaaaaatatatttgtgggacccatttatcattcacacaaaaatatacaatgggacccactgacatgtggggccacatggtcatcctctctccaacccttcttccccttcctctctccttatctctctctttctcttccccttcggccaatggcgaacaacggcacagcgcgcgtggcaatgctggagctgcgggtacgggagcggcacaacgacgatggagacggcggccagggcaacgtacgacgccccggcgacccaggtggggaccctgtggccgagctcggccaccttgttcccgccgcggcacacgtggaacacggccatgtcgtcgagttgcgggagcagcgtggcgatctccctgcacagtctcaggtccttctccgactgcatgtcggcacggtcgcgcaccacgtcgaccatcaccttggagtcgccctccgcccaaatgaggcgccacccgttctgcaccgccagctcgagccctcgcctgagcacggtgctgatgctcgcgatcccggtcgagtgcttggaagacccgtcgaagttggcttcatccacccctcctccggcttcctccaagtcctcgtcgacgccgacaagtaggcacgcagacgcaagatccgtatccctacgccccgctgccgacgaggatgcaacccagaacggggttgcgccgccgcagcacacccagaccagcgcggtgcgcgcgcagcatcaccgatcccctcgcagaaatattcacaatttgttcgtgtatttagccccaagcggacccaccaatagggcaatgttgggaaatggctagacctaccggcgccggcgaatatccccttccccggacttgttcctcttgcccatatatcttttttgtgtgaatgataaatgggtcccacaaatatcctttcttcctatatataattggtacccactaaagatcatttagtgctataaagctcaaattctatgaagccatgtcatccactaaaaatcaaccgttagatcattcgagggagttattctcaaccatctgatcatctccaatatgctcctttatgtggcccattcactcgattaggagcattggaaattcttctcagcccaccaggcaatgaggcatggagtccttcaaccttcccctgcagacgagtggtcaccaggtcatgcggaacccttccaatagtctgctgcgtcatctccgtattagaggaacggctgccatctaacacggcatacgaatcgacgacaatagctatttgtacgctgagtaaatcgctcatctttttcacgctaattaactttccatctgttacatctccttttgctaaacaccacgatgggagctgaagcagcccgcggcggatgcatacacaccgctttattgcgaaacctcagcgaacatgtcttgccttcaggaactgacggagctgctgctgcagtaagagcaggtacaatagcaggctataagccaactgcaaacatatcttaagcagataaatgaggagagagaagggcagcaggctatatatttgtagccagctgtagcacggattccaagacgaagtgtgtgtatgataggtggaaccagatattaatagtgtagtatgtaactattgtatgaatgagctattagattggctatagatgaattggagcctgtagttggctatactattaaacttgctctaatggagagattgatcaatcttttttctttatgacttttgcctaattggtcgcaggtgtggtggttctatggactgaatgcaagctttatagattgtagactcattctattcaaaccacggtacatcactgaaatatgaatttctgtcttggaattaatgtttggcttatttttgtttttgatggcgaaatatatggttgatttaaccttacagcacgcaggaaaatattattggtagaaatgattttgttttttcaattcatattcagggtatcacataactctggcttcatgacatatacaagtctccagcggagtgtgttctcgacgtatcagcacagttagtctatccttacttctttttggaaaaatcttattctttaattgtttgatttgatattcatgcttccaaataactgtctatgaaacatgtctatagaaatcgaatggattgcaaaaattaagttcctccgctttctttttttttttctgtttagtttatctttacaatgtcagaggaatttgattattaaagaatgtaagaccaggcatggaaatatgcgtgtattcggtaaaaaaacaatgatcactagcatcattttccattacattacaagatattgtgcctaagattcagcgctgtgggtcttgctacctgagtggcagtgcactggacatctgaccaaccctacttgagtctttctttttcctttctatttacttagttatttttttactaagatttacaactgctatatatatatatatatatatatatatatatatatatatatatatatatatattgaaatatatagcaatgtgtacatgaatgtcccgcagcaacgcgcggggtgtcatctagtatttttaattttaatgccatataagcgccacgtcaatgccgcatgagacaaagacccaatcaacagcgtcatgtcagtgaaatcatcctccaaaaccactaagggagtcaaattacactggtttcattagttcggggagtcattttatccggttttctagttaaggggcatgaattagatttgaccgacttttaagggagtcgaagtagactttttccatcccacaaatagcttgttgtttgtgagctcgtggccctagagccacgtgatttgatccaacaagcaaccccgggcggctttgggtcgtgccaaagtgagactccacctcaatttggcccaaacagcactccctactaatatagctggaccaacggtctcccgtatagatggccaaatgggccgcccggctcgtagctttaattgccttgcttcattttcgccatattgagattctatggaagaaatgaaacgttatccgcctacttatacttcttatagcaagcatcctcttagccaagaagtcccagaagtgaagcccctttcaagctttagtctttctcaagtgctcgatcggggcttttctggtgatttctatataagaaaacacttttgagaacttggcatagagtcggtgatcctactttcatagggcccatcctagcccgccctaggtcctgtcgtgcccgggccaagatttgtcgggccggcacgacccgacctacacgtcggctcatgcagtgctggcccacgtgctccaccaggccggcacgaaggcacgagcagcccatcgtgtttttttttgaaataagtctatttaccctccatctctttcggctgtgacatatatatagctaaaataagtctattttgcgtccctactctttgggccgtgccatataatatgtctatttgttctctctattctttgtgccctgtcttacctatggttgaaaataagtctatttcacttctctaaacttcgtgacttgccaggctagcccaccgtgctgaggcataggtccagacatgacccaacagccgggccgtgccggcacgggcctgacagcgattgggttgtgccgtgcttaggtcgggccaaaacctcgtgccttgcgccgggccgtcgggcctcgggccttatggccaactatagtctcccgtgacaccccccgggggctcaactcccattttctcgcgaattcgcccgccgcctgcgccgatctccggtgcttccgccgcacacctacgcacatggcgattggcaattgcttcgactgtctgacagtctgagggtgatcggctccagcctccaagccctgttgtgtcctcgctctcgtcggctcgtcgctaggccattcgaaggctagctactccgtatgcagccccaccacaggtgagattctgcatctggcgcggtcgcaccgacctcactgtgccgccgccatgggcttccacgtgacggccaaagagttcaaggtggtgcggttaggcgtagaggtgggcaaactgcacctgcacgccattgtgctcaccgttggcgatgcccgaggctggagggccccggccgccatcggcaaccatgatgacgcgttcctcggtttcaccgacgacgacgccagcatcgacagcgatgtgcatgcacccggtgttggcggacgggacgggtgcctccactggagtttcaggacagactacctcgacaagcccccacggggtcctctccttctcggctctcgccgccgacgattccttccgccgtggctcgtcgccgcgctcaggtaccttgacgacgacggcgatctctccatggcagagaagaagaagaggaggaggaggaagctccttctcgcgaccactgcgcaggaggcccacatctacgacccggactccgacagtctccggaagatggcctccattgctggccgggcgacgacgattcaatgcgactcgtgctgtaccaggagagccttgtccggtttcctggcatcatgatggcaaaggaaagattaagtttgtacagcttgataatcgtgagcaagtaatcctgagtccgtaggcagatcagtcacggcaatatttccagttttatctctcaacaaataaataaattccatgctttgtgttagccacttcgtgaagccttccagcagtttcttctttcagatgctaaatccaaaatccttgccaatgcaaggttgtcaggaattcacaaatatataaatttaaattcaacttctacaaattataataaaaataataaatttgattgaatatattacatagctaaagtttaatttgttaactattttgttacaatttggtcgtgaagtgatatattacatattaatctattttgttaaaaaaaattaaaaaatagattatatacaataaacaaacggacattcactcgcgtgaatagaatccttatcgtgaacggatgcacgaccgtcaggttccagcaaggccttgcacgctcgaactgagaattgagcatcttgagtgcagccgtggagtaacggaatgaactgacgcgctgcgaccgttaaaaatcacgagaatcctcaccatcaaataatctgctcccttagctgctgctaactgacgtctgaggtggctcgtgtgcagtcgtccaaatcgccattcgcaactgctttgttcgcatgccacctagcatcaacgacgacgactttctgaaatctcaccaaaaaaaagaaaagcaaagcattttgaattcgtttttcctccctgaattgaaggcaaagaatcctgaattcgccgggaacaaacctcctgtcgacgcctggacagattagttagaacataatcctaattcagtaattcctaactcgacatcagcatcaagacattgacacaacacaaaagcacacatagatagccacaggattcgctccacagtgaatccggaccgtccagccagggcaccgcccggatccaatcaccgccctccacgtggcaaatctcgcttcgactcgacagcttaacagcttttcctccctcgtgaagagagctccgattccgaaacggctaaaaccgctttcacactgcctctttcgcgcagatccatacaaaaccaccggaaaagttttcaaatcccgaagcggattcgcgcacggaaacccacagtcgattctccggtgagaggattgtttcggcggcgaggtcgggggcatggggaacagcatatacaggttcctgtgcggcctctgctcgccgtcgccggagtaccagccgcacggcgcgcaccccgccgtcgcggcgctcggccgggacatccagcagttcgaggccacctcgcaggtgagggcgtgaggctgaagctgatgaaattcgattttgcgatgcgtcggcgtcgtaaggtgatgggatttttttttcttggggggtttaatttggtttgttttgaatttttaaggttccggatgggctgagccggcatgtagtctcctccaagaaagcgcaggctaattggtgcgtaattcaattcctcctacttatgttttcttcctccttgtttcgagctggaaatggatcagagccgatgagctttgtcgtaatcgcgagggattgggcgtgtgaaaattttgaaagcgacgtgttcaagaggaaaataactcttcttttttttttgaaaaaacaaagttcatttctttcttttggaaaagagaatttcctttctttttcaagcaagaagaaacaaaatatatcattcgctgattttggtgacggaattgtggttcagtacgtcgaggggtatcgagagataactttactaaactgaaccgcaataattgagtgaagcttaatcaggcagtggagaattcggtaaattaaatcagtcataaatgcttgcagtaattgtcattagccagtaggcacggtaggatttcctcaaaccgctgccatgatactagcagggtttactaaatcgtttgggatcaggattatcgtcacctcatggtttagcggtaaccgtgtgtttaccgtgtttaccgtggttttaaaaactgaaaagattattagacgcgataaatcgcgtgataatcgcatgattttgtaagccctggacactagtagtctagtactactgtgataaaatttcctggtgctgtaggtacaagaagctgatagtgacatggaagaaagccaggccgacgccgaggacgccggaggaagccgcgcggctcgtcgtcaccacgctgaagaatcatcagaaagcagacgtcgaggtatatctcaaagattcaaacttccaatgtcatcatactcatattctaggcgcttgaattctgaaagtctgaacaatcgatgcatgcctgtttatgcttgtccagggattcttggttttctatggccttccaattccaaatgcagcagcaagtacccctgcgcctcacactgcacacgtcccaaaacctcaaggttgcaagtttgagctgcacactctcccggtgagactgattattactttctaatctctgaattttcctcgcaaaaaaaacaaatatcatctgaatttttcatgccaagaaaggctcttggactgacaagtgcacctgctagtttcttaggtcgatgcaaaggccgtggccgacggcgacacgatcaccgtgtacattgacacggccgatcctcgggagtccggcaatgttccccgtgaaattcagaaagcggcggcggaacggacaagggcgcgcgcggccagggattatcagaaggccgacgggttgcagaagatgatagctgatgcaggatataggtcatcagcttgcacttcacatcgatcaatcagttttttgttaaattttcagagatggttaatggttcaggctgtgtgacaattctgaagttttcaatgcaggcaagttcctaatgcgagcggcgaggaagtgctcgcaaagaagtacaggatcaggctaaggtctgtgtgctactatctcttgatcactcgatcaatgagcaaatgattctgccgtttttcttcttctcaagtttgaggtggtcgtatgaaatgaaatgaaaatgcagggggattgatgcgccggagagcgccatgccgtacggcaaggaggcaaaagaggcgcttctgaaaatggtgcagggaaagagcctgaaggtctatgtgtatgatgaggaccggtatggtagatgcgtcggagatatctactgcgatggggtgtttgtgcaggtaatcatgcagtgaaatcaatttcatcgttagaacacttttgttcttgttgaattgcaatggcacattgtgcaccaatgggagaagcttagaaagtactactgcgatagtttgcgccatgtgccatttcgcttgcagttgttatactgcagttttgtttaatggagtgttacttaggatcatgaaagttcaggtgtttaactggaatatgaaggaaagttaattcgttcttttaaaacttttgcttccgcgttctgcaaggaactgtgaaaatatttcatcacatgacacgtactgaaaaagtttatcttttcctgaagcctatctttcttccatacttacacaaggtacataatttgcctcttgctttctgaacaggagcaaatgttgaagaaaggatgtgcatggcactatactgcctatgaccaacgaccagagctggccaaggtacattgaaaccatacagctacacagatcacttgagtgaaagcaccatgaacattcaggttgttctgtatcatatttctaaatgagagcctttgatttttcaatctatcagtgggagaaacaggcgcaatctggcaggaagggcttgtgggcggcgtcaaggccacagaagccatgggaatggaggagggacaagcgcaatggtacagcatgaacatgaaccatgaacaacagatgattgatttataatattagctctttcagacttgtagcccggagcaatatatgctttacaccacagtagaagtgtagatcgtgtagtgtgtacactagtacatcggcag

SEQ ID NO: 6245 - DNA, 8798 bp, Oryza sativa
acaaacaggcacaataatttcaaccattggattgacaaatctttacagaattaggcgaaagtcccctccgattccccccagtccccacccattaaacaacatcattaatctctcctccaccattaggaccctttgaatcgcaggaatggaaaaacagaggaatagaaaaaaacgcaggattctgacaggaatatatattttaaaacagaggattggaaaatacaggaaaaacacaggaatgaccgtttgattggaccacaggaaaaacgcaggaatcggataagagagatagactcaaaggaatttttccaagaggttggacctcttgctaactttcctccaaaatctctataggattacccattccatagaaattttaaaggatagtataggattcagtcctttgttttaaagggtttcatagaaaatttttccataggattaaaatccttcaaattttctacactttttttacaaatcaaaggagccctaagtatcagatcatttttagcttaaccatcttccaatcaatgcatgtagactactggtagtacttttccatctgccgctttgcaagatttaagaaacaccaagacatatactccctctatactaataaaagaagtcgtttagaacaatgtttaaatcaaaccttgagaatataaatcatgaataactctcaagttattgagtttgaaaatataaaaattatatgaatagatttgtcttgaaaatactttcataaaaatatacatatattactttttaataaatatttttatagaaataaaaagttaaagttctgttttggagaccgtgtcgctgtccaaaacgacttcctttacgagtatggagggagtataaaccgtcgaagtttttttctaagaacttaatatattagaagcacaaaacgtgaacggatacatcttcctctgcccagggggcagcaagcagaagttgtttcatatgtagcctcggcatatatactgacgaggaatccaataatattttataaaagtataagtaattcaaaaccaaataaataattaccaagtcgctatgcgtatacagtaacttctggctaaatcattttcgccacaaagtcatgcttcggtgctctttacttatagtaaaaatcaatctaaaccgttgatttttttttatccaagagactagatgtatttatactgccatcttattaacaggagtagaaacgtgagagggcaaaatgtccattgaaaagtagaagttgagggataaatttgtaaatatgcatatcagtcgagacggcgctacagaagcgagggggcggaggcggctaccgcagccggcgcaggcggcggcggctgatctgctcctggacatccttcgccaacacctgccgcctcccacctcgtgcctcctccatttgctaatctgcgtctttgttgtcctcttatacgtttacacatcgctcgtccttattttcgtcgttcggtggctcgtcggagctcggggagacatgctcctcagccggtgcatcccgtctgccggtattggaaggcaatggtggcgcggtccctattgcggttgccggcggctgatccatgattgagggcgaggagcctgcccgaggaggctgaggtccggggcgatggtgacaactgacaacagatcagtgactgaaggtacagggttaaacttttgggtttagccgatttgatcggacatcactaaaataccaaaatttcggtctgaaattttcaaaattttgaacaaaatttatttaaatttgaataaatattatcaaaatttatgaattttttttaaaaaaaaattgaccaaaataatatcttatcgaagggatccaaaatgtccgaaatttccaaccctgtgaaggcgtggagatggcgcaaccatggctgttgtggttgcagcggttctggctgtgagaggcactgaagcagcatattattatactccctccgtcctataatatagcaacctaggaccggatgggatatttcatagatgtccggattcgttgtactgtgtcccatccggttctatgttactatattatgggacggagggagtacaagataacctcctgtccatccatttcctcccccatgcagatcaagtttttttttttttgaatggatgcagatcaagtattgatatttgattgctctattctgtgtcgattgttgtaggtgtatgcgaaacctgaattttgtacgtagctgtgtattgcatgactgatgagatgaataaaaataatttactccctccgtctctaaatatttgatgctgttgacttttttaaatatgtttgaccattcatcttattcaaaaactaaactatatgtatacataaaagtatatttaacaataaatcaaatgataggaaaagaatcaataaaacgaatgatcaaacatatttagaaaaatcaatagcgtcaaatatttagagacggatggagtagcatatagaggtgcaatcgcctttgactacttggcgctaccgcaagagctgggcgcgtggagctacaacgcgaagaaacgatagaagcagcaccatcaacgataaattcaacgattacttaaaaaatataaaaaataaaattacagccctatataactaaaattacatatgtaaattaagttgatatgatatgtaagtggattgtaattttgataaaaaagatgtgtaagtaaatatgtatttgttattttttaaatataaaattacagtcctatataactaaaattacatttgcaaattcagtcgatatgacatataagtgtactgtaattttgataaaaatgttgtgtaaataaatatgtatttgtttttttgtccgttggatgtaaatctaaagttggaaaaaatttggatgatttttttttctagaaatcacccaataaatggatagtcagatccataaataaacatcaaaattatccctaatcatataagtagcaaagtactgatatagccttataaatcaacggcttagactattctactaatagtagagaacaccgaagcaacgactggctggccgagttgatcttctgttaatccagctagcaacgtacgaatccgagttggcgagttatcgtgtataagaatgtgcgagggtatgcggtagaatcctccgtccatacaccgatcgatacaccctcttacgtatagcagactagcagtaaacccaatcaaactgctgtacttgctagttgctactccacaatgacccgttacaagccattggtgttgccgttgatgctgatcctcttacacacccagctcattattgtcccttcttcatcagcagctacgtacgccaaccacaccggagccctgccgccggcggttgttccatgcttgccggaccaggcatcggcgctgctccggttgaaacgttctttctccatcaccaaaaactccagttccacctttgggtcatggaaggccggcacagactgttgccattgggagggcatccactgcaggaatggggatgggcgtgtgacgtctctggacctgggagggcgtagattggagagcggcggtcttgatcctgcgatcttccatctaacctccctcaacctcgcttgcaacagcttcaatggatcctaactcccgcagacagggtttgagcggctcaccatgctcacctatctcaacctctccagctccgatttcgtgggccaggtacctaccgctagcatcagtcgcctaacaaatctagtatctctcgacctatctactcgatttgaagtagaagaattcacacaaggtcattctgtgttgtcctttgattcagttgaatctagcgtgctcaaagagccaaactttgaaactttaatcgcaaatcataaaaaattgagggagctctacctcggcgctgtggacttgtccgacaacgggatgacatggtgcgatgctctatcctcgtccactcctaaccttcgggttcttagcttaccaaactgtgggctctctggtcctatttgtggatccttttctgccatgcactcgcttgctgttattgacctacggtttaatgatttgtctggtcccattccaaacttcgccaccttctcctctttgcgtgttctacaactgggacacaattttcttcaaggacaggtatctccattaatcttacaacacaagaaattagtaacagttgatctttacaataatctagaactatctgattcgttaccaaatttctcagttgctagtaatttggaaaatatatttgtcactgagactagtttctacggtgaaataccaagttccattggaaatctcaaatatttgaagaaccttggcgtcggtgcaagtcagttttcaggggagctgccctcatcaatcgggtggcttaaatcattgaattcgttggagatttctggaacaacaatagtaggaaccataccatcatggatcacaaaccttacctctttaacaatccttcaattctctaggtgtggtctaactggatctatcccttcttttttaggtaagttaacgaaattgagaaaattagtgttgtatgaatgcaacttttcaggaaaactaccacaaaatatctcaaacttcaccaatctgagcacactcttccttaattcaaacaatcttgtcggtacaatgaaacttgcatcattatggggactacaacacctccgttacttggatatatctgataataatcttgtggtggtggatggaaaagtcgattcttcatcaacacacatccctaaactacaaatattagctttatcgggttgcaacatcactaaattccctgatttcttgaggagtcaagatgaactcctttggctcgacctttcaaaaaaccaaatccatggggctataccatcgtgggcatgggagtcttggaatgattctggcgttgctagtttgattttagcacataataaatttactagtgttggatctaacccttttattcctttacaaattgattggcttgatcttagcaacaacatgtttgaggggactatacctatacctcaaggttctgcaagattgctagattactcaaacaacatgttctcatcgattccttttaatttcactgcccatcttagtcatgtcacacttttcaatgcccctggaaacaacttctccggagaaatcccaccatctttctgtactgcaactgaattacaataccttgatctctctaacaacaactttagtggctcaataccatcttgtttgatcgagaacgttaatggaatacaaatattaaatctaaatgcaaatcaactcgatggggagatcccagatactataaaggaaggctgctcatttcatgcactatattttagtggcaataggattgaaggacagctacccagatccctacttgcttgtcaaaatttggagatccttgatgctgggaacaatcaaataaatgacattttcccatgctggatgagtaaacttcgtagactccaagtgcttgtactgaaatccaataagctatttggacatgtcgttcaatctctcaccgatgaagaaagcacatgtgcatttccaaatgcaataattattgacatatcctcaaataacttctctggtccgttgcccaaagacaagtggtttaagaagttggagtcgatgctacatatagacacaaatacatcattggtcatggatcatgctgtgccaagtgtaggactagtatatagatataaagcctcactcacatacaaaggtcatgacaccacacttgctcaaatactaagaacccttgtattcattgatttctccaataatgcattcaatggtagcatcccagaaattgttggggaacttgttttaactcatgggataaatatgtcacataacttcctcactgggccaattccatctcaacttggtgggctgaagcagctggaagctttggatctatcttcaaatcagctttcaggagtcattccacaagaattagcatccttagacttcctcgaaatgctaaacctatcctacaacaagcttaagggaaaaatacctgaatcacttcatttcttgacattcaccaacagctcatttctggggaataatgatttgtgtggtcctccgctatctaaaggttgcatcaacatgacaattctgaatgtgatcccttccaagaagaaatccgtagatattgtgttgttcctcttttctggattgggattcggccttgggttggccattgctgttgtagtatcatggggaatacccattagaaaacaggctacagtaagacagagagccctctgtatcatgtattgaaataaacttttttctgtatcaaggtcacttgcagtgcattattgtaatcagggccatgtcagtgttgtcgcaagataatatttgaatcactgtaagtatgggtgataatggtgttatatttatttactttagagttacacaagccagtaggatgcacacatcatatactgatatacagagtttacattacatactagtgatgttctgaatcaacgagttggcatgtgtgatttataggtaacacttgcttactagtgaaaacaatagaattttgctttggcagtgaggttcggagcacacctgagatgttgttgagttattccatcgattgcttctgttatttcttcagtaagaaaatctgagcctacaaaaattcacccataacagtattgttaggtatgttcagtaggaaaactagcagcaattaacacctactagtcgccaactcagtaggatgacttgagaaaaaaaaggcatctggaggcatgtattagcaatttctttatgcgaaatgtattagcaatttgagatgaacaatcttagcatccgaagtaaatagaaagcaagttgctcctccatagcctactttaccccagagacacgcaacggagaggattcggaggggttcagactctggagggcgtagatccggcaacgctgcgttatgggaggaggagaggttggtttatggagtgtacagacctcggaggtgggcgacgccatgggagggagagaaggtccatgacgaggaagacgaccttgccgttgacaggtcagagatctcacctgctcctgttgagaagagcaatggcgcgggttcctggccttctatcacatacacaacgccaaccgggagagcgactccggccgccgctcgccggagcgccgcgccgccgccgctcttggacggctcaaccatcggcccgcgctctctagcaatattatgaaattaattgaagggcctatgtgtaaaatatacttcactcagtcacgttccacaacttgatctgaaccacacgattagatttaacggtcaacgcgtgcgcgagatttggaggaaaaagtccactttgactcccttaaatgtacaacgaatctgattcgtacccctcaaccaaaaaaccggttagaacgactcccccaattactaaaaccggtacaaattgactctctcggttgttttggagggcggttttgctgacatggcgctgacgtggcagtgttgacttggtctcatcccatgtggcgctgatgtaagattacatttaaaaatatatatatgtaggacccatttattattcacacacaaaaattataataggatccactgacatgtggggtcccgatatcattctctttccaacctttcttcctccccctctatctcccttatctctctctttctcttcctgtcggcgagcctttccaacctttcttcctccccctctctctcccttatctctctctttctcttcccgtcggcgagcagcgcggagagcttgccgaggcaacggatggcggagcggagggcggcaagggagtgcgtgaagccgtgggcggcggtgggtggagaaggccggcgcgaaggcagggcagagcggcgctgcggcggcatcgagagctgccagtcaccgcggtcgctgttgtcgcgtatcctgcagcgaggcgacggcggcggtgggaagttcggatgccgggtgcggctgccgcggcggtacagctccacctccgccgccggcgctggagttgccggagagaaggagatgatgtcgaacgcgttcaggctcgaccgccgccgcgagctcccgccccgcccgaatctcccttccagcaacgacggcgtcgccatcgtcccggtgcactccaccgcggacatcgccgtcgccgacaccctctggaaggccactaccgcggtcggggctcccctcgcgtgagttgctcaggctcgtcaccagcgacgacgacgctgacatggacatgtgctgccgctgctgcgccgccatggcagcatggcgccatccactcaccggagtagtaattagctagctagctagctaggcaacatgacgacgacactagcttaattagcttgtatttagttggttaatttagtgttgttggttgcttggcgacgtcattagctaagctagtgatgtagtagtagcagctagtgggagtattagttatcacacaaggcgaggaaaccgacgcccagaagaggggggggggcgcaggggccgcggccatgccgcccagatccgtcgccaatccacccggccgctgccgccactgatgcgtccgaatggggaagagaaaagggggagagaaaagagaggagggagggaggaggaagaagaagggaaggagaaaggatgtcggtgggccccacatgtcagtgggtcccacatgtcggtgggtcccacgatatattttatatgtgaatgatagatgggtcccacagatattttttaattctaatgccacgtaggcgccacgc

SEQ ID NO: 6246 - DNA, 1799 bp, Oryza sativa
tctccctcctcacctcaccacttctcccgccattgctccgctccccaatctccccaacgagagagagagagagcgaggagagggagagggaggatggtggggccgcagtacgacctcgtcgggaaccccctgggggcggtgcgctccaccttcgagagggcggcggcggagtccggtgggcacgagccggtggcggcgttccgggggaaagactggggcgccaccgaggtgttccgctcctttctcttcgagcaaggcgggcttgacaaggtaagaagtctgatccccccccgtgttgatggttgccgcagctgtcgatttctgaaaatgatgttatttggtagatcgctgaaaccctaatatcgtcaaagttagtgatctttgaatgtctataatgaatatgagacggggagattaaaggttttcttagggtaaatttggaatcatcagtagatgtggtaggaagtactatgctctcagatctaagttgggtgaaagataactgctttttgctgttcttgcaaacatttcaattcagatacttagaatgtcacatatgtttatgttgagcttgtcccaaaaaaaagagagaaagaggatattttgtattgtgggtgtaaatgaatcttaggaagttcagggaatgacggaatgtgggaatattttcctttccaggttccggtgttggatgaatcaaatcttggattgatcaagccgaatacccttgttcggttccgggggatggttcaggacatgctcgggaacgagttctatgttggtgctttcaaggtattggaatttagtacataagttaatgtaaagctgcattttagtgcttgttatgcttattttgaaccattatttgtgtaggatggctccacttggaggacaaacaaattctccgattcctcgccgttctcaatgccacacccttgtgattcacatctctgggagcgccatcttttccactgtgtgcctgtatgttgccgcttccaagagcacctgctgctcatttgctattaatcctagtcttactcattgctgataagcagcttatgttggaattcaacctggacaatgccattggtttatttcaggtgcctggacaaaattcttggacacgcgagtcgtcccctggccctgacttgcgcagaatagcaagctgcttcacatctgaacaaagggagaaaaggaagaggggtgcagataatgacgccatggatgtaagcttttgctaagtttgttgcaatggtttcttttgacactttgctgcctaacaagtagtattgtcgtctaatgagttgactgatgcaggtttcagaaagtggtagtggagagacttcttcatccagcaagaagacggtaagaaggaagattgatttttctttcctagtagtctcctaacatttacacagtctcgcaactgccttgcttggttgtagattaattctgcatgctaataaagtaggataacttaaatgtcttagtagatttatggcatatatgcttctccaaattgcttggtttcatgctaaatctaatccatacagttagctgactgggaatctgatttaaactgccttacttttcctcagaaggatgatggtgtcaagatctcaaatagttcagtagaaatgtcaatgaatgaagaacatcatgtcccagagatgaatgggggagatcatcatattcctggaagctccttttcctgcctagtgaaggtagagctcctaagctttctgcatgcaatgcattctattcaatcttttttttctatggtttacggagtgaactattct

SEQ ID NO: 6247 - DNA, 5026 bp, Oryza sativa
acatactacatagtgatcggtttcatatctaacaatgaaaagaaagtgtattcatatttgtatttttttctgacttctaatgcttgtaaatatttgtacaggttccccgtcttcactgcttggtatggagaaacttatctgctcatgattttctaccaaggcctcctgcggttgaggtacatagcactgaatcttgaatgcagaagttggtttaacagttttagcgttgatttaaaataactaatcccaattttttttatcatgcagccatcaccaatcctgctaaggggaattcggcaatctttgctctcacatcttactctggtattagggaaagatgaactggcagctcaatgtttactgttgcatcttctatccagagtacgtcatatcactaacacagctgatctatactacatcaagttgttttctttgcattgtaactgctaaaaacagttcatattagtttactaagttattggttctcaatctccatgcagcttcgtaataaggtggatgtggttaccgttggtaggctctccttgaatttcactggctttaacagagagagtgtttctatatttggaaaccagctaaataatttgttccagaggctactaccatattcacaagttattcctctgtcaattgagtatctcaacacagccacacttcagcctagaaaggacaaccaatcaggaaggtacatattgtttgtttgtcttatgaagaatttgttactcctgatgttttcatcattcaacaatcacttttaacataaccccacctaaaatttgctgcaaatggttacaggagttttacagttacctcagggtactcacctgacctttgatgagactctcttgcagtctggatcattgacatccaaaggtgtcgagaatactatgctgcttaagaacttgatggagtcacagaaggtaataagcctcatgacttcatgaggctacaaattatctttgccgaccaatttatctataacatctttaaacatttttgcaggttgagtatgattttgagttctacaagttggaaatggcaactgatgtgcagctactaattctctccgagggaaaatcaaatatcctaccttctgacttgatagtacctttccgcccatcatctgttcctgcggtaaatgcaagctccgaggaacttgaaagttggagatggtatttggccacagttaggtctcttcctcagtcaactgaaactgatacataccaggtgattatcccttgctcaactctatcaagaaataaactgatatgtttgtcaggaacatgaacagacttaattaaattgcataatgtttgcgccttaattgtagatgattcaagatgaaatggtcaatgccatgcgtgatgataggagcttgggttgttctgaacttagcaggtgtgtgccgctgatgcctgtcagtgtgggcaatctggcatcctacaccatctccagttacttttacatgaggattatgaaatgaaaccttttgctaaactaattctgcttatgtggatctgcagatggctaacgatggcacagataatggctgcaagctttggtgagaagagtctctccatggagcactggcagatggtgaaggagctggagaggctcaggaaggagaggctacaatgagatgagatcacagtaaaatgtgcttgtaaaatccacttgtggccgtggcccaatgttatgtgtataccactagggtctaaaatctaaatcaagatgtggatctgcaacatcttctgtgatcctatggaagtatcaatgccatttgataagttatctgacctgaaaagcatctcttgcaatacctgtgaaaaaaaaaattgaacttgcacctacaggcttgccatccgatttgccattggtttcagcaaattctacagcctgaagtgctgttctagtattggatggacacccaaatatttttatcaaccaagtgaaccttccatgccatgtttcaattatctttgagccaaaattttaacatacaattttccgtgtatcacttgcaatatttactctttttttcatatatttgacctaccattggaccagccagagcaacagagaaacactgaataataatagtatgaatgtttgtcaaatgataatgatacaatgcgataattgcacatgtaacttccaaattcaatgacatcagacagtttgtaactttgtatgctcgatcatcgagaacggtggtacagctgctccatgcttcaaacttgagagcagtgtaggttcaaaatatacaacacaaatctctacatacaacatttttttttgcctcactcaatactgtttcagcaatagagtaaagaattcccacaggcatctgatcttcaattcattaccggttcaatctcttgggaaataagtagcaatttcttgatttgcattgttttcacgatgcggcagacagaagcatggtttctgcagatgcttgtgtccccgtttcgcatgcatgaattgtagagcagacgtctgtcgtctcaagaaacttctgagatttcaccagaatcaaggggtatattcaaggaccatcttcttgcactgcaaaaattacaaataggactgccatgagaagaacagaactagaaatgggccttgcaaatggttaaaatggcagtatttcatcaggaaaaccattcagctgatacaaagttgcaggtaactaagctaattacagataaatttctaggtgctgggcttgatcagcgacatcttaatgtctcaaatcggtatatgcaagcacattcgagaaaagcattatagcatttgaaatgctttgcttacaggatgttaagtgattttctgtataaacaaccatgaaaaatgtgtttgattctttagtagaggctgatttattttgtatttccataaatgtgactaatttacctgctgtacataattatctgccttgctgcatgctttgagaaatatctcgactatctccagctgcaaaattacgaattcgattaagtatgaccccagcaatacagaattggttgtgaccattgaaaatctgaaatgatggcagttacctgcatgtcaggatcctttagcatgataagaacttcaacaagaacatgatggcatatgccgcatgtatctcctcgagatggtaggcgaagcatcgttccctttctgcagagatgcactgattcacagaacttttcaggtgttaccatcgaaacctccaagaagaaaaggggaatgtagtagtcaaccagagtgatgcactgtaacagggtaaaccattggcatacaaaaattagtctgacgaaattagcatgttctgattccaaggcgggcattgaaatttattcagacctgctgttttagaggtccaacgtttgcgcatgcatggtggaggatgctaagaatctcagtttgggtttcattttgttggaggtagaacagtgcttccgttgagtactgctcgcatagttgacacagctttccattggctgaagttaaccctgtcttcttgttttcaaggggaaagcttttatgagctgaaatacatgacaaattgaccgtagagtcaaaaactaataagttgaattgtagaacgaaatcattcttatgctgaagatataaccactgtgtgatatctgacctacaattttattacaggtgaagatagagttttcaagtgaaaacaaaattgtagaacggaatcattcttatgctgaagatatattgaccactgtgtgatatctgaattacaattttattacaggtgaagataagagttttcaaaatgaaaacaaaaatagataaaataaatgtaactcatgatgtctgatatgcagcagatgtgtcaagcaagactggtcagaaatgcaattctcataacattcgtcatcagcaaacacacagataccaattttactattatgtgcttgtgcaatcttagaccaacgcatataacgtgatgtggaataattaatgtagatcaacacataaatgtattcctttatattttagaactgtagagagtgttatattgcttgccattgcggcgcttgatctacttagaattatcatcagaaacaccaattgatatgaaaataagaatggagaaaatattagtaacattattcattctcataatgaattcatgacttacccaatacattaaatgaatctctgctctccgcgactgcaactgaaaatgctaataccagcacaaaagcaaagctccttatggaacacattttgcctgcttgcagaattgcagattagagaaacagaagctggaaagttaaactccaaagtatccaactgaaagttgaagctgtgtgcatcagacgaccagaatgcatctcagaggtcaatcatgcagaagttttccccaaaatggttgactagacagatttaccctccggttgcttaactaaaatttctccatatggccaaaagaaagcctcaaatagatcccttcctcctctctcacattccaaatctagtgttagatcttacaggaacgcttcagaatcccaatacagtggatttcagcccatctcaagaccaatttttgcacaaaaaaaatcaacaaactcggtaacgctggattagatttctagattagatctcacacttccacaaacaatgcatacacgagttgcgcaccaaatcagccagattcagcttccccaccgaaacaaacgctagaaagatccaaaatttacttccttttcatcactacagacgctcgaattcgtaaagcataaaactttctcttccgctactaacctaccttggttcgtgggagatgaaatcaacagctcatgatactcaaatcgaaccccccatggttacggaatcgaatcgggcagagaaaatcaagaaacagcgagtggttgctaagaataagctaatatggatcaaggaatcaagcatgggctcaccttgttgcttcttcgctctctgtctgctttgttcttggaacggggtggagaagtcaggagagcaagggaatcttcttgaa

SEQ ID NO: 6248 - DNA, 2573 bp, Oryza sativa
acattttctcattttatagtttattttcgtttgtccatagcaaatttagtttacattcttctgtcagccaaagtcttcagtgaatcacggcttcatgtcgctgtacatccttgttcaacatttataagcagagggtttggttgaagagctacagaattgcccatgccaccataatttgtgaatgcatccaaagctttccatatcggaaccatcattttgactggtggatacaccttctgcaaattaagggactccgtcagtcaacggattcctcgtagtgcacttgaaaccaactgaaagcaggaaaaatttaccttaaaaacacgcacgagtttgtcttcgctgtgtagaagcaacactaagctccagtaacatgtaataggggtcacatgctcattcaacactggctttaggagcttgccaacgggcacaaattgacgatgaactcttccactataaaaggtagctttgatgaagagaagataaaagaaaataaatctacgtgctgcagcatatataaaatctaagaaacatgggaagtgtctctgcaatgcctgtattcctgaaaaactttgcatgttcagtacattttctctcaaaaaagagagaagtatttgtagttatttaaattttgaagacttcacttccactaccatgatacccctatctatttgcaattgccaaagtccccttggggtgtcactaaaatttgaataagtaagagtggaacttattgcacccctgtaaaaatccaaattggatcttcatacgtccaaaaagtgttgttctagctgaacaccaaaggttggcatgatcaacaatgactctgcacaggattaaaatggtatcaatgaggacacacaattgcacttccatataagcattcctaatcaggatcctgagtaacaagggtatacatctttatccttccttcaggtaaaaaaataactaaacaatcagtgcaaaatgcacaaaatagataatacagacactgcccacctacctttcttcacaggcttatattttaagcattttgcaacggcaaaagcaaatgaaatactccaaaaagaattgatgcatagactctcctgaaacattgagcacagaaagtcagaaactcattaaagtcacaagcgtatggtgacacctttcttctctttctgaatcttaagtacccaaacaaaatcaacatcatgtgagtatcactgacaaggcatgtatgataagcttgtttttgaagaacctcacatatctattcacatcatgaaaaatgttggcattcagcaatcagcaaataaattttttgggagaatgcagtaggtcactgaaatagtgaagactcagctaccacttgggattatcatccgagagaacaacgacctttaacagcaaggcatgcagtacattcgcaaagaggaaaatttcgccgacataagagaacagcaccctgaatttgctcctcttgatgtagatttcatggatatcgaatcctccctcgcagtgatgtttatacgtgtacacgccactcgacatctctactgctcgattcttcatggtttcaggctttcagaacatcaaaacactcgaagtcccaaccaatggcgttcatttcagaagctttcaatccttgaacgaacctaacaagaacaacacatccgcccaaatgtctagtgaatcccatgatctcctaactgctgatatagagaaaaaaaacgcatcactgcaaattaattgcgcaaatttaatacggggagacacgaaaaaaagaagtctgtatttctacatagcattatcaagtatggtgatgaaacaacatccatgcccacatcaatgcaccccaaccacccaaaatgtacagcaaaggatcgacgtgagcgcgcgtacctgcgaatgaaacgcgagacggtttggaggagtaaacgcagacccgccgccggcgacggcggcggcggaggaggaggaggacggctgaacgggtaacctaaccacctgcagctgcaggctgggatttctccgtgaattctaacgcgatgcatcgtagccgtccgtttgtagaagtaataaattgagtaaattacagtttggccaatttttattacaatgccaaagtttcactgtgaagtttgaaccaccattccaactaatgtttttattttataaactagataatttaccattgttgtactttaggccaccttacttttttttcgaacgcgtaaaagaattacacgtcaatatattagaagaaaaggagatttgttacacaacgcaatcgagcaggcaggcctatgctagagaggagggaaaaagaaaagggaaaaagaactagtagtgcaaaaagactactccaacatacaagagggagggggcggagcacactacactctagcaaatccccaaagcagcaatgcccgcagaagaccacagacggccttccgagtgaatgggctcaataagcacagagaccgaggatagtgccgagtcaaaaaccctggagttccactccttccacagttgccaagagactaggaggaccaaggagtcgaagcctaagcgaagatgctcgggtaagc

SEQ ID NO: 6249 - DNA, 7467 bp, Oryza sativa
ctggacatatagtatgtgatcttccattgcactgactatatctcaagttgactaatctttgaagtccgaaattcatgagtcccatatgaaatgcgagtagttatgaattaaacagtgcctcgtgtaattttctgtgtagacgagctatatcccagtttcttttctgcaggcccttcacataattcttcagctttacccctttgtagtgcaagtgcaactttaactcactgttacgtttgtttctcaggttggttttagtaatctggtcaagcgagataaagaccagatgaggcacgtgtgggtagctgaggcgacagagagctccacctatagtctctcccacgagatacctaaaaaatcacatctcaaagaggctgccacttctgctgaaaaatgggcttcaaattctcatcctgtaagtttcttcacaccacagagatcctgttctgataagatggacagtcttattgtcactttctgttgatctcttgcagatgattcagcatctgaaggaaagagttctgcaaatagttggtgacagtggtggctgaagtactctgaatggtgctgctcgtagaacagtgtaaggaatctctcggagttctatcaagcacaactatattattttttcggacatgtttttctttgtcgttccagtgcttcacttgagataacgttgattggaagtagtttgtttcaggactcgaccagaatgaagcctatggcagtggatgctcgatgtcgactagacaactgacagtcttgataaatgctgcatggcatacgaatgatggatggatacgacggtatgatactcactttgtcatatggttttctagtcataactaaatatcttgattttttattgtaaataactgggctataactataagcctacaatcatctttcttaaacaaaacttggactgtaataaatagcatgtgtgttcattagggcgaggcacgttaagaaacacgggtacacttcatgatgaattagcttcacaaccatcttattgaacattatctgcatatttaacatgtaacatcagaagattatgtataatgaaacatgttgcgcactgcataataccactactccctccgtcccaaatgatagggcgtccctttttaagaaaaaacatattcggtagcttttgaccaataatcatactaactatatctatactatgtattatgcatgttatatcactagattcatattttgaagtacatttatgtgatgctaatttcatatttgttgggattatagaatgaaataaaataatgatcaaagtatgttattgaaaaccgtgtaaaaaaatataggccatatagtttgggacagagggagtatattgtactttctatgctcaaattcgtgaattgctgactgctccttacatttcaggttacaagatgttttgactttggttaaagtcaactgtttcaagtttgactaagtttataagtttatagacaaatgtagtataatagctataatactaaattaatttcatcaaatcaataattgaatatattttcataataaatttgtcttgtgtttaaaatattactactttttttacaaacttaatcaaattttaagcagtttgattttgactaaagtcaaaatgttttataacctgaaacagaggaagcataatagtcacctgtgccagtgtttaccagtagatagcatagaccataggtggcaattcgcacgctgcatcatatgtttattaataaagcaatgcatggtttatgtgattttgtgcgagcaggacgtgattggcacgtggagggacagatcagcggatttggacacgagatatcctgctggcgaggaaatggttagactcccaccacgacatcatcctgctggcgtttgagcgtcccaagtttcaacatggagcgtcatgctgccctcccaatcccattgaacacgcacatctgctcgtcgttcgctatgagcctatgaattatagattacgagcatctggtgtctgctgcctatcctgacttgtaattatccggtgtataaagttgtgtatggaggcttagtttgatcattttgatatttctacagccattttacatgcgtttagggaaaaaaaatagtaatacgtgctatagctaagttattgatactcaattctcaaattggagaacagccctgacgcaattatatggttgtatttctcactccaatatccaattggggaaaatgtctgttgtttaaatttctatgatattttagacttcccagatatgtttaatgtgcaatggagtatattacagcttttttagcctactgtctgcaactcttccatcctcatttggtctgtggcatgggccaaatctctcggtcattacccagtaatggcctgaattcacggcccgtttcaagctgttatatatggaccttaacgttaggccattgccctaactttcagcccacatattttgacgggccgcactgtctaaccaaacaatcgtgtacgcgaagatgaagggaacgtgagaccagtcaggataaatgccgttttaaaactgcaaaactggaactacaaaaaatgttaaagaatagtaatatcattagaacacgaccatgatacgagcaaaacagttgaatggttttacaagagatcagtggtaactggagcatatatcatcatatgcagtttggagctaaatgtatggcctcaggataatcaaggctgaggaaggcagcaacagaactttttcttatgctcttttcgggccgggccgggtgttcatcttccagcagcaatttgtattagcgaacgaaatgcgcgtcgggagctttgtgctggaatatttatgacgaaatccttttctcatcattatacctgcagaatacaaagaacaagatcaataatggcttgtatcggactaggttgccgacttctagtcattgtactaatattggctacactaatggtttagtattgattatctgtttgcttcattgtacttgggaaactatacgtgaaattacatgaacgtacagaaaaggtgaattgaacaaaacaaaatgaagatggcaatatttataactgaaagaaagaactcaaattttttttcttgtttgtttaccacgtaacaggtggacatccgtgacttcataagctacataaaatttgcacttcaattcctgaatgcttagatcaactgcaatttcaaattatagaaatatatattctttcctctaaacatgatatgcacttcatgaaacgtaatttcggcatgactgatatggaactaaaggcatacgacggtagttattgtgaaaagcaactggtgtgtactcaacttcaaaagtaatcaatgcaatgtactagcaatcggcatgaatgaatgatagatgaaagatgtaaatcttaccctgaacatatcaccaaaaagtccttccaaagcgctctggctccgtattccataaaattttgcggctatttcatctaataactgaaacccaaccataatatcacgtgagctctgtttcagcttgtttttcatatatgatagaaagcattaactaccttcttcaagttactctgctagttaatgtaatggaagttctatccacatattactctgctagtagagttaaatattaagcacattataagtgcagatggtcctttatcaacactgtttacatttccctatggacagcacatgataacaaggttgttggtggattaaattgtagagtttcctacatgatctaatataactcttgtgaacacattgttttatgacaactatgcagggaacatgaaaaatataatttttcccagttcttgttaagttaatctttgaaagaataagatgttttggtgcatgttttacagctgtttagcaagctaacactatatttgatgaaatagctacctcctcaaatacagggtcgcgatctgtacttgtcttgtacttctgccgcagtgtcctgaaaagagggtaagcatctctttcgagcctgtaaacatagcatgcagtcagtaatataaccacgaccagaggaaacaatgagaaaaaaaaaaacttgttgcttgtataaaataacgtctgggcttggtatacacgtacaagtaacaaaatgcaaaactatctcatcaattattcgaaagatgcatggaaacttggataattgaaactgtaggatcagtttgtttacagtgaacagaaagctacctaggcaacctagatcaacatattgcgcagtgatacacaacaagcacacaatagatcctagatttacagtgttaaaattatcacatcatcaatacagtcaaatataatcattatcctgcatagcatgcaatctaacagcaaagcatcaaccaaatctaacagtttgaactttaaccatcagtgagaacttaaacatggctaagttatataaggttatcagaatttttcaataaccatcaaagaaatatttaatatttttatatgcattcatgatctgtactgaaaacaaatcctacataaactatgaacatatctcaaaggtggaaaatagtctaatacccaggtaatgtacctaggccatgaaagattttcccataactggtggttctttcaaaaaaaaaagaattgttcctgcgatcagtattttttagtagaaacatgtaaggatgaaactactctgcaggtgtcctctaagttatcatggcaaattgcagcatgaatgcacacaaatacatgagaacattgcagaacaaaaatgtggaaaagaaacataaaaataatgcaaactgaaagacaggaaagacttacgtcggtaagagatacttgatgaactgaattaaatctggtttggggatttccaagtcagcagattttagttgatccttcagctcgtccatgagcaaatttgcatccctaagattcccttgtgatagataccttaaataaaaatgcagtatatcagaaaaacaagcatctgagcacgtctttttccccaaaatttcttatttattcatcctataacgaaacactttcttaactttgatttttctgaagttagctttgatttttctggtccccagtgcaagaattttgacacttccttttaacatactatagtactataaacataataaaataatatattatgtaactatttccgaagttcgatcaaattctaatattttaccttggatggagcactttatagtgtgctcctgtatgtgcttaagtatccaaaggagatttgtatataacttagaggatattgtattgatgcatattgaggaaatatatcctaatgcatgatttgctagcacattcctaaatatgtatattgtttactcattgtaaacagaacatgaaatagagaactccctatgaaattcggtttctgcattgcaagatgcaaacatcttccatggcttttagaaattttgccagtgtcaaaacaatgcactctttgaaaggaaaaaaaaaagaaagaaattatatcttacattaggacaccacgtgctattgcagtatcatcttcaccagggtagcactgtgcagtaagaaaaatattaataaaaatatttttttgattgagaaaaaacatctatgaatactgctttacacgaagattatgttggtcttgaaataatccaacccaaaaatggatatagataactgattgaacaatcacttgctggcaccgtgtttctattttcggagaaggatgacctccaactcaaataaaaactataagcaagagacccgttgtaaaatgaaaattgttgtaaagaatgtgaacctactgatcatattcagataagacattttaatcattgctcagagaacagaagaatgttcaatagaatttggcattagacaatcatcagctgcaagtctattatcaattattttctaaaaaccattacctttcccataaagttcgccagcatagaggcaaactttttaggatcatttcccctcacaaaatgacttgacactttagtcatgtcctgcatccaacggcagtcaacacgaaccttagcaaaccacaaaggcattaaagagtaacagttgaaaagacataaaatttcagctctaaaacaaacacaatatattcatgtcagaaaaatagttctataatttataaacagtaccgtttctggagattcagaatatatgtattccgccaacataacatgcagctcaggagatccacttcttgatgccccaacctcagcagaccaccttaataaaggattgatatgctattagtggcatataaatatagcaggcagaaaattgagaagagtcaactagatgaccacattgtccattaacagagttaaacataaagattcaaagatcccatggaaatgattcttatatgttgcacaccttgagttcatcttaaaatcacaaattcgtgaccatctcctttttcatttttttctgagagcattattgtaataaacaaacttacacaatcaacatctggatttttatatgcaagtgagcaacgagaacagatcatttgtttttaccatcatgataagctcaattgtctgttctacttttgtcagtaatgaactactggtcaagcactacagttaacaagtcctggtcatagtatagatgctattcaacagtttgatgtatttgccttaagatccacttaaacaaactgccatgtttagatgaagatgtttgatgcttgcatgaaggatatttagtttttctactcaatttacttggattaatgaaaattagtacaaccttacctgatagcagctctcaggaatgatgaacaactctcagaacgcacttttgctgcagaaatagcttcggataatttctgcccgtcgtcatcataatcatctccaaggaagtgtggaacagatatcctggggaaggcgtcgtacatctttctgatacgatctaaggtttacatatagttacaatcacaaaatgtgatactaacaaatcaaactagaaacatgttctcattcataataaagtaagtatcttattcaattcaattaaaatctaagggaaaagtgatcttctgaaggtaaacaaacaaagagaagacaaagtaaagctagagccacaattaggactagtaaacactgcttccactaacattttaaacaactttgattcttcaaaactttacaagtgatggacattaggagtatgctacaaataaaatattgtaaatatgttccaaaaatgaaatctagatgtgtatttacttacaggataaatatgcaatttattagcatgttaatgatataaagaaatagtagcttttcactatgagagaagactgaccaaaggttttcattataaggaagcgctgccttgacaaggggtgtccacaaacattatagcaagttcaccaccacaagttacctgaaatcaggaatttttaaccaataaggcaaaaatgtgaaggtttaaaatgatataaaacacc

SEQ ID NO: 6250 - DNA, 80 bp, Oryza sativa
  unsure (1)..(80): unsure at all n locations
aaaaaaaaaaaaaaaaanaaaaaaaaaaanaaaaaaaaaaaaaaaaaaaaaaaaaaaaaaaaaaaaaaaaaaaaaaaaaa

SEQ ID NO: 6251 - DNA, 405 bp, Oryza sativa
ttttttgcatccatgagcttcacttcatctgttacatcttctgtctggtcacaagagttataagttaacaatgtgaagaatatagtgcacctacagaaattaactgcaacacaataaataccaaatatttgaagcatgggggaccaccaaaatactcttcacacgattttctttgatgttgaaaaggatagcatgaagatagctttgttcgacagggattaatctgaataggtagtttggatactcctgtgaaaattagttcaactaatcaagtaggaaggaattttcagaatgttctgacatgtctaggccatcagcttaccagaaggggatggattattgatgttgataggtgcgatgaacctaaccagtttcatcaaggatgtcagaagcaaggtagcaagg

SEQ ID NO: 6252 - DNA, 3285 bp, Oryza sativa
  unsure (1)..(3285): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctgtttctcttgtaacaaaaacactgtgcaacagacccggaaaaatggttgacatttattactccctctgtcccaaaaagactttaactttggctatgaatctagagaagcatgtccagattcatagtgaaaaatgaagtctttttgggacgaaggtagtagtacctaagtatctgctcttccttttcagataacagctatggtgccaaaaataactgcattgcaagaagcactgcccaaatctattggacttctttcatttgatggtggtatagcaggtaatggtggcagccaggtttttaaattacaatgtgtgtgttctgtttccgtttggcctgttaatacttgcccaaaagagaaggcaaagcatagtatatctgaagggaccatctatcatcttaggagcactcaagttcaattgaaatatgagatggcattggtgaatagcactccataatatatcttatctatcctagatattgatgctactcagagactgtattctacaattcttcaattgattctgtgaatgttgcgaataggtcttaaagtggtgttattagtaattatattactccctccttccaaaagtctaagtcctatttctttttgcaccaagaccaagaagcaattaattcattcaccatgtgacaaaaccaatgaacatgcaaccaataaacactaaaatggcttcttgggttcctatcaacaatttaatttagcacataatgactacaagtaggacttagacttttggaaaaatcaaagaatgaaataagtcttagacttttggaaggagggagtattatattgcacctttaaaggacaagtagttgctagtaaaatggtgtattgccaatttagttcctaaagtggtgttcgagtagctataaaaagtttgtagtcttttgttaagaatgggatggcctcaatttctttggacattgtggttattgacaggctcatttatagtcaccatataccaaattaaatattgttaaattccccgcacacttactactaactgcagcttgtgtatgtcataggttgtcagaagatagttcatgaaatattgacttgggaagcaaaatcagaagtgaaaactgaagttcttcatgatctcaaggaaattgggagtgctttgtattggatgagccttctggatattgttttggtgagcatatgtttgtacgcaacttcattagtttcttttctagtcaaaatggtgccctgccgtccttctctgtgctgttgcatgtaagcatgtgtcctagaaactaagcttatcgtagatattgaaaacaaaaacagtttagcggtatgtagagtatagtcttgcagtacacctactgagaggagttgagcatcccttggtctttgcacctaggatatgaggtagagaatccatattattacttagtcatttgtattttattgggaccttgcattatgaattatctctgaaagatttctccaggacaagtttgtgtctcctcacctcatgcagccatattaatgctttttttgtccaatctgctcactgttatgctgttcggtttataaacattataaattactggcctatgcggttttcccttacacaatggaagtcctttcaattgtggattttttttttattccagtcacatatttgttatgaagtactctcgttatcttactgacaagcatgctcatttttccagagacaaatagacactacacagttcatgcagtctgctccatggttgggattgattccaggaaatgatgggcaagtgaagcatgcatactctgataatactccatttaccactttgttaagtgctgccaccaatgcagttgcatcaagtcctgcatgcccaaatccatcttcatttcttgtcatggcaaagcaagctgaagctgccagtaagtgcagagcctatttattgaatcatattttcaaatgatagttttgtgttgaagtttttttttagataatggaactttattgaactcagccatgtgttgattttttttagtatcaaaaaagaaaaacaataagaaatttgttgtggacccgtgccctccaaaggtttggcaggaaatggctatctcaattgtatcaatggtgttatgctatctaaaccagttagtctttgcttgaatgggttgagtacgggtggcatatcatcctaattgttgttgaacactgagatttggttgaaatttctacaggtctactctacaaatcaaacctaaactctgggagtgtgcttgagtatgctcttgctttcacgagtgctgcgctggataggcattacagtaaatggagtgcaactccaaagacaggatttattgacatcaccacatcaaaggacttttatcgtgtttttagtggtcttcagtatgtaagtagacttcattatcaaatatctgttacagtatgtatatctatgtcatccatcatttacagaccttttagccaacagctggtaacaagaaatgttgggtgacaataaatagttttatggtaataaatagtttttcttcttttttttttctttagagctacttggaagagagcatcaatccttcgaggaaacaagaaatgttgggtgactctgtagcttgggctggctgtacaatcatgtatttactgggacagcagcagcattttgagcttttcgacttctcttaccaatttctcaacgtggcagaagtagaaaatgcaacagtttcactttatcaatattcagataggaacaaaagcccgaatttcttgcaggtgagatcatttcccgatgttctagatctgaagtaaaatgatactcataatattgtacttcatttttatttccgacattcatgatgtgcatgagtagggttacgagggtatccttgaagcgatgaggaaagccaggaggctcaataaccatgttttctccatgttgagagcacggtgccccctcgaggacaagattgcatgtgctatcaagccaagtggggcgcctcttcaccgtatgaagtttacgaacaccgtttctgcgttcgagacattgccacagagagctacttgagaggctattcggcgtgtatgtgtttccttccttcttttttttccttgtacgtgtgaggtcatatgttttatgtt

SEQ ID NO: 6253 - DNA, 10887 bp, Oryza sativa
cggctcggcccatcaccggcttgctcggcaacatctacaacgggcaggtccccttcgcgcggcccatcggcttcgcgacgcccaagaacggcgtcccgatccccaactccaatggcgccatccccacgtacaacggcaacaacggcatcccgctggacaccggcctctccggcgctggtttcctgcagccggctaagggcgcctcggcggcgcaggtgcagctcggccccgacgggctcagcctcgggttcggcaccatcaccgtcatcgacgacgtcctcacgagcgggccggacctcggcgcgcagccgctcggccgcgcgcagggcgtgtacgtggcgagcgccgccgacgggtcggcgcagatgatggcgttcacggcgatgatggagggcggcgagtacggcgacacgctcaacttcttcggggtctacaaggtgggatccaccatgtgcaagctgtccatcaccggcggcaccggcaagttcaagggcgcctgcggcttcgccgaggtgcgcccgctgatcgccaccgggcagcacgtcaccgacggcgccgagacgctgctccggatcagtgtccatctcgcctagtatagtacctggagtgctcgaccatgccataagttttgccgttggttctcacgtccttgggttgggttgctttgctttgggcgtttcatggttgcgctgtttgctccatgtgcaatgatcttacaagtgtgtgtgcgtcctctgcagggattaaactttatgaaagcagaaaaacactttagtattatggtaaatccatttgggaaagaaagttactttcatgtgcattcactgtaagttgggctccagtcattcatagcatattagcagcctcaatcacaacggtatttcacttcaacgctaagaagaaactgaattggaaatcatgatggatgtacattaacaacgagaatcttagattttatcagagaaactagcaagatgagaaactgcgtcctcaaggcgcgacaagtgtacagcaaacctgtccttcagctccgccaagtctgtttcactgagagcactccgcatgatcttgagaccgttctgtacaagcatcattccttcacaaattctatctggcatcttcctcttctttgtttccacatcattagtaactgaaacattctcaggcattccttcacaaattccatctggcatcttccttttctttgttttcacataattagtaattgaaactttctcaggctctggaactagaggaatttccaagcatgattcaaccagtttcttcagcattctcccctctgaaactagtgaacatatttgctcttcagaccatttgtcatctcgcaaggctacctctttctgaaggaaggctttcaattctgacataaacccatcctcatctatgtccacccctgtgcatgtgtaggaaagggcagcatctacaggaacaaatttccagagctgtgcaaaagaagtgcgagcggcaaagtacccaaaggaacccattgcaaggtgaatgagtgcccaatgccgctccctcagcaagaaatggaacagatcccacattgcagaacaaagtgggtttgcatcgtcttcagtagtgttcaagtgaccaagaattgccataaatgaagccattgatggtttgcactgagagattgctgtatttgaattatcaaaactggacatgaacagagtgtgcaactccaaagttaacttctccaactcactgaacgcacaaagatgcctcatgtgcgtaataataaccaatatggaactgatgtgcttgacaaggaggttcttactgctatcaggtgaagttctataaagattaatgagagaggtggcaatcttgaacatagtagcaatacttttttcatcaatggtaacgtcctttatttcgctgcataaaatattgtgtacaaaagaattgtttctttggttccaaaaataaaagcagcattttagcatcagactgaataatagtaagagacaagggacttaccaactctggaaagcagaggctagagcatgtacaggaaaccctattatgcccgaactagaagaagttggcaagttgatttctccatgattcttgaagtagttctgattctgtagatacccagcaaaagaagtgaacagtgtcttcacagcatgttcctttacaccacgagataatgaatcaaaaggaaatccttccatcaacagtgctaagtacaagatcgatgacttggaagagctatcattcagcatggtataaatttgatcaattgttgcagacgatgcatagctcaagatgttacatgatgcacgagcaagcttcctcagagcactgagaggtgcaagaacttcctctggtgacgctagagtctttaacagaagaaatagctgattgattaaataggttgaagtttcagcttcagcataatgcatgaagaaacaccatagctctgttagaatttccaagcaaaggaaatggggatggaaaaggttctcaagtaagaagacttcaaactcactccaagcagcacttgaagaagaagcagcaatcataaaagtcttcaaggcttgtataagagaagtatatacaggttgccagacaaccttaggagaatcatcatcactacttagtgcaggaatttggcagccaagtacatatgagtagacatcttccaacgttaaaatattaagaaacagatgtagcttcttacataattcaatgaccacctcttccctcaaccatggggaagcattgaggaagtgcaagaacacagtaaattcagctggtaaaagtgccctgtttatattatcaacatcagaatccacagaaaaaatgcaacccaatgtagcgaaattcattgtatgatcaacttctccggtgtactctgaattaccggttcgtactttttccaaaaagtactgcacgagctggcatttagactctggacttacttgtgatgacttcataagtgtgtctaacagaagaaaggaactaggctccaataactgaaaaagtaattcacttgctgctttcaactggggatctctgcagaacagaatacttgagtgtgaaatcagcagtgcacaccggattatgctcttgtatatagccattgtttcagatggatatatagaacaaatcctagcggcgttcgttaggaaatatttgattggtaagaaagcccttctagcttcagcggtaccaaggacttcttgtaatggtacacaccatctctcagtagcaaccctcagagattcaatggcaactgagataggaattaaaataatctctcttacattcaccttttcttctaccatccctttaccaagctgcagtaaggaaattatgcccttccatgatatattcagtaaaatcacctggcttccaccactggatgctgcatgggttcctattttacacaaggactgaatagtgcatgctgtaatctgggcaatgttgctagtaagatctgtctctttgtgttcctcagttgtctcttctttaggcatgctcattatgcactggtctgattttgcagcctcggagtacactctgcacagtttgatggtttcatctagaaaaacaggtgcagccttagcaacatgtcctgtagttccgagtttctgtcaacagagagcatagacaatgactccatttctacaatattagcatttcaatgatttgaaaagagcactaccatctcatatgatcaaagttggataaaaaaacataaattttagcctgacgaatctatgtattagtcaagggtaggaagcacttccaattaaaggatgaatttccaatattctcacagaaaacatctctttaggagtaaacaaaacttgtaagtaatttgaaacagataaggtctattgttattgtaatgtcatggaggtaacatatttactctagttggccattatttgctatttcccctttagatttttgttgctaagttactttcaggagatgaaggatatatatatgcaagatagcatataaaactatcttataggacataaatcaagcaacatgatcataaaaaaaaaggagagaaatatagatttcggtcatgcaagttaaaccacctgatacgaccattgtgtaatataggaactgaaccgttaccttgtcaagtattgagctttcagtcagggttagtaactccaaaataaagtcgccaacagcatgcacagtatcttcggcaatgcatttagatgcaacagggaggtgcttggaagagatatttaaggtcagtgcaattatctgcagtcaaataagttgaacttgtattggaacattctagatagaatcacagttacagaaaggaataaatgatgtaatgaatctccagaatgtagaacaattaagtataaactaatatgagctggtgaaaaaaatgtagtgattgagagtagtactgttcacttgcataggtctgcattgaaaaaaaatgtagtgattgagagtaatgtacaaatgttctttctgttattactgataactacatgtattgcaatgaaatacaaacagatcttttttaagagagagagagagagagagagagagagagagagagagagactcaaagcccttgacctcaggaaataatctggagtgttcttcctcttgggcatcttcagattcatcaatagattcaacagaccacaggagatgcctcacacaccacgaaccagcctggcataggtgcaccaaaaaacaagcaaatgttttgattggttgagccagaaagcagataggcaggcaaggtaggtacagctggcacttatgatgaagcaagactccatttggaatggcaacaagtacctttgaaccaagagtaagaaatggccccaagcaattggttgtatctaattctgagcatttaagagcaacctgcagaattgacttgtgtagcatgcagtgtgatacaccggaacatgtggaatcatcccacgatgcctaagatgttgtcaaggtaccataagaaaactccttactagaaaacactgacaacgtccactaagaaacaatgaatcagtgagtccatccgactggctacatatatcatcgtgtttctggatatatcaagtataccgagataaagcaataaaggatacgatcagactttcaaccactaggcccagatcatctgcacacaactgaaaaggatcctcgagttggttgataagggaaattctgttctccaaaacctgctattatatacagatcatgttgttattaatgcctggaagagtatggattaactagagcgcgcacaaatccccaaaccccaacggccaacacctacagaagttcgcggagattcatcttaaatcccacccagaaacatccattcccccatccccaccccccaaatctacatccattccactcgaccgaactctctattcgtggaaaccaatcacggccgcagcactcgaacaatgtatcaagctaaaccctagaagtggcctaacggagcaaatggggacgaggagccgcacgagcacgcacctcggaggacttgatggcttccacgagggacccgagctcgctcctcctcctcctctcctccgcctcctcgccggcggcgccgccgtcagcctccatttccctcccccgtctcggccgtgcacctcggctttcccgcctcctcccacccctctgcgcttcgtggaggccaatgtccaatcagctggagatccaggccgagatcatttgtggccgtccatgggctgaatcggcccattccgctccactttagccggttcaaacggtttgtcgcgactctcgttggaaacagttattcgcttggttgacttttgaacagtactacttctgatcatttatctcattgaaaactagtacagtagtaattgtcatacttaagttacttagcaaaaaaaccaaataaacgataattatatactcctattctttaataataggaaaggccaaccgatgaagcccttagttgtcatctactgtaaaaaaaaatgtgaaagtcatatattagtttacttaaatgccgtgggaatggctgaagattagcgtgccacctcagccgtcttttgcaaaataaaccccatgcttttgattaattacgtgccggtccttgctatgtccaccgtccgatcttgagataggctcgatctggccgtcacgttccccctttggcggcccttccacacccgtgggatcgttggatctctaacagacggtgtggatttcgccaacacgtccaaaccctagccgcccgtcctctcctcccccatgcgtgccgtctcgcccttctccccccatcgcgccgcatcctcaccctcctccttcctcgcgtgcgtcgtcgccgccgcaactccctcctcctccactccctcaacccctccactccctcaaccatctcgccgtgccgccatcgccgcctccactccctcaacaagccatctcgccgtaacgccatcgccgctccctccccgccagatctcccagtgaggagactagggccgccggatccggtgatcccattctccttgccggcggatccggcgccctagagaggaacgagagccgccgccctttctcctctttcatccctgccacgccactgcctcccaagccctctccaaccatttgattcatcggccttggcctccccctccagtggatccggtcgccagccggacggagtcagcaggccgccgccacaccctcttctcctctccctctccatgagcacctcgctcagtgccatgagaagggaagggagagcgtaggctcagccacgaccgcgacgaaggcaaccgcggctcggcgacgatggttgcctgcctgcctggtcgttcgttctctctcttttcctttgttgttttacctcagtgacatgagaaggaaggaagtgattggacattagttcttgatgattacagctttgatttgcttctaacgtgtgaggcttgatttagttacagtgtgtatgttatgtagaaaaatttccctctgcatgtacctcaacactgtcatgtgtgatcaaacttttttagcttgaagcaatgcacactgctactaaaatttctatatgctatgattattatttattcagtcaggaattgcatatacagctatggggggcaaaacgataatgttgataggtttatttgttcccatttgtgctgcagggtgtattttcatattcagatagttttggaagctacaagtacacatggcttacctcttgaatgtacatcaaaagagtttttcatatgctgctgtactgtgttcctcattttcagtgatgaatgctatatgctcgaagcacattcattacaggtatgctccacaccaatttccatatggtttatttttgttcatctactatatttcctaaaatttccatgcataaatatttatgttagctcgaaagaaatctgtaccgttatttgccattacctttgtacagttctttcattctgtaatcttatcttctcgagtggtattgatgtgttgtttgcatctgcttgaagtgcatacactgcatgcatgcttcagcttcacatcaatgttcatgtatgatcatctaatatatggtagcagcatttaactcagtgaagtctttcattctgtccaccatttttgctgctcaggttttttgttccaactatataaatgcctagatggtgaaaggaatttctctgtacaaaagagaatgctcatttatttaagtagtaaggcatcatattcttttagattttatagaatatcttagcaaaatttagagatattagagccaatccttcatgccatatttctgtacaaaacacgaagggtgactgatatcattcctttgagtgatgaaaagaaagatgataccatttttgagtgatgaaaacattatcagtctctagaatgacctttatttattcatgcttcatgacatgcctctattttcttttttattaggtcgcaaaaagaaatggatatggattgggtccatcatggaaacagacacaaatttcttttgaaggtacatttcaatttagtttgtgcatcaactggttcaatgggaatgttttcctagacatgtcctaaccgttgcgatccaatggtaaagcaatatcataagtcaatctttttaatattctgtctttcagttggtttgcttttacatgtctatgctcagagagagattatttcactatttagttcaccggtcttttttacatgttttttttcattaattgtgaaaccacacttttaaatcctaaaagttgtggagccgatctgtttcgtcaaactatagtgtaacatgctgcttctgtgctctacaaagctcattgtttccacattttatattacgccagctacttacaaaagggccagagaagaaaaaaatgggacctacctgaagaagtatgcaatgtagaactataaggcttatgttattgcatccatactttggttaagtgatcatgcatgctttcgctcgtaaactttgccatgtggtagtagcactttgtactacctctgcttcgaaaatagatagaacttctggtagaaaaattggtttcatgtgttagaactgtgatgccaggctgaaaatattatctctctatatataaatggttgatactatactattttagctgtactaacgttattaaaactttctattacctttgtcccaaaatgtaataacttctggccctatatcttgaaaggaatgtttaggtacacagctcaaaattgcaatatattttgggacagaggtagtatactttttttcagctgtactgatgtcactaatcgcacataacggaggattgttgttgactagggcatcggcatgctacacttgaaaaaaggtcattttctatctgttcattttagctttgcatgcatttaatagaaccaccagttggcatggtcttctctttgtagcatccaatagtccagtgtgattctagcgtatagagaaaaaggggtaccatgaaacctctgtaaactcattgtaattgacatgtaatttgcctttttttttctatttattcaaacttcctatacttttgatttcctcctttagcctagacactatttttttgtgtgttccaatttttcttacaagggtcgtttataggatatagatgaaaacatgaaccaacgctataggtgaatatagatacatattattccttgaacatattggacttcaattgattcgggcggcgcggcgtagcgcgcttctattgctagatactttacttaaacgtcgtgggagtggtgaaaatttaggccgccacatcatcaatttttttcaaaaaaacccttgctcttttcgctaatagcgtgtagatccatgttaacatggctgtcggatcgcatgctagggttgatctggccgtccacgtttcccggcctgactgcccttccaccatcatcagatcgttggattaggggaacggacggcctggatttgccaagaaccctagccgcctttgccttgcgtgcgtctcacgtccaactcggccgccaggcgctcttctcgcctgcgctgcctcgccctcctctcctcacgcgcatcgccggttcgccctcctcccgccgccgccataccgtcgccgcttctctccccagtaaggccgccgcacctgctccggcgttcggtctcccgccggtggatccggccacttggagccttggaagtgagggagcaagccgtcgctaccaccctctgctgctcttcttctccgcacctccatcgcccctctccccctctcagctccgctcagtgccagatccggctcaggggccgccggatttggtaggaggaggaggtagcagcagtgcagctattgaggagaaggaaggaggagggtcgcgacatggccattactgtgatgagaacggttagggctcggttaggtcgatggctaggaacgacgacggctagcggcttggtcaggtcgacggtaaggaacaacaatggctcagtctttcctacgttttttctgcttttcattttatttttctccgggagaggcaacctgatattgttgggctatttgcgctgaaataatatgacatcttgcctggatcacctactgatacgcattggagtcacatcgaggagcccagagtaaccttccgttctgtctttaagcaataacaatcccaattgtgaatttgtgatgtctaattttatatctctaaaatcccaattggcatgtccaagatacacggacgaagcaatatctgttcatgaatgtgatttgagcaacatatataacaagtaggttgtgttcagttttttttcctcggctcatatgggaaagactagggatgattttgatttatttattttcttattggtacttaaaaaaggatcatttttacctgtttacacatgagtgcttgcagtactaatacgaatcattgccatgggttaacattgaggcgattacgccacccaatttggtgagaagatagcaggtggaggttagcagggctgggcatcccttgcttcaggtcttgctgtccattcatgctgctaggacatgtatgttggtcctatatacccttcctcagccaccatcctgcttttcttttgcatctgttatgtatgctaaattgctaatttccgcatcgcattatttgttcttagttgtagctgtcttcacttagaatgcacatgcctattttcattgcctggtttcttcgttgtctatggtaagttcaagtcggttaatgcatatgtttgtgtttcggacttttttcttagaatcaacaatgttgtttagtgacacacattattttttcccctctactcttttagtttgatatgaaacacatttctcatacactccctccgttttttaatagatgacgccg

SEQ ID NO: 6254 - DNA, 6522 bp, Oryza sativa
gtcatctattaaaaaacggaggtagtatttatttttattcttagaggtaatagtatgcacacaaactgagcaggtattcttttcaggctcttttgaagaggttaggtgtttttatgtgatctctgcaaattattgattctataatgaggttgcgtaaatatgaagtatgatattatctagattccaattacattgtgggacatagtaattctcattgctattgtaggccatagtgtattgattcctgtgcatcgcttctttctggagttcagttaccacgttggtgcttcatatgcaacagcatggaccaatttactatgccatgtcctaagaaggtttgtgcatgacaagaaggtatctaagataacactctttcgttaatgccaactgttaaacatagaaatcaaagtaatttattttgctaccatttcctttaggtggcactcacatattgttcaattgtactggggacattaggctttattactgttattgggatcaatcagatatgcgttttctgctggttttgctcatggctatgtacacaagaaattttagattataaaataaatatgatggaccaatgtttccagctactacttccggtgtacatccttttttattatgtgtcacttcagatttggtctttgttcaaacctgcctataatatcaacaagaactaaaactgaaagatttcaacaagaatcatgtacttgcaaaaccattgttcaaaatccaagatttcatccctgaagtgttcgtttaaaagttaaggcaattttctgttccggattagcctttcggcctgcatcaatggttttaaacaatctggttggattcagttgccctatgagttacttttgtagtactgatgaatctgaaaatttaccctgagttctattgggttctaagttaatccatggtgtattcattcaaagttggcatcccataccacataccgctgagataatatattgctagtttggtggaactatttcactgattatcatatgttatcacatattggttgcatatttgtgcaaatggctgaaacaattctatttttatttaatcgctttgcctttcaagctatattattgtttcagactttgtgatgaactttcttgcaagatatctaaagcttatctcaaagttgataagttatgtactaatttcagtattatgtttgcttttgtcagggctagagaatatatgcattagtgtacttgaaacaaaacagggtagagtggcccaatggcactatttgtctttccaaatcgccactatgtcagtacagataaacgaatagaggtatgatcatttgtatatggtttagatttttcaacaatattgtatcaaagtattgttttcctcatatcttggactgtagtatgtccttgcaggatgtaaatgttaactcaagttacatttcatgaacatatttggatctcttttttgtccacacgcagcgtagcgcgtgtctattgctagtagtaattagacacagagtagatatgttccaaaggtggtgagaattaggccttgtttagttgaagaaaatttttaggcttggttgtcacatcggatatacggatacacatttaaagtattaagcgtagtctaataacaaaacaaattacagataccgccaggaaatgcgagatgaatttattaagcctaattaatctatcattagcaaatgttgactgtagcaccacattatcaaatcatggcgtaattaggcttaaaagattcgtctcgtaatttacacgcaatctatgtaattggttttttttctacatttaatactctatacatgtgtttaaacattcgatatgatttcataaaaaattttattttcggaagtaaacaggccttactaatgctagatcgatctgacagaggccgttgaccattgattcattgaattaatactcctatctccaggagtgtgaatacggtgtggtgtccagcctctggatctgtcggtaagacagtaattaggagtgcactagaagcgcactaggtcagtaatagcccaaacctaaacggctagaagtattgacgagttcgtcgcatctgcattgtctaattttttttttcgagacgacacgtgttcttacataaatatatatacgctcattactataaacacacatagtaccgtataagcatattaaaagatttattgaaaccgtattgttttgatatttttgaagttgtcatagacatctcatcaacaatagccaaatgcctcgaaaaaaaaagcgccaaatgcgagcacccgtaaatgcaatgcctagattttggtaagttaactaaggctgtattcgggaggtgagatggggaactcacctcctgtgcatgcaaaatagagcgacgcattttcttatgattaattaagtatttattttttaaaaattatattaatataatttttaaagcagcttttatatagaaaattttttaaaaaaacatatcatatttagccgtttgaaaagcgtgcatgtggaacacgaggggtgtgagttgggaaactcaccgaaaataatacaacctaattactccttgaaacagcgaaccatcattttcattcggtggcggagctagacccggctaccatgggcaatggctcgggctccgcctggcaaatgcagctatgcatccatagattaacacttaattagcttgctaattacattgcttagttcactactaggccgtatgaagcaacaccacatcgacagatgtgcttaacacaaacttataaagcaaatgctcatgttaaaatgatctatgtattatatagacttgtatattttttttttgtttgctaggtttgctcgagctcataaaatattttgaatccgccactgttttaattaaatagaggagtaaaactgtacaagtgtacaaagtgaaaaaggagataatgtaatgctcaggaccttcagtccgagcttactaaaactctagacaactgccgagatgtaataccgttgcttataattcacccgtaaatgcattggctagattttggtaagttaactaattattacgagtcttagtttttgtaatacagccgcttgtaatttactgtttgtaatgcgagtacaccagtattttttttttagcaaaaccgatttcttttacttatatttgagagtttgaaccgggctcgcagatggaatcggagagacatctgccccgtacccgtacgtacgtgcgggcgtgccgcggaaaaactccccgattccgtcgaggagtcgatctcctccaccgcgccacacccacatatacaaaatctcgatcccgctcgttcaataacgcgtccgcgcacggcgacacacccgatggatcgcgagcggcggcggctgcgcggccgcggcgggaacaacaaccacccacggcgcgtcctggccgacgtcgtcatccgctgcgaccccacatggctggtgacgatcctcctgttgtcgcttctgctactggggaaggcgacggggaccacggcgacggtggtcgtctccggcagcatggagccagggatccggcggggcgacatgctcatcgtacgggagcggcgcaacgacggcgacggcgacgacaacatccgcgccggggacatcgtcctcttcagcaccgaactccaccccgtccccatcgttcatcgcgtcatcgagctccacgagcgacacgacggcggcgcgaggcagatgctaacgaaaggtgacaacaatggtgtcaccgatagaagctccctctacacggggcagtggctgcacgatcaccatattttgggaagagcagtcgggtttttgccttatcttggttggccgcgttgcttgatccaagattttgtacttgacaaactgaatttgtgacgccggtaggcaggtttagtggaagctttgagcttgtttcaccgatgattgactggcttgtgacttgtaatgcgagccatttgaagttgtcgtagtgcttgtgggtagagatatgcaagtgtaccggcccgtgaatacaattgtaggccaaaaaaagtgggtaacctgtaggttctcagtcgtggttcggcttgctgcacggttatgggcaattagaggttaataattagttgtgtttctttctataaggtgaaaccccacgcattgctgcgggaatttagtatgataacaataaaaaaacatgtaagatagctagataacatcagattaagtaaattaatatggtttataataatttaaatttaaatagtatgtagaatggtgattcaaacgtaaaaagtaaggtggtatgactttatggaagaataaaattaggaagatagtttggaccgtagattaatcatctaaatgctaaaaacaattgatgtgatatgacttatttagaggaaaaaaggagaaagataatttagaccatagattaatcatttaagcactaactaagtgagaatgaactatataagtatataggatatcataaaacataataaagatatacattgaaacattattttcaattatgtgaattatgttggatgataatttaacatgtttgtatttgaaaagctcttaaattataaaaactataaagatatagcatatttgcatgatgtttaaatgtgatgattgttagtggatgatgatgtggcatcttgttaattagtggatgatgatgtagcatctttgcatgttaagtttaaagagttagtgggggataattttatagtaagatatgatttctctgtctttttttctcttggagagaggtgaaaaggagaagtaggttgtagaaggaaaaaagatatacagtacatataaaagtttttcttacatatattttactttgtcgtttcggtaatgaatcttgattttttgaattcaattgttgagaactttataagagttctataagaattatttaagtactcataacattactcactgcagtatgtatcaccagcagaccagctctccactcatcaactctttctcaatacaagtcgtaggagtgaatgtacttaagtactagtgtcagaaaagaatgaaggactcttgaaacaaaactggaaccagaatgccattttctggctaaaagatccgaaacatccaatgggagcgcagacgaacccactgagatactggctcacgtggcacactattcatcgcaaaaactagcatgtcaaaaaatacattcgtattcagcatcaactggtgctacaatattatacactggtccgagcgcgtatgtagaactgttagtgttgacatcttaaacaaatatgaactctcattaaacaatcaatcactggtaattacactggtgcacgtctgtacaactgttgactgtgtatgtcacacttcttttgagccacaatttaaacttatttttaactcgatgacatgttaaacaaatatgaactcattaaacaatcagctagtaatttaatgtctcccatgcaggtgctaatatactgcactctctgtcaactctgcaccgaagcaagtgtgcgcaattcaccaacttggagattagtaacaatttgagcataggctctacagtctcggttagtccccccagatctccattgcagcagagtgtcgccattgcaagggtgcttggtgaagcgtcctctatagggatagtctttgggtcttcgtcttcctccaatcagttctcgagacattggtgttgctgcagtatatattctacactcgaaatgcatattagagtgggcagcacgatcagacaagtggtgagccaaagctgcttcacatttttcttccttttgatcgaattggtctctcgcttgcatttcactccatggatagacgtgcatgaggtttagtgtggtgattagttcttggatcttgaatcggcagctgatcaaatccgcgccgaaaggcggtggtcggcagcaacgccgggcgaaggggatggagaaggtcgcggttggcttgttgccgccgctgcggttcatcgccgtcctcgccgtcgtgtcgtggacgtcgttcatctactgccatttctccttgctcagcggcgggttgctgctgggccacggcggcggcgacgacggcgccgacccgtgccgggggaggtacatctacgtgcacgacctgccgcgccggttcaacgacgacatcctccgcgactgccggaagacgagagaccactggccggacatgtgcgggttcgtcagcaacgccggcctcggccggccgctcgtcgaccgggccgacggcgtgctgacgggcgaggccgggtggtacggcacgcaccagttcgcgctggacgccatcttccacaaccggatgaagcagtacgagtgcctgaccaaccaatcggcggtggctgacgcggtgttcgtcccgttctacgccggcttcgacttcgtccgctaccactggggttacgacaacgcgacgagggacgccgcgtcggtcgacctcacgcagtggctcatgcggcggccggagtggaggcgcatgggcggccgcgaccacttcctcgtcgccgggagga

SEQ ID NO: 6255 - DNA, 1807 bp, Oryza sativa
cgggcaacatcatgcggctgttccagaaggccaccttctgcctgcagccgccgggggactcctacacgcggcggtcggtgttcgactcgatggtcgccgggtgcatcccggtgttcttccacaacgcgacggcgtacctgcagtatgcgtggcacctcccccgggagcacgccaagtactcggtgttcatctccgagcacgacgtgcgcgccggcaacgtgagcatcgaggcgacgctccgggcgatccccgccgccaccgtggagcggatgcgggaggaggtgatccggctcatcccgtcggtgatctacgccgacccgaggtcgaagctggagacggtgagggacgccttcgacgtcgccgtcgaggggatcatcgacagaatcgccatgaccaggggaggctacgcgagatggtggctccggcctaaacaatctaggcaagcactagacgctcgacgacgcagactaagttaatgaattaaatgtaggatactcgatcaatttacagcatgtagaacgagttgatatcaatcatcagtttcgctagttgatactatcatatagatctttgtatacttctgtttgttccaaaattcgtttacatcaagatttgcacctgtacgccccacggccacagttgttgcagtttgcagattctgatccacggctgtacatgtacggaccgaatacgatcggttggaaaacacgtgccttagcacaataaatctcactttgtaacatacaacatatatactcgcacttcaatctgtaattccgttgagaatttcactgccagaaaagtggatcttcctctttcttagaagttgattgtaaaaaaccatccaaattaagtgttatcgtctcaataaatacttgtagcatctccaacaaaattgctatttttggctctccaaatatccatttaaccatcttgccaaaaataaatagagagatgaatttgtatttcattacaacggtctctccatatattacactctgtaaattgacaatgagtcccattttgttaggctctatgtgcttcttctccctccttccctctagatctttcctctccccacccatagtgacatggagaagcaacagcagcagccaacaggaggggcagaatggccttctctaccacctcaccggagctaggagggctagggctgtaagtgggtcagccgcgaaaccacctataggtcaaaataagcgggtttacggctaattttagcctataagtgggttttacgggttagccacttacaccctaaggagggccacctcttctgccatcgcatgatagcggggggagaaaggagggcggccatggaggtgaggtgaccggcaccggagaagaaaaggcggtcgacggacggtattggagaagggaaggtgacgacgatcctcttatggtagacggcggcgacaaaggcgaggtggccagataacaggcattgccactgccacgttgatgatccctagagattgagatagagtactaccagggaccaacttttatcttacactttgtgtacaagcacttgtactcagaaaaaaagtatatccatccctcaaaggaatgcctcttcgttttttcatgttcatacttttctttaaaaaatagtgagttaaatcaatatgtcactccacaaaagttcaaattcaacttatgcaaatagaaacaaaaataacaaatttaattataaatagaatatgcactcacatttaaatttgacatttttgtaattatatatgtcgaatttaaacttgtatgtttgtgaaatgatacatagcatgttgat

SEQ ID NO: 6256 - DNA, 1845 bp, Oryza sativa
cttcggcatcacgcagccagccgggcaggtggtgccgcctcgccggtggcgaagttgggggtcagaattcagatccccgcgcccttgacagtttccataccgaggcgtggcctctgcgcgcgcgcgaatctgagctagatcaccgcgcccttgtcgattttccatatttggcgtggacgggcgcgtgcgagatcgcgagatgcgaaaccgacgaacgagtctcgtctcgcggcggcgacccggcgcgccgcacgcgggggcaatcgactaagagagagaccaagagagttaatgccccataaattaagtctttgatccgagaaactaatcccgtgtcaactcttcaggggatgcgattaccgtgcaacccacgtgcaacatcacggttcacccccaattcaacctcgaagcaaccgccttagctacctgcttacacacttcggccagaaaaatcgatcgctacagctgaatttacgagaaacctcttgttaagattgaagtcgaaatttaggggctctttgaatcatagtaatagaaaaatggaggaatatgataaacgaaaaattatgatagaaatgtaggtagaaatcagagaagtgcaaaacatatgaaaacacatatattaccgtttgattggattgcaggagaaacacacgaattgaatgagattgatagactaagagaaaaaattcaagaggtgaactctggctaaatttcttctaaaatctatataaaattatctattccacataaatttcaaaagatatgatatgatttaatcttttgttttaaatgcttttataaaatttttttggtatgattgaaatcatccaaaatttttatatttttctccaaataaaaaaggccctcagaaagttctaaacgttgggtacagaactatacagtgcccgagacttttcgtctagggtccagagattatgcacatgtttctcaggcacacctgcatgcatttgattggtaaaccgcttctactcacaagtcacgtaaagagcaggtacaaaagagcagactacaagctagctataagcatattttgagaagataaaagagaagagagaagagtagcgggctatatatttgtagccaactacaacacacagagttcaagatgcacgtgtgtatgataggtggggccaagtctgaattgtgcattgtatgtttataggtaattattgtatgaattggctactaaattagctatagatgatttggagccagtagtcggctatattagtattaaacttgctctaaacagtttctactcctgctacaccataaacaactcacaagtcgcatctgcacagaaatttactccaactaattgacttgctcattgcatcccagttaggtcttcatcacacatgacacaggattcccatgacacatgcatggtggtttcgagatttctcattgtctgttatctgaaacctgaaggctgaaactctccacggccatggagaggaccggcgcccacggcggcaaacgcttgctgcctcgcctcctcttcctcgccgccctgtcggtcacgccgtggcttctcatcttctgcctccacttctccgtcttcgatggcgcaccgccggtcagctcgccagcggcgcgccagtcgctcgtcgccgtcgtgtccgagggcggcgaggactcgcagcgttttctcctcgagcaagaggagcagctcaggaggctcccgtccgcacgcgacgtcacgacgacgacggcggcggcggtggctggggacgcgcacgcctgcgaggggcggtacgtgtacatccacgacctgccgccgcggttcaacgacgacatcctccgcaactgccgcgagtg

SEQ ID NO: 6257 - DNA, 2727 bp, Oryza sativa
  unsure (1)..(2727): unsure at all n locations
gcgccccggtgaccccaactccatccggcaccacctcatccggcaatgcggcgcgtccagcctctgcacctgatccagtgccggaagggcgagaagaagtgcctcatcccgagcacgttcatgcgcgtgttccagggcacgcgcttctgcctgcagccgccgggcgacacgtacacgcggcggtcggcgttcgacgccatgctcgccggctgcgtgccggtgttcttccacccggcgtccgcgtacacgcagtacaagtggcacctccccgacgtgcacgaaacctactcggtgttcatcgccgaggaggacatccgcagcggcaacgtgagcgtagaggagacgctccggaggatcccgccggacgtcgcggagaagatgacggagacggtgatcagcctcgtgccgaggctgctctacgcggaccctaggtcgaagctggagacggtcaaggacgccgtggatttgacggtggaggcggtcatcgagagggtcaagaagctgaggaaggagatgcacggcgccggcgcgtcgtcgcgactctcaacggcattaggtgcaaacaccaatggaggtttccaatcgagttagaccagatgacaaaaatagttaaaagggatatgatagttaagttggagagcaaaacatgggatttgaaggagtttgatttcatgtttaagaaaacgtaatttgatttcacctcaccgtacgtaggtggccgaatgctgaagcatgcgtgtctctattggttgtgggtaggctgaaataaaattttgatccgtgcttcgtggaaatggattttcagccgagaggatgtctctcgcatgccatctaacaaatgagctttgacatcacaaattaatacgtgatatatcgcttgaagttaaaattcaacccaagtcatcgcaaaagaaataaattaaactctaaatagttcatgtacttgtgtaagttgaatttaaatattcatgtttgtaaattgatatatcaaatactaacttctctttccatttgaaaaaaaaagcgtttagaccataagaaacgagtgacacctccttttggagaaaaatactttcccagtgcttcatacacagtagcttttgtaactagtgttatacattacgaccgctaggatctctttgattcggcaagaagattgcaagggctcgggtaggctgtgcatgggaaaagacttttcatacaaaaggaaaggattaattaaagagaaccagagaattgaataggtatggaattaatcttcttcatagcttttgatttatttggtaataaaaggattaaccgaccaagaccaggaaaggaaatggtggcagctcgcgagtggtggccggcaatcgacgagatatttaactatctgccatatttagatgtggcaattaactatttgacactagacccacatgtcatagacacgtgtggatccacgtgtcattaagataggggtggcaaatagttaattgccaaatctaaaagtggcaaatagttaaatgccccgcaatctacacgccttgagccatttaggcatatctttgatgtgccgccgctcgcttgtggccattgcgctacgaggagtaggcgtagtgaaagagaataaaactccgaccttgtcgtgtaacactccaatcgttgtgtgggccgttgggctttagcttttctattcagctttgggctttaattcttctcggacttttttattttctaaaggaataagttcacttagtgaccatcaaaagtgattgaaatctaatccgtaaccctaaaccacaaaaccggatttggaggacggttttgctgacgtggcgcctatgtggcggtattgaccgggtctcctttacaagtggcgttgaggtggcatttagaatttaaaaatatatgtgggacccatttgtaagtgacacattaaaaattgtgggacccacgtgtcccttctctctctcccctccctccagttccttctccctcctcgccgctccctctccctctctcctgcggcgggcggcgagggccggagcggcggcgggcggagacggcggaggcgcgggcgtggcacggcggcctgcgactgcgagcggcggagatgcgggagtggcggcggcaggcactggacggcgggcagcttcaccgcctcctcgccgacgacgaccaggcgtttgagcaggaggacggcggtgggaggcacacgcggcaggttcgacgacgacgacgacgtcctccaccgtccagattgggtgattggctccggcgtgctggcactagcgtggagcgtggcgcagctgggttgggtggccgggccgcttgccctcgccggcttctactgcgtcacctactacacctccaccctgctcgccaacgcaaccgcgcgccgcaccccgtcaccggacaccagggnaccgcacctacatggacgccgtcagatcatacctcagtaagtactcacctcctcaacaaacgccatttttttttctttctcatctccatcttgttggttaaacctgaacgcaatgccaaaatattttcagagtcctagagaggtgttccatgttcatgtgcggaatctcccagtacgttaacctgtggggcaccatggtcggctacacaatcaccgtaaccataagcatggtgtgagtaaccgaacagatcaccccaactcccctcccaactgaacttcgccatcggtcaggctactaaatttcgtctgtttttatttcc

SEQ ID NO: 6258 - DNA, 3374 bp, Oryza sativa
  unsure (1)..(3374): unsure at all n locations
tggagctcagaccgggcgccgccgccgccactcccgcgtttccgctgctcgcagtgacatgccgccgcgccactcccatgcctacgccgcccgccaccgccgccgctccggccctcgccgcccgccgcaggagagaggaagagagagagagggagcggcgaggagggagaagaactggagggagggcagagagaagggacacgtgggtcccacaattttttttatgtgccactgacaaatggtcccacacatatttttaaactctaaatgccacctcaacgccacgtgtaaagaagacccggtcaataccgccacgtaggcgccacgtcaacaaaaccgtccttcaaaaccgccaagggagtcaaattgcaccggttttaagagtttgggtgtcgagatatccggtcttgtggtttagggttatggattagattttgatcgcttttgagggtcactaagtgtacttattccttttctaaaagaagaggccgaaacaacaaactatgggccatgatgggctgaaacctgaaagaagatctagaactccacggattgtggcccatttatctaatgttcctttgtgggtttttcttttatgacgaacttaaaaaaatgcccgtgcgttgcaacgggtgaaggctattttaatcttattatcgttatacggtttagttaatatgaaatttactgtgagaattcgcttgtatatatatttttctagaaaatcatgatctgagaattcgtttggatatatatttttctaaaaaatcatgagttgcaattaggagtctgatcatctcaagttagcatgcgagtttttttaaagagatttcttatacgactccatccatatttccaaaagcgaacgaacttaaaatcccgactcaaatacggatctatattttcaaaagcaaacaaacttaaaaaccgactcatacacggatgtcgtatcattatacgacagtaccggcaaaaaatcttcaattttaatttttatataaatagtagagataagataaagatacatgtgcatagtagcttgattgaatatttctctgattaggttttcgtatttctcttggcaaccgtgatcgatcggttgctgttcttgatcgtcttgctgcacgcgtggattttcgatatgtgggtagtaatagatctcggctttaatatcatgatttttttaaaatctttttgaaacacgtataaacagcagatcgtattggattgagtttctgataaacacagtaggaattcttctcgatacagtgtgcgtgtagagaaaaatcaacaaatcaacaatggtatgtcttgctgcttgcctcggtgcacggcgacacaactgactgctgctggttggtgttgatataggtgcgcgacagcaggttccaaaccgtgttgccgaacagatcgcatcggcaagatgacaacttcgcgatggtggttggttcgtgacaatgcactggacgaaacacaatcggccgaaggcactgatccgaacaagcaaattttggaaaatccaatgtttaaagctcatacacagtgggacaaataaatagttaaattgacagtgtgtcacgccccgaactagccccgaacggagctagcccgtgacgctccaaattaacctgttaatcgataacagtcccaggaaacagtgtcggtatcacaagaagacataatatcacggcaacagaggtctctttattacagagtaggagtacagtcatgttgggctgcggatagttcccgagctcacaactgcattacaaaagggaaagcggaagccaagacttggaccattcatcacaggcgcgacttgggaactaggtcgaaaccctaaaactcatcgtagctgacttgctcctggaagaactcctcatcagcaggatccacatcatcttcttccacaactaggggggattatttatatagagcaagggtgagtacaggagtactcagcaagccatgggaattaagtgtttaatgtagacttcaaaggaaaggctgttgtttttgcaattggttttatttaaactcctttttgaaacaactaagtgagtgcttctcaaacgacacggattagacagtgcatctcgtccggtcggagtatgtgcaatgtatcaatctttgaattgattcaaagttggcacccggccaacggctttcaaacggccacccgggcctggctgatcccatcagccgcagattttccaaacatcgaacccattccacaatagtaatttcacaagcagtagtcaaacaaaactacgctaggaatcacctcacatccgcccatgaccgtgggcacggctgttcgaatagtttaataacctctacagagggggtacactttacccacacgacattactaacccggatcacccagcccgtgcagaatggccacgtctggagactttgaggctttcatgacaaggcgcatttcgaaagccgacacaggttcaccatatgccaacgagaggggtcccagaccaacaccaggttagttcccagaccatactgtgccaggaaacccgggggttctccccagcaccaccccgttgaatccacatgtctcttggcatcatggctcccccgattagctaattactcagccaggggcgtcccattacacctatgtggtcgcacttgtcttatgttcggatgaaattccaaggaaacagtccttaagtgtaagagcgggaaaccgtactcccggtacgtcctctggtttgtggttttggaaattcatttagttcgcaagcaccgacncaggtgtcgggttttccaaatcttttgtaaaaccccaagttttacccatcgttggatattttaaatttgaagggaagtgttccaatgctcgagcccgaaggcccgtgcatcgaagcacaacagtcgacaaaggaggtctaagtgttcaataattcaaggagggtaattgcagcaattgggattgggaccagcaggctatctcacaagccgcggccgaattactcgtgttaatcctattcatgcaatatttgcggaaaagaaatacttagatttaaattataggtgtaagatgatcaaaggtgacttgccttgctcgagatcttgagctagatcctcgaaatcctcgcactgcgggtcttcaggctccgaaactacacgcgaaacgggacaactcaacaaacggcgaaaataaagcccaattattgacctctaaacgtgctattaaatagatctcgagatttgaggaattttgggagttgaacggagtcaaacggacatacggttgagaagatattgaatttctaagattattggatttttggtctaaaggaaaaaggatttaattaaacccttttgaaaagaaaagaaagagggaggggaaa

SEQ ID NO: 6259 - DNA, 898 bp, Oryza sativa
gccgacatggcgcctacgtggctgccacgtgggccggcgggaggttgaagaaggcgacggccggaacggacagcggacggcggctgcaaatggcgggacgaaccacgacgatacaggcaaaagcgagcacaccgggtggttgcacgagacgaggggagacgagccaatggctcggattcgccggagggagttcgacggcggcggattgcggcggcggcaaccggcggcgagaaaagagggaaacggcaacgacgcgactagggttcgattcctccggactagagcatctacgcggccaccgtagtccgtttctagcatcggattagacggagacactacaagagaggccggcgacgtgcgggcgctacggagcacgggcggtgatggcggcgagtacacagcgagcggcggtagcggtcggggcggcgccagctatctacggggaggctatacgagcttctaccgaaaactaaggggaagaggacgaacgaggagggagaacggggaggaggcactaccgtgcggggtgaaggggcgcaatgacgatggccgacggtgcggggcgtgatcgctccggcctcgggccggggaagaggaaggagagggtgcgcccggagtccacgtcacgcgtcctcgctcgtgccggctcctccgacacgtgcgacgacggcgaacagggcagggcgcggcaatggcgagggcgaaaacggggaagattggtttggggaggggctcgggtttatagggcggcaatgtcggtttgggagggaggaaccgacattgggcggtcaagccagcgagctggctctccgactagcggccaaaacgacgacagggaggatgacgctggcggggggaaaaagaagaaaagaaagagggaaaggagacttgactcttg

SEQ ID NO: 6260 - DNA, 6983 bp, Oryza sativa
ctgcacccccggcccatcttacctgagagaggaaaaatagacttttgtggaggaatttgatttgggaaggatttggattcgggatttgaatttgacgatagatcggggattcgagatcagggattggcacatagactgacaacaagcaaagaaacaaatttcgcaattagggtttttagaatttaaattttcccgctaggcgccacgacggaacgggcgctacacagtgattgtgttgcgaggtggatttggacacaacgacttaccaagccaccgtcaaaaacatcttcaatttttataatagtagagattagcaccagacaatgtgatgattcattgaatagaacatgaaaaaaaaatacaagactattgccttaagacagtagccaagaaaaaggaaaaaaccaccatcatcacgcgccaacaacacctacacacaacccagtagaaagctagcgttggaccgactgccactaggccaataggatagcaacatcgggactgcccaaaaaccaaaactaacaaccgggcaccaagctcaaccctatttacacctttgggattaaggggggagagggtgagagagaagaatggatcccttctcccccctacagcccgccaacatagccaacttgcataagctaggccgccactgtaagaggataacatgcatttagagagagcttactccaattaccagagaaagtttttggaaaggggcctcctagacgtctccagggagatcaacgacgatgagcaccgccgccgtcgtccgttgaggtcttagggagaactacaacaaggttttcacccgccagctataacagaaaaaagggatggctcgacaacgtcctcaagaaggaagatgatactcgaagtgccgtcgttgtcgtccggtacagtcgggctaggttttcacccactgcctgccccctatcgatccacagttatcgcttcattactccaccaccggccatcctttgtgagcacgtggacaccaccgcatcgacgtccccgccggccagcctccgcgggtcttgtgggcttatatataatcgcctaacatttctctgcatgcattcggcccaacatgtaggaactaggaaataagacgaggttcaaccgaactaggtcactgccattgcgggtcgtgccaaaatattctggaagcttctagaagctagaaccatctggtctaggattttactgggagatatagctgggctccaatcacatggtaagcccaatttaacttggaaaaagtacacgcaaggccctcaagatacaaagccgtctctcaaccacaaaaccggatatccggcatccctcaacttataaaactggtccctcggcagttttaaccccggttttgtcccacgtggcgactgactcagcgtgggacccacgtgggccccacgtatcagtatgaaatgtcatctctgtttcccctcttttctcgtctctctcttctatctcaggtgacggtggtcgcgactccggcggtgaagggcggtggccggcccggagctcggcggggcgaggcaagagagactgcgcgagctcaagacgtggttctccggaccactccacgcggagtcggcgccgggctgcgggcggagcgcggcgggcgagagcggcgatgggcgggcggcgggcaagctccaggtcgctccgtgcgagtcacgtcaccgggggcgcggcgactggtgggtgtgggcggccgccctcctccgactttgccccctactcctcgcacatcacctcctgccggaggcaggcaggcgcggactgggcggcgatgacgacgactcgccctcctcatctccccgtctcccgccggcctcctctcccacttctcccgccggtgcggtcggccggctctccccccactcccgtgctgcatccaaatcgaattgagatttgagatagtgggagagcgccatttgagttgagatggatgccgtcggcggcgggaaggtgaagaaggcgacaggcgggaggaaggccggcgggcgaggaagaaggcggtgacgcgctccgtcaaggccgggctccaattccccgtcggccgtatcgggcgctacctcaagaaaagccggccggtcgatctcctctccgccgctccttccccatcggccgcgccgaccctcttccccaccgcgtcggtcacgccgccgaccctctttcccaccgcgtcggtgacgccgccgaccctctttcccacacacgcacctcaagatattcctctctacccatcctcagcagacatggcgagaaaggagggggaagggctggatctggtagcgatggaagaagagctggatctgtattcttgggaacccgtggtgacgcttgccatatctttgctggacagagccatatcctacttgggtgaggacactagctgggcggaggggcggaacaagaacagatttggtggtttcagcagtcaaatgttttattatctccaacctgccagaggaaggtttcaagacttccgtctgcgtctgattaattggccaaagtcgtactgttgtggctatgaggaaatctggaagttcaggattgcggttgagctattggaggatttgatcgaggagatcgaacaccgccggctggaggaagatggtcgcattcctgccttgttcatgaatgctaaggcaaagatcgccttcaagtttgcgacaaatgattatttcagggaggagtgggacaggctgttccaggagttcacaaccttcaggctagaggacttgatcacggatatcgaacaccttagactggaagagagtggaaaaaagatctccaacaagaagtttgcgagatctcctgatcagtataaacaacaggctaggctatttttcctgctagagagaggtgtatcacgtttacgcgaccaattaccagcggtggtcgaacatgtggttagccaagatagggagctggttgaccttgagaaggaggagttgcatgcagagctggttggccgagatagggagaagaagcagatagtgcagtggttggtcgagcaaccagctgaaaactctgagataatttttcctttcaaaaaaaaaactctgagataatcagcgcagatcatatcaggctctctgcaattctgggtgtggccggcatgggaaaaactaggcttgccaagctagcttgccaagaccccgttgtgtcaaccactttcgattttgttgtgcgggtgcaagtgccttatgatttcacccgggagccgccgtcgccggccgcaccaccctttggccgcgcgcgccgccgcctgtgcgagagcagagagcgagaggaaggagagaaatagagaaagagagactgtgatgacgtggtctccataacatgtggggcccacgtgggtcctacgctgagtcagccgctacatgggacaaaaccggggtcaaaaccgccgaggggactattgtgaccggttttgtaagttgggggacgcggatgtccagtttgcggttgagggaggattttgtatttggctaacaagttgagggaccttgtgtgtactttttccatttaacttcgtcctatggaagacccagcttaaccttctgtccactgacggcaaccatcagggctgaacagcccaaactctgttgatgtaggcccaagtaggcctaacctggaaactctcctgtaaatgtgtacacaactactaccgtatattcagatgatcagatcctatattctccctgtttctggctcaatatagagtcgacgatcgtgtcatcagttttaaataatcgtcaataccggtctaatttataagataagctcagttaatgaagtactccagtttttccataagccataaccctaaacatttcgtttggtactccctcctacccagcccacctgtcctctctcctctgtgaatgtctcattgcagatttgcagcctcatcatcagcacagcaggcgcagaaatcaagcgtgtagcgagcgcaggccacatccaggagtatctttcagtccggatctcgaggcactgtcacaatggtaaaaccgtaaaacacgcagtggaaatttgggagtaaacagactactgtaggagcactaaacctaggcacattgctaatctgctgtttttgtcagtgtgcgtcactgtctcgacatggtaacatggtctgaaagggaaatgcactgtttctgattgaaggctttgcctggagcccatggggcacacacgatgacacgaagtcacgaacacgccggtgatcgtggacccaacaaacgtcgcgtgccgccaagtttggttcggccggccggccggccggcaagtctctcgacccggtggcaatttctttgatgctaaatctcccatttggagcgtaatgagttgacaaatggcgtcatctcccggcagttttgggtaaccggagactctcaccgcacatgccgacgacgttcgtgagacccactccctccctgttcagttcagggtacatttcctacaatgatggtgctcgactgtatcgctggagggacaggccggggaccaacggaaagtgcgtaaataatgtgtggcaaatagtaggcagtgtgcttcaacagacacaacctcctacattttttctactagtatcctcgatcaaatttacatattctcttcgtgttttttgctgtgtcatgtgcctttggtccaaccaaggagtagtactagaatccatagctggctttataacggtgttacgccatgctgatgccaaggtacaacttgtgctgttttatttgattcttgccctttgcgttgcatggaggaccaaaaacgattccatgggaaggagaactggagaaggggaagatacagtaaacaaaagcaggtgtcggcagaccagcacactgctatatagtactccagtgcaaatagttttttttaaatcccgtgtttcattctggatcatgggggtggatccggcaccgcgtgacggcaactgccgcaatagctggacagccggcgcaaccggtgcctgcgaccggcacgtcaccgcgcgcacattgccctgtctccccactttgaccgcctaccgacgatttcgccggcgagagagtgatcacgatttggctgcaggggcgtccccgtctgcccccctattcatttttctgatttctgtggttgctgccaattgaactccggtaggttacaaacgaagccacctaacaaagcgtcatcttctagtaactgaatttttctgtgaccgagtcgaagtcgaaatcgatgtgcaatgatttaacagacgagagcacaccggtgcttagatttccatattgtttagtcaactaacagccggtaggattcgagtaatttcaactaactgcatgtttgagaatttccattagagagttttgttaccattacatcgaagtcctgtttagaaagtaaaattaatgaaccagagattgtgttccaaacaggtctcgatgaatttggttacaaagaatacaggctgcaatttaagtagtctaattttaactcttaaactatgctcgaagtctatttattatgatgaaaagtaaaagataaactattttttatatctttgggttaaacgcatatatgtattaggtttcacctattttacattctgccactttttttttgctaattgctatataatcccactagtttagcatgaagatgatataatgccattctgttgtgttagatgacaccaacaccattaatttattgtgaattgactttgttaggcactatgaattataaacgcacattgctactaccttcgtcctagaatacttgattctttagaattcaaattttatcccaaaatacttgtcattatggagtactagttgtcccattaatcactttctattcaaaagttttcccattttaccctcaataaccattccacttcctatcatatattatttattaagggatattatatttttttattaaaccttaatatatactaaacaatctagaatgacgactattgtgggacgaagggagtaaaaaatatgctcctacctcagtttgagatgaggggtatttatgtcgtaatagaatgccacggaactttcaacaatttttacttttcctaatttcaaaatttaaagatacattctccaatccaaggacaccgtgacagttagctggttttcggtggtaaattgacaattacaacatgccctaatagcaaatatacaattgtttctacaattattacatataaaaatgttgagtcatatttttgtcacggaactacttttacgtcacatgtctgatacgttttacaaatgtaaaaaaaaaaaacaatggccaatggttactacagagaaccgagctactagcagtttttctcccggtgagacaggaagtaaaagaaaaaaaaaacgacccactgccaaatggttgtatcaaagcatcaacaattcaccccccgcatgtgctggtagtatgacggcgtataaaacagcacatggaaacagatgaaccacaatcatatggtaaaaaacaaaaacggaagctcaccttcccaccgccacgtcccggctccccatgcgaccgcgcctatggacgggcgccctgcccacgccactgcccccaccgtcgcacgacggccgcgtcggtcgccacgtctccatctccctccacaccacctggtttcctcttcagtttcctcctcattattcctcctcttcccccctcgccgcttacaacatccatccccaaacccgcattcaaaacaagcaaccctcctcccgaatcgaacaaggaaacagatatcgcctctaaaacccccatcgtctcgtctcgtctcgttcccctctccatcttccgcggctttccgcgcgatccaccgatccggtttccccgcgccgtgcccggagtcggcgctccattcccgcgccgggttttggggtggtgtgttgatgcggcgggattcgagccctggcctgtgagttgggcgatggctcggcggctgcggg

SEQ ID NO: 6261 - DNA, 6897 bp, Oryza sativa
ggcggacaccgccgccggcgccgcggcgagcattgcccgcgcagaacttccgctccccgaacccgagcgcgtctccgatcccgcggttcccctccctccgcctgccctcgtctcggagccgccacctaccaccgctactgtcgccaaagtggaagatgaggagaagcccacggccgtcgcccaccaggaggcggcgcccagggattacgcgttccagcgagcgctcaagaccgcggagaacaagagcgacccgtgcggcggccggtacatctacgtgcacgagctgccgccgcggttcaacgacgacatgctccgggagtgcgagaggctcagcctctggaccaatatgtgcaagttcatgagcaacgaagggcttggtccgccgttgggcaacgaggaaggggtgttctccaacaccggctggtacgcgacgaaccagtttatggtggatgtcatcttcaggaaccggatgaagcagtacgagtgcctgaccaaggactcgtccatcgctgccgcggtgtttgtgccgttctacgccgggtttgatgtggcgaggtatctttgggggcacaacatttcgacgagggatgccgcgtcgctggatttgatagattggctgaggaagaggcctgaatggaatgtgatgggcgggcgtgaccatttcttagttggcggcaggattgcgtgggatttcaggcgcttgacggacgaagagtcggattggggcaacaagctgcttttcatgccggctgcgaagaatatgtcgatgttggtggtggagtcaagcccatggaatgccaatgattttgcgataccatatcctacttacttccaccctgccaaggatgctgatgttttgctttggcaggatagaatgaggagcctggaacgaccatggttgttctcgtttgctggggctcctcgtcctgatgatcccaagtctatcagaagtcagcttattgatcaatgcaggacatcaagtgtctgtaaattgctggagtgtgatcttggggagagcaagtgccattcccctagcgcaatcatgaatatgttccagaactctttgttctgcttgcagccccaaggtgattcgtatacgagaagatctgccttcgactcgatgctggctggttgcattcctgttttctttcatcctggttcagcgtatgtccaatatacgtggcatcttccgaagaactatacacggtactctgtcttcatccctgaagatggcgtccgtaagggaaatgtcagcattgaggacaggcttaaaagtatccatccagatatggtcaagaagatgagggaagaggtcattagtctcatcccaagggtgatatatgctgatccaaggtcaaagctggagaccctgaaggatgcattcgatgtttctgtagaggcaataattaacaaggtgacacagttgagaagagatatcatcgaagatcatgaagataaagattttgttgaagagaatagctggaagtatgatctgttggaagaagggcagaggacaattgggcctcatgaatgggacccgttcttctctaagcccaaggacaagggtggagattctactaatccatctactaatgctgccaagaactcctggaaaaacgaacaaagaggtcagaactaaaatacaggtagttagatatgtgatcgaggaaaggaactagatatcctctctagagaagctccttgcaaataccttgcccatatgtcaaagatcctccaacgcagtagctctgatgatcatgtatgttcttgatgatctagcccctacaggtgtaagtggtggtagaaaagatgcttggggaaaaaaatgcacggccttcgagttgcccttataaataccatttcacactctatttttgttttgctttgctcaataatcctttgtaagtccttacgggatttataggtatatcaattttgctgttgtttctgttttgtttgctttgatctgtatgtgtatggtttagaatttgtgtatactacctttttatactcacaattagtaagcaatcaaagagatttttgtagatatgacttttttcaagcaagatataacttttgtgatcgcacatcatgcttcagaaggatgcatccttgcagatttgagatagctctactctattgtaacctaatggcaacaggacatttatttctgtttgttcagttgtgtagggctgggccgctccagttaaatgattgtggaagcctaaagttgtcctattccaatagctttaacaggctatatagttgactatacataaataacaaactccattgttagttacctccaactgaacttgcttgccaatgatgagctaaataaggtagatgctattgtctatcaaacagtgatagtttttgaatggtcttattattgattattactactccctcttttccatattgtaaggtgttttttagttgttacggaacagagggagtaattgcttctaagctttatctagcactgataagatcgagggttcttccatcatttgtcaatgacttcctcagttcctgttcatggctatgtgccaatgtatcctgccagatagattgtttgtatcttgcaagaaactcagatctggccatgtgggatcaacttttggtctaatatctgttacttcatattcagatttatctggttgggaatttagagattattggtgtcatcatggaagtgtagtagtgaattgatttaacaaaaaaaatatttattctgttagtccatttatggcagcgttggaatgaggatgtgcttacctcttctctatgcttgtggtataggttgatgaacacatcagggctctctgaagaatgaagtagaagaaattacagttctaattcaggtatattctcgcaaccctgctagctttgaaatgcaatacatattagctatctatattagcaaggcatgtagtggtgcaactgaaattttcttttaggaattgacttctgacaatatatgattagcaaactaataattttatcactatagttgtagttttctgaaatttactcatgattatattatagaatctggagagtttgtctggttcttgatgtgtcggtccatctgactatttctctcctttgtggtcctttctgatataaatgagactatgggaacattatcacgtagtaccaattagtaactggtacggttcagagtgacatttacttttgttttctgcactatggctgtcttaagttgccctcttattgaagctcatggtatctatcacaagaatctacattcatagtacaaccatccataataattgctgcaatctagtataggtataaaaatctggtgttcatctcttttgagaagaaattaggatattattgttgactaacagccggtcattagttcatcaaagctcgcaagtcagaaaggcaaggccacgttcatcgcttgtaagccaaaagcaatcatgtcctgcacgttcccacgttgctgatgaacttggcatgaaaaagcacggcattgttccgacctttggggctcggatttggggccctgcaagtaagagatggtgttatatccaagcatgggatccaatcggtggtgttatatccaagcgtacagagggttattatattggacggcgatgctttttagtcgaatctcttgttttaatcatttgcttgttgctttccaagttttgttcctactacgagtttatgcttaaagcattcatcctcaaaagctgatcttcttgtatggagtagctgtgtatataagctaatattaaactagactaactttaccataattgtcgggctagagagtaaatacatgccttgcatatgaaaaatagtcgcaacaactgtagtttgcatctgtttaaccttattatgctgttgtaatccgtatctgcacaaatcaaccgttttcagagcacttgctactatagttgcttcctggttgtcagatgtcgacttcgtttgaagcccgtatcgcgcttacaagtggagaaggaaacaaggagcccaattcccatcggggctcgggagccttgacctcgtttccgcctctcaaagttcggcctaccaaagaactggatatatcatctgccgatttttggccaatacgagcccaataggattgtctgaggccgagtttagttccaaattttttcttcaaacttctaatttttccatcacatcaaaactttcctacacacacaaacttttaacttttccgtcacatcgttctaatttcaaccaaaccttcaattttggcatgaactaaacacaccctgattcatgagctattcttcctaagttcagtagaaaattcctcgatatatcttttgagtctaaaattcgtccctaaatcgaaatatcaggtatagcacatcctttaacttatgataccgtgttaactttggtttctcagtagtatagtggttggttttggttgatgtggtgagcgggactcacgtttgccccacatgttagctgtcctctacctctcccacacgcaccgggaatggcatgtcgccagcaccgtcgtcaggacgtggccacggttgggtcattggaagtccaccgcccagaagttggcaacgtcggggcaactgcattgtctctctcttgctcgcatcacgcattccctgctgcgtcccgtacccaagccaagctccgatccatcacaatcaccagccgcagctacaaccacagtgaaacgcggatcgaaagttgtgaccgagtagggggcaggaggtgtcacttcatttgccttccaattcggtcgtcccatgcatcaattgcccccgtgcacgtgccgccccctttgtcgtctccgcccccacaagcaacctgtatagccacacgcgaaaatttcccccctcttgggtattgtggttgctatagttgttgcggtgagtgggaggaggaattggagggatcagggatgaatataaagaatggcaggggttcggagatgagggaagcgatggcgggtgcgggtgcgggtacggcgccgctggcaaggcaggggttgatatagtcgttaatgttcgacaagttctagagtacactgggagggatgggagacaggctaaggaaggattttgggtccatgaacatggacgagctgctgtggagtatctggacggtggaggagagccaagcaatggcatcggtgttggggatggggagaaggatgggagggcgcgcgacaaggatgacgaacggggcgagacgggaagaagacgactcgctgaggaagacaatgctacttgccgtggaagtttgctcctccacgccgttgaccgtgccctgtggccccttcctatcagtcggcatgggttgggggacggaatggctgagctagcttctccccgccgtccactgtcctcctcgctacatgtcgtcggcgctcgtcgtcgattgtcgtcctcctcattgctcgccgcctgctgcccctccacactgtccgcagctagccaccaccctggtgagatgggaacggaggggagggagagagataaaggtcactgacatgtggggccacatgtgttccacgctaactcagcgttgttgaccctggtcaactagtcacgtcatacaaaactagctgctatattgtcctgagacctagtaatccagttttgtaagttgaggggtaagttatacctggtattacggtgcagggatgaatatcaaactcggtgataaattgaggaccaaaagtgaacttattccttcttcctctcctggagaactaggcctcgttttgccccccacgcgagaatccggcagcaataacagtacggcctgccctgtgagctctgcacctctcctgctgcaccaaaattgggccctgttacccaccgtgattgtatcgctattatattcaattttgctatatatttgtcgataaattttcttccaaaaatttaacagatgtaattacagtacaattttagtgtaattacactgtaacttacatgtaacttgtatgtaattttcaaaaatctctccgtaacatggtatttcggtaaaatgaaggttgtgggaacaaatcctttcacataggtgtgtgctgtgatttttttcttcctcaccaaaacaaatcttgtaatagactagcaaaagtgcccgtgcgttgcaacgggaattgtaaagaccaaaaaattgaggaaaagttgagaaatatttacattatgtaattcattgaaatacaaatttcggtattttttaagtaggtaggtgtataattaaattagtttacaagtaaagtaagtgcgagaaataaaatgatatggttaaaattaattttattaaattctccatgattaattatgctatttggaattttattggaatttgcatagcttaattgctaattttcataatactaacatccttgcaatatttatttgaatataaatcttccactctcttgttgggccattttcagcccattttattatacagcccgcagccaagccggccgctttcctcccttctcctctcctccgactcaaccgcacacttgtctggcccaaaaataagtctaatttactccccctactttatctctcactgtcgcgtgggccctaaccgaaagtcgaagttaaatttttttgttggaccggtcgacctgctgcggcccatgaagcgcacgcggcccaatagtgattctgcccgacgcgggaccgagccgttcgtttagatggacggctcagatcggctcctaatccattaaaaccccggaccgaacccttatccctaaccctacctttttccccttcctcctcccaccgtaggccactctctccccaccggcgactgcgcacctcccccacctccgccatcttccccgcgccccttccccaccgccacctcgccgtgcccctcccccac

SEQ ID NO: 6262 - DNA, 1904 bp, Oryza sativa
ggccagatcgggcagcttggaggcggctgcagcccggacgcgccggcggcgggaggaccgccggcccggatggcgtggggacagccggccggacttcgcctccgccggatccgacggcggcgggggcaggaggggcggcggcccggatggggcagaggcgggagaggcagccgcccggacggcgtgggggcgacggcggcccagcgtccctgcatcgacggcggcgacggcggcaccctccccttccggcgttggcgtttttgtgcttgtgatgttcctgtgttgttgttgttgatgaaatatgatcttgtgatggtcttcttgtagtagtgttttctcttggaatttgtgatgatttccgatctgtatttggattgagattgagattttgtttttgggtttgattggatgcgggatttggagaggaggagcgcgtgaggttagagaggagagggacgaaaaactggtgtgacgaccagaaaaatacaaatatttatactagttatagatctaacgattcaaaattacgtgaaacttacatacaagttacactatagttacatgcaagttacagtgtaattacactacaattgtaatataattacatccgtcaaatttttagaagaaaattcgtcgacaaatgtatagatggtcccattgatttcctttacatcctaaaattgtaaaaaagtataaacattgtttacatcaattcgtagcccctgaacaggaccaaatgtaaatcagaactatgtaaaaaggtagcagcagattacaagaactataggtacaaaaacaaacacgtccgctaatgccaagtattcgcgtctgtcacgtcagatcctccggtgaaaaaccaacttttctactataggtaaccggagtcgggcgacgtcgtgaacaccggcttgtccttgtccacgacggtggcggccaccgtggcgctgctgctcttccgccggggcttcgcctccccgagcatggtcaccacgtcgcgcatggtgggccggtccttgggtgacttggccgtgcacagcaccgccacccgcagcaccagcagcatctcctcccgtacgtggtcgacgcggccgccgacgctggcgtcgagaagctcctccaccccggtgttgctgcgcagccgctccctgatccacccgacgatgtcctggctctcgccgtactccggctcgatcggccgccgtccggtgaggagctccatgaggacgacaccgaagctgtagatgtcactcttctgatccaccttcagcgtgtacccgtactccggcgcgatgtagccgtacgagccggcgacgacggagacggtctcgtgggcgcgcgccatgacgcgggcgaggccgaagtcggcgatcttggcgtccatgttgtcgtcgaggaggacgttgctcgacttgacgtcgcggtggatgaccggcggccggcagtcgtggtgcaggtaggcgagcccggcggcgacgcccgccgccacgttgtaccgcgacacccagtccatcagcatcttgcccttccgctggccgtgcagcgcatcccacaggctgccattgaccatgtactcgtagatcaccatcgtgtccaggttgttgctcacgtagcccagcatgcgcacgacgttccggtgccggagccgcccgaggagcttcacctcggccgcgaactcgcctcccgcctcgacgtccgtccgcccgtccaccgtggtggcctcctcggggcacccggcggcgcgccacagcttcttgacggcgaccacggcgtggtggcgtggcatgtcggcgcggtacaccacccccgtgccgcccatgccgacaatgttagcctccttgatgcacgcgagcacctcggcgctggtgaaactcaaccgctggaacgccgtgaggcgccatggccac

SEQ ID NO: 6263 - DNA, 1868 bp, Oryza sativa
atctgccctgtgaaccggttgttccggaggctcagcgaaacgagcctctggcacgacgcgaggctggccgggatcgcgccggatagccggttgttcgacaggtcgagggccgacaacgacgggcaatcggcaagctcgtccggcacgccaccggtcagctcgttgtccgccgccgcgaacgtctgcagcgcagggatggacaggatgttcgacggcagcgccgaccgcagctggttgtgcgagaggtcgatgaaggagagcgacgtcgagagcgccaggtcgtcggggatctcgccggacagctcattgccggcgagctccaggcgctgcagccgcggcagccgcccgagccccaacggcacagtgccgttgagccggttgttgtgcgccctgacgcggacaagcgtcgaacacgtcgtgagccccgcggggatcgcgcccgtgaagacattgttgaacagtatcagcttcgtcaggttgccgctgtcgcagagcccggcgggcaccggcccggacaaggcgttcgtcgacacgtccagccactgcagcggctgcgctttgccgagcgacggcggcaacgggccggtgagtgagttgttccacagctcaagcacctcgagcttggggagctcgccaatgccggccgggatgccgcccttgatcttgttgcacatcaggttaagcagctgcaggttagtgagctgcgccaactccggcgggatcgtgccggtgatcgcgttgtcggagaggtcgagcatgatgagggaggagaggttgccgagctccttcggtatctggccgccaatgttgttcttgtagaggtaaacggtgttgaggtacggcagccggccgagctccggcggaatggggccctctaagctgccgatcgccatgtcgaggtactggagcttggcgagattgccaatggcggccgggatcgcgccgctgaactcgttgtacccgatgatgagctgctccaatgacgagagctcgaacagctcagccgggagagcgccattgaggttgttgcccgagaggcccaagaacttgagcttctggagcttgccatacgtcttcgggatgccgccggagaagaagccacccctgaagtcgagcgtctcgagcgcggtggcgttgccgatgtcggccgggagcgggccggcgaagttgttcccggacgcgttgaggtgcgtcagcgaggcgcacgccccgaggccggccgggaacctgcccttgaagttgttgtcgctgacgtcgagctcgcggagcgtcgggatggacacgagcaccggcggcagctcgccgtcgaacgcgttgctctgcaggacgatcgaggtgagcccggcgaggccgaggatgtcgtccgggatggcgccgctcaggttcatggcggcgaggttgaggccggtgaccgcgccccgggcgtcgcagcgcacgcccttccatgtgcaatgtggcgcagagctccatcctttcagctcccccaatggatcgacgagagacgccttgatggccagcaacgcggcggcctcgtcaccggcattgcacacggcaatgcagctcaagagcgccaagaaggagaaggacaaggtgaagaacaagtgtctagcacttgtcatgctcggttcttctgttcctcccttgtcctctacactcctctggcccctctctctctctctcacacacactgtttctagttttgtgttttcattgccttgtttgaagcaatagagaaatggagggaaacttgtaggaaggtatataagaggatgtctatgattaggattggattaatgcattaatctatgtgtttggagacaataaaatactactttggggcatgctaatgcattggcgtgctaatgtgt

SEQ ID NO: 6264 - DNA, 4003 bp, Oryza sativa
gaaaatgctcttggaattattgagagcttcgggagacatggcccatgtggttaagagaatgtgcgaaaaggggattgatcactcgtcattggagagagaattttgtcttgctggtttaaacaacgagaattgcaatcattgtaaacacagaacatggaagttttcattggagccgattccctattttcgttgtgtcaataacatggttgtttttgcagatataatacatagttctaaagtatgggcatgaaacggaattgctgttcaattgccgacggcctgaaaggagtacacattcattctagtatatttctactctaccgtgttccgtattggtacatactaattttcagtttgttctgatcaatgttcaagtatgacagcaagcagttttttccaccattttcatcttttagaacaaattaagctttaagaaattcagttaaactcaaccatcatatatgaaagaaagaagggataacacaagtggtggtcttaatagttcagtagtctgaacaaatggaattttactaagcggacacgcacggttaacgccaagattactttagttgaatactccctccgtccaaaaaaaggcaaaccatggattttcgtgttcaactttgactgtccgtcttatatgaaaattttttataattcgtattttcattgttgttagatgataaaacatgataaatattttatgcatgacttgtctttttaattttttttcataattttttcaaataaaacggacggtcaaatattgggcacggaaatcaggttttgtcttttttttttattttaggacgtagtgagtatgtgtaagtagattttagtgaaggcaggggtagagatgcaagcgtgtcctggtgttaaacaaatgattgaccaaaaattagtatgctattcttatcttgcaggttgaatggaacttttgtcagtgatcctggtggtggagctgtagcctgtagggactgtaagattctcttccaggtttgataaatagctcccaggagtaaaaagtgatatgagaatcttctaatcttctgactcaacagtatgcttagctactgcaggatctttggcggtagtgagaacttctacaggtaaggttctaatcatctcctgaatcaactattccagtgaacaataaaccgttagcacttagcagtaatcttgtgaaacaattataagctgtactttgtcaaagcttcatgtgtacattatatgtgtaaagtctaggaaaatatatcactacaacaacactagcaagcagcaaccgaatttgcagagtccaacgagttataaatcgttgtcattttcacctgctgtgttgtcagagtccgaaggttgtgtttagtttagcgcaaagtttagattttgattgaaattagagatgatgtgactaaaaagttgtgtgtgtataacaggttgatgtgatggaaaagaactgaagtttggatccaaactttagatctaaacacagccttcattatgaaggaaaattcatggagcaagtttttttgttactttattcatagagcaaactttgtattcggggtagagaagcgcgttcacagtatacaagttgcccagacccaaaccaattatctccatcacatggaagaacctcctgttcttttgatgattagattcttgagaacgccatgctttggtttcctgttttcatgaccaggttgtcaaatttggggatcttaaccaacaggggttcgcttcaaatatttttttcattgtacgcaataatattgacctgccatctagaaaaaatactgaatctgaccattaacagaatacgtacataatcttgtacttgtaaggtttatttttggatgttttgctctgaatatggaagcagcaatgcctctgacaagggattgggagtgagttactacttactactacagtaaacgttattctgttactactacaatagtttccaagaccaaagcaagtccaagaatttcaattagcattgccctagacatgtttctttttaaaaaaagatagtgtgatatctttcctttttgtgcttggaaagcatagctatgatggcgtgattgatgttacgctttggtggtatgaatatgaagctggcatgatctgaccttatgcttgctcagctatggcattattttacctgatcgtctgttctttttctcttgagggacatcaactaggttgcacacatcaattaggatcataacaagcagtaactggagtagagcagaagcagcactgtatatcttagggcaccaaactaagcaatttcagtttataatattccatttagtattacaccaaaggttttggaaccactatagtaacaactacacaacattgagcacaagccaaacagataagcaactgcaagaacaatatgcatcagcacggtataaactataaagatacacatttctcacacaattcaccttttgctctgtcaaatatgtttggttgtcatgtagcagtggcaaatactccatcctactagtaatacttttgctctgggggacatcaggttataaacaagcactgaaaagtacaaacagcaacaggacccttgtcctcccatcaaaaagtcagcccaactgacccaactgtttctacctttatgaagtgtactatcctgcaaaaactaatcctttctctgtaggtgaattacacaacaaacaacatgatcctaacaattactcgcccaactctgaaccttcccatgttagcaatggaaacaattattggacccacctggcaggcatacatgatacggagtataccaatggattctctgcaattgcagctttccgagtaaggtaaatccagtgtgtagtagttactgaagagttatgtagcagctcattcatatgacaatctgaagtccctgctgttttcagtcatacgacacagccgttttacctcttgtaattcagttatgtaagatgcatttgtgtgctctttgtttggctcaagcagacacaaaatatgatttatgaagaggagtgagaagatagaggcaacaaggaaagtgtaagccatactagccggtggccgaaattcaatcatgcaggagaagatgcagccaccaactgcaacaaatgcaggcacccttccgttccaagttccaactcggttgaactcggccttagcttagcttagcttcgctagcccacatgcacgcacacatggccttccatcttctctcgtattatctctcctctccgttttctaattgcgacttggcgagagacagcgtggggctaagatggggggccatgtgaagtgcctccgctttgcagcttctgaaaattctctccgtgccggcagattattgagccattattaatcgtgtggcattactcatcgatcactagtggtttttttccttcctgcttgaatcatagttcaaattgcactaatttcagctaataaaatatggtcatattccttgatatctataattgaacaagggaagtttccaaagggcatcaccgtttgttatattcctacatattcctcctctatggaaatgcaatgttagctagtgaaagtaacatgccaataagaaactatgacacgataaagcaggaaaatgtcatttataagtacttatcagttaattagtattccatattgttgtatgtttatattgtcattcggtcatatagagtacgagcaatagccagataaattaaaagtcgcgaggatgcgtcgtctcttaattaatctcttaatctatcccttcattagactgcagtatatatgctggccacatgcaagcgtgttgcttttgctgattgttgttcggcaatatggctagctccaacctccgacgtacaaacacctgtagttgggtgaacatgcttgtttagttagggcgctttggtgcataaattaaactgagtattgcttgtattaatgtacagtatcaggaggagagaatatatgtttggtatggtgaaaggctggatagttcagaaacagt

SEQ ID NO: 6265 - DNA, 6562 bp, Oryza sativa
ggttggttggcgatgcgtggcccagccgccgtgcgtcccgctccacggaccaacgcttccgagcccccgatgcgcgcggccctaggcacgcgaagcgaaccgtgtcgcgcggtgatgccctcgtacgcctcgcgggccgtggtcgcctattagccgtgatgcggctgcactcctcggacgcctcgcgtcgcaggccgcattcgctggacggtcttcgctgtcggcctgcggtggaggccgcgcggccggcacatgcgaaattggcttccacggaccgcgcacggagcgggccgcatggctgtatgggctggcggagtttacacgcctcttctgccgtgcagcttgcggccatgataaaccgaggttttccccctttttttcccctagatcagacatacttgtgcagttgtgcggtgggctatggttgccaacgctgaggtgcacttcggtgagaatctgaatggattttgaggataaaaccgagctattattgaaggttttcagtaatttgttgttgtaatacaaatatttaagaaatacaatctcatacctttagattacatcatatgtcttgttcaatgactataaatgaaacaacacacttatcctttctttcttatatagttacaatcactgctcgcaaaggcatgatatggagaatgcatgagccatataatgtgatatgcacagttcttttttgtcatctattttattagcaaagctgatgagccctcgcctagtttcttttgctgttgagatccaatcccattttaataattataaatatgatttttttagtgttgacaatatcataaatctctatcaagtaaatcaatcatatacataagtatcacaacaacacgtgacggacgcaactttacaatatagatggagcggtgaatagatatgttctcgctcgacaagagcaattgaacccaacacatattgtattaatagttcattcgcataattgtctcaatctattgggtgttcacagttcacatattgttttacctatttttgatggtccatgactactataaaagggtagaggggtcttggagtcgtggggcgacacgggtcgtagctgggtcaatcgacccaccccgcctaatgggtagatctgccctttgacgtggtgcctttctctaactttagagataatggttttgttcggtagccattgctgcacaaccaaaacgctgcaccccaaatttacgacaactggatcagcaatagaaacattgtttaagttgctatagcccaaccacattaacaagcttccaaacagagccaatatagcacgttctcttcgaaaggacatagtaaatgataagtagcatatttttcccgacatagatatgacaaacaataattactccttacccgtaaacttaaaaactacaaatatccgctttaattttctaacgaattgtataactatttattccttagattcctaatagatacgcaataatgaaccaacacaaccaactccctcccataaatatttgtatgttgttttgccgtcagacttgctcacttagtacctgctattttttaaggtgaccgtacatgctgactatttgttttttgaaaaatatgacgctataaatatagttactcccgttgtccaatactttctcgtcagcaacacaatatttcgttaggaagtggattgcatgatgaatccttttgcacaattgtttggcctactattttttacaattataactaatttaaatttcaaaatgttacaaattagagattagaaaggccaaaaaaggcgaaccgtaacagcccaacaaacttcgtctatactcaatagttaagtactccagggagtattaagcagcacccaaaaaaggacaaaaacaactgcaaaaatcgagtacagttcaatcacagcaagaaactccttgtaccctgatatgtcacgaaacgcattcaccgctgcgtacaaaacaggatgcataaaaggatagaaacggcaggcggcatcatcctcattcattcagttcttgttttggccacctggggcgcgtttccactgcttaaaccttaagcaaaccctaatggaaggtgctggttaaccaaggggggcgtgtttagtgagatgctaatacatccaaatcgtccagggagacacagtgcttgctagacacaaaacttaagaaccaccccacccccacgtgaacgccatggggtaattaccatcgttaaaacctatggatttctcgcatcatcgcaagaacccagacaaaaatctcttgctttaacttgcaaaccgaagcaaaaaaccccaaacaaaaaggggtaaaagggcttgatgataaaaaggccaggggatcaaatagaggtgccaagaaaaatcgaataaaaattttccatttctttatcccccgagtcgtgacggcggcggcggcggacatggttggtgataaggacgcggcggcgctggctggagagctgaccggcgacgcgggcgccagcttgaacggcttctttgaccacacggtatgcgtctctctctctccaatccccgtgtgagaggttgggttgccgtattggctaggtaggcggctggaagttttgattttttgcgtggttcttgcagggtttggagtcggcggtggtaggggaggggcaaggggaaggggaggaggaggaggagctggagtggctttcgaacaaggacgcgttcccgtcggtggacaccatggcggcggaggtggagtcggcggcgcccggggcgccggcgcgcgcggcggtggggccgaggaccaagggtttgcggcggcgccggcgggtgactgctccgtggagcctggcgccccttctgtcgcgcccgcgtcaggcggcggcggcggcggcggacgcgggggcgccgcggcgccggtgcacccactgcgccgtggatgagacgccgcagtggcggctcgggccggacggcccccgcacgctgtgcaacgcgtgcggcgtgcggttcaagtccgggcgcctcttcccggagtaccgcccggcgaacagccccaccttctcgccgctgctgcactccaactcccaccgccgcgtcatggagatgcgcctccagagcgaggaggacgcctcggccgccagccgcgtcaacgccaaggcacgccgcgccgagcgcgcggcggcgcgcctcgccggcaaggacaagaagtgatggaacaaaaaaccgttgcctcttccccggcggaggcgaagttggacggagacgattagcgcgtgtcatctcatctccttttgcatttcttttcaatttccattttgtagaacattaggattagagagaggtttaagaacatctgccaaatcttagttcttggcaaggaaagatcgacagacatcaaagcagcctctcgtcatgctcaatttttcctgaaaccatggcaaccttggtgttgtaaacaaagcaagcggtgaaagtgctgttgctgtttttgcttattaggtccctcctattcctggtagtagcagtagcaaaggcgatcaacatacacagcgtctgaatgtctgaatgcgacgtgtgtatctatgccatcatcggccgggcaagccgctgctgcagccttgcagccgaaacaattttgacggctctagcagtctaccagttccatttcttcaggtttggctgctggtagtaatggtagtatggtagactggcagtagaacatccatatgcatatatccatctctgtgtgaggctgaggcaccggcaaggaatgaaaagggcactgtacttattacccgtcgaggcacagtggcgctgtgctggttgtcgattcgtgtcgccgggcaatgatatgttctcatttcatggggtgatgctgctgcagccgcgttgccatggcaagaagcggattaactagttcgttgcctgaacgaaaacgacggtgagagcaatcctcacatggatggcgtcgaccgggagaggcgcaggtcgcgtggtccgcgaactacaggtctacagcaacaacaactcgtggcgctgggggactagctggtgtgtgctggtgcgtagtcgtcgccgcgcagcgcacggtcggtcctgggcatttcgtcgcggtagggggcgcggcatctcaggggcgagatgagatctttatgggtggcagtggcggtacggccccggagcacgtgatggcggagagcggagaggaacactcgcggtctcgcaccggccagattgttgtttgcttgggttgggtacttgcgttgcgtaccaccagggcgcagaaaacaaatgggacaagatcgctagcatacccggatgaaggcggctacagcctaccgtatgtgagatcgcactctgcttatgattttttgtgtggcgtacttcccttttattttttatatctagcagatagttatactccattctctccaaaatatagctcttgtttcaaaagagagcactctctctaacttggaatgtaatcgtttttaggcttgtgcgtaggtattaaggccatgtttcttttagcctatgattattataatctagattattaaaccagattactgtaagctggattataataaactgacatagaataagctgtgagttgtttgtttgtctagattattggaggcatggattattgggtttgaaaggctaaagtctataatgccctcagctatctattcggttgatggtataggtgggtaatttttctcaattatgtaggggtagtgggtctttagccactcaataatctgaaaaaagctcctctagagcagcttattagattataataatctggcttatagattataataatttgctataataatctatttgtttgtttcagcttactcctaataagctagattataataattctaaactgaatcaaacagggcataagaaaagtagtaagaagaccatactatcctatatagggtctgttcggcagtcgtgactgtggctgtggcgcagccaacaacaacagtgccgcaagcatcagtgtaacgtgcgactgttgtatttgcagcgcggtcttctgaacacacccataattattcctaaggatcaattagtaatttagtatgcactgctaggaacttagtggtgccaacctatttgctgtcatcttcgcacacacgcgtgtgatgcattggcgccagaaattgaagatgcaagagctagggttaaacacattaaaaactcactaactaatcacaggagatgaacaaatcaaaatttgaagtactaggcagcaaaaccatatgcgcggtaatataaatgagaggggactacatatatatttattgacaaattttttcctaaaaatttaacagatgtaattatagtataattgtagtgtaattacactgtaacttatatgtaattacactgtaacttgcatgtaactacagtgtaacttatatgtaagtttcacataattttgaattgttagatctattacaagatttgttttggtgaggaagaaagcaaattatagcacacgcatatgtgaaagaatttgttcccacgaccaccattttatagaaataacatgttacagagagatttttaaaaattacatacaagttacactatagtcacagtgtaattacatgtaagttccagtgtaattacactaaaattgtactgtaattacatctgtcaaatttttgaggaaaattttgtcgacaaatatatagcaaaatcgaaatgagagatagtaaaaaaaaatcactactcataatggcacatcacatcaataatagttaatctatcgtcttctatttagattatgcaatgtatgagtaagaatttaattgaaggcacaaatcggttgttcaattttttcaaagaaatgaaacacaactcttaagtttactatccttacaatattcacaccagagtaatacttaatcacaaactaatattagcaaactgatccaacaaccaaactaaagtctatatataacaaaaatgaaaaaaaatacttgttatttcgttaacaaaaaatcaaagaagtaatgtttatgaacatgtcaataatcagctctctttgaaggtaaataattaatttgatgaaaaaagtttttctcaacaaagtaatagtcataaaaaaagcaatatgatcaacacaagcatagctaaaaagtttagaacaatccgtagtaccaagacgaaagatgatgacatacccatttaaatttgctaactaaatacatcaaatattgagtatccataataaactagtaaacaaagaaagcgcaatatactaaaaacacaaatatgaattacacgaaaacaaataaactcaacttttctttttccaatgaagtgaactcaaagtcaccctgaccagaccgaccctgacccatccaaggaaaccgtcggtcggtctcatcagacacgcccggtgcaccaaacacggaagaaaaacctttcctctttccacggttctccctccctccctccccgatccactcctcccactccgcccgccgcccgccgcccgccgcttgcaccaccgccaaaaaagaagaaatccatcgcccatgcaaccctccgtgcccg

SEQ ID NO: 6266 - DNA, 25963 bp, Oryza sativa
tcacattaggaaaagtaatatattgatttgtggcattccatggaataaattcttgattaatcgatcagtagatatttctcacacatattcatccaaaaaacaaactgtgaccacatctgtttgatgccagaagcatgtggaacttggttttctacactgaagccaactcctttgaggtctgaaatggaatggtattattttggcagcatgacaagcctttgaacttgctactgatttttgctttcccgccatacaaaccatatggccttggttctaaaaatattttggacgaaagagtacaagcttggcatgctgatctaatctggcttcaacagaaaatcatgacgatgtgatctaaattagtgaatcctttgcattataacagcatggataactatttcttatggaacttgagaataataataaaaaaactttactaatctttgcctcctgtttaggctgttagagtttcctcagtgtgtttcatgttcattgtacttgcttattgaattcgaagttcactttctgcactgttcctaaagagacttagataaacttgtgccctacagaaattgcttggttatgtaatggtagaacagaacggacacaaatacctctatgttgtgcttataccattttatttctctggaaactatggacattttgtgaaacaaggtgctcttctatggggcacagcactctttatccgacctaactttgaattgttggcagatctactacatgttttatcatatataccaaaggatctcaacttcatccagcataccagttatatcggttggagggagtaaggacatacgatcattctgaatttctttagttttaattcaaacttgggaattcaagttcttgactttgtatgtttgttcaggtcaagacagataagaccgattgttgttgatcctggtctatatctctcatccaggactgatatattttatgccactcaaaaacgtgaactgccaaatgcttataaactatttacaggtaaggggttaatgcgcttcagtatttattagaagatcatcccataaatcattatataatgataggggacatagaataatttgtcttatagtgctaatgatgatgcaatacccagttgatggaaaattgtgaaacgtctttatcatatgtcggtttaatggactagtttcccttttagttattgacagatggtttgaaattattagataacatatggctatccatataaatagtgtacttatactattcaattctcttactttggttgacattttattgggctcattatacttggcatcccatttgttatctgatgatttgtaaaacataggcacttctttcggtacaactccgatgacatttaactctgcctgccctgcctgaacaagagctttgcagaattctaatgtcttgctcatgaaataggctggaaaaaatatgtattgttttgaaatgaatccatttttatatagaatggcattgaattcactatacatcttgattacaccttatgttaatgtcttttttacctaactatttaattgattggaagacactgaagaagtatttaattgtacctattgttccaatgcaggttcttcatctgttatcctttctcggaaatttatcgaatactgtatcatcggtacggataatctaccaagaaccatgctaatgtactatactaacatgcccttgccacacaggaagtatttccagacagttctttgcaactcccctgagtttaacaggactgttgttaaccatgacctacactattcaaaatgggactcatcttcgaaaaaagagccccttctactgaccctggatgatgtagagaatatgactcaaagcggcgtagcatttggaacaagattttccatggacgatcctgttcttaaccacattgatgaggagattttacaccggcaacctgaagaaccagccccagggggatggtgcataggtgttggggatgctagtccatgttctgtttcaggtaacccggatgttcttagacctgggcctgcagctatgaaacttgccaagcttcttgcacaaagattgacttaccgtaacttctattcgcagcaatgtatatgggattaatggaacatgattgtatctctggaaactaccaatttgatcatctatatttaactcgtactgtggtgcttctttgtctatcctgtgtggcttagcagtcctgtcagtttgttcttggtacctatagcaagcacagattcacaataatccattttgcccaaatttcccaagtataatcacgttttccactacctcttacctatctgagctagtggctttcagttaaaaaaaattaggattaggagtccatgtataatcaacaaggtagtaatattatttgtaccttacactatttataattcacttagtttcaggcaactaagaatgaactcatacacaaattttggagataaatgaaggaatcacaaattaacaacgaacatagacacgggatataggatagatcaggcacgtgcacataattaagtagtttcagttgaccttcaggcctgcctcatcaactccagagccgcctcgacgtccgcgcagacgctgaccccgcggcggctgaggccgacgctgccggagaagacgttgaagcactcgagctccgacgtggtgcccgcgacgcgccgcagctggtcttccattcccagctcaacgaacagcgccacgtatcgcttgtccgaccgcatcatggcgacggcgagctcgatggtgtaccggcggatccgcggcaccaccatggacggccggctgtactccctcaggacctgcaccatcgtcttcgccagcgccgcgtccgtcaccctcgccgcggcgaggctcgcgcggagctcctccggctccatgaaccggagcatctgcgccgcgaggcccaggaagatgttgagcaccttgcccttctcggccatgattgtcctcagcaccttggtggcgccggcggcgactcctctcagcggaagccgccactcgtcgccggcgtaggtgcacaggttgcggaggatcctcgcggcgccgacgatgacgacggggtcgctcatcgcctcgacgagccgttcaactccgccgccgcaagccgtcatgatggcgccgcagttcctccggctgtcgagggccagcatcgccagcgcctcgccggcctccacacggaccgcgtcggccggccggtctccgaccgcctccgtcgccggcaagaacatcgccaccagctcgctcaccacgccacccgtcctgccgatcatctccctcgcctcctcgtccatggtgaggctcgtcagggtctcgatcgccagctggtgcagctcgctccaggccttcccgtcgcgctgctgcagcacatccctgacgttgctcaccgtgaacacgatgccggagagctccctccggaggagcttgccggtggtgcccgtcgtgctagccagcctcttcaccacgcggagcgactgcttcaccgccatgaggttcgtgtcggtgggcgcggccgtcgcaggtgcactggcgatgctcgagtaggagatgatcttgtcgaggagtcccttcgtcttgccgatcttgtcgcagatgtcgtggtcgtgcgccagcttgttgaggatggagaggccgaggaggttgagctcgtcgaggtcggcgtagagcagcgacgcgacggactcgatggcgccggggatgccggtgacgcggagagcattgagcttcccctcggtgagcatggagacgaccaccgcggccgaccggcggacgcccttctccgacgagttcttccagctgagcatctcgatgagccgctcggtgaccggcgccgacgtgccgatcctgcgcagcgtggcgtcggcgaagcggtcggactcggcgagcgcgacgaggacggaggcgccgagccgctgctcgtcgtaggagccggcggtgagcaggtcgtcggcgtaggacacgaggtccatgtgcaggccgtcgaagatgctgccgttgaggcagcgggagtaggaatcgtagaagaagcggcggacggccaccgcgccgcacgcgccggcgaggtggcactccttggcgacgcgctcgatcaggcggcggtgccccacccgccactgccacagcgccttctcgacgaggaacagcagcgcctcggcgagcgcgaggccgtagaagatgtcgagcgccgagctccggttggtccgcgcgtcggcgctgccgccgtagcgctggtggacgaggcggacgagcgagagcgcgacgcacgcggacgcggacagcagctgcatccagtagaacacgaggccggccgccgacgacaccggcgaccgccacgtcgcctcgtgctgccactccagctcgtggctgcggcacaggatgcgggcgccctccaccaccagcagcacggtgatgcaccagaagtcggtgcgcccgagcgtgatggcgaagccgccgagcagcaccaccgtcgcccagatgaaccccagcgtgccgagcctgctcgccgccttctcgaggacggcgagctgcagggccagcaccgtgagacgccgctccggcggcgccgcgtcgccgtcgtcgtcgtcgtcgacgcccgcgcggatgttcggcgtcattatggccttctgcggctcgaacagcgtcggcagctggtccgggatttggacgagcacgctccggctagacatgctagcgcggcgatccatctctgcgaattcgtgtgcgttttagcaagaggtcactcactgatcactgacttttgcttgctgcgtgtgctctggattggcgatcgcgcgcacggtatttataggcttggaatgcagatgcagccaagcaaagtactacggattttgtacgatgtacgggtgtgtgtgtgtgtgcacactactggatattaatcccagcaaatgggaatctgcaacgaaacgcacgttgcgaatttgtttgtttcttgtgtgcatggaagactctgtttttggggcttcagagatgggagtctgcgtgtcttctttttttcttgttaggagaagatgttgctgtgcaaggcaaattaggcaatgtaggggaagagtagctgccgccctgaggtttggacgtgaacagctagcgtcaatatagcatgtagctcaatcatggtctaatgatcaccaggctgtcctctctggtgatgcgtgatatcttgcagctcataaacttcatactcgagtcacgccgcggttgtgatcagataagagtactcatccttggtgatcaccaagcttgctgatctctgctccaacgaggtgcaattttgtcacgtgatcacgcctctgttgcgtgcttgtgttgtgaggtgtggttggttaatgtctgttgcatagccttataagttatactgctttgcaaattgagacgatgttattcaccatgcgtccttgccttgtcattcagtcaaggttattacttcttccgtttcctccgttttacattgtttcacaatgtaagattccgaatcttacattatgaaatggagggagtaataacttatgatggttcatggtttgaaatatttacaaatacccttcgaaaaagctacgaaagatgaatacattataatcaactaataactgtgatgacgttcttgtgcacccgaagtcccgaactagggacctaacccgaactccgggtatatgcgcactgcaatgaataagctatcttatttacaggattcttttcactatatacgctgatttgtataacgaagagaatactaggaaccaaaaatatatataactgtaatgcagcattgaaacatttcttttccatcccatgtataccttcccaaacccaaaggacaggtgcatcccatttaaaagactgggttgcatcacacatttttcatgtccagactatccgattcatccgtcttttaagctccagcattgaacggaaacttctggggcttgcgcagtctaaccctcaattctcggtccggactgccttttcttcccattgcccgatcgttctaatgacagggaaattttcgccacaaaccggggaagttgattactttgatctctgactagagcaaaccgttttatgttagttcattctcaaatgtggaaagtcgagaatctgatagaacagagaacatctgcgtctccacaaaaagctgcaaacacaagtttcgtttcattagagtcgagaatttgcatgaataacagaaaagaagggaagatgattagatgaaaaacacagacaatacagctctggcatccttacaaaattcgtttcattgagaaatttctatactgagacctgttcatatactaatactcttgttatgtccctccacccttctggtttcttttattttttttaaaaaaggtcagtgacctaggttttcttttagcagtgatctaggacaaggaacagaaaagagttaaaagtgcagacaatattaacatcttttgaaagctctatctcatcaacaggacctacgatgtggagaaagactggcatgcctctagaagtatactacaggtttgccatccaagggttcatgaacaacttataaatttctattaatttcgtaaaaacgtaactcaactacaaatacctttacaaatggtcggtcctttgaggggaatgaatcgataaaactgtcttttagaagcaacgaaacctgataagatagaagaaatatcattgactggatttatgctgttttcaataattaaagtgcaaaccagtgttcatattgctaaccctgtcattatttgactgtacattggtgatggtatgagatggcaggtcagaacaaagcgactccagataggatctcatgacgttcaagaactgccaagctgcctcagcctgtaatgaaatccaaactagttgtaatacatgggaaatatttcgagccatctttatccttcaataaaatctaacatgaaggatcaacaagttttacatgatcaagatctgcaaagggaaaaatccaagggaacaggcaccaaacaggattgatccctattccaaattttataaataatattactacctgaacttcattgcatttgtaaattggatgtctcttagccagggcattctcacatgaaagtctagcatgaattggactgagatcagaaacaagttctttgaatcgtggaagttgaggtaatgagcatgccttcacctgcgcattttcagtatagttgctaacagttagtggctatgaatcttttcctgcaaaaagtcataacagcagcacgtatgctttgcttgcaccagtaaaatatcacaaaatcaacatgatcagcccaggagttccatcatgcaacagtagacgtactatgtaccctggaagtataaaccttgaagccctggtctcatagactcgcacaaaacatttttgttctttgaaaatcagaatgtatacggaactagcaattcccgtttggcagagcatgcatatggaacttgtgattcctgattgggtgtagtgaaatgtcaccaagacaccaatgggtaaaatcaattccaacttactcctattgatattgttcacttaaattactccaactgacatgctgacatgttagctaggcatagagcaagaataaattattcacttttgacaaaaaaaaagcatttattcccaagatattttaaattacaggaaaaatatgatgcacttacctgatctttatctacattgattctgacaatacttgatgctttcatcttaatatcagggggtttatgttggacaccagcctgtaggagagaacacgtccatcagctaatatgcacaaacaatcagaacatggtgaagatcggtaacatgcacaaattggcaattgcggtcagtgatgactccttgaaagagcatgaccaataagtgtgcttaaaagaacattcagaacttacaatgaaagggacgggagcatcaagaaaatccaccaattttcttggtagaacctgaaaagcagttgtttgacttcagagcagaataggaacatgagatatatgaatgagctacaaatctatcactcttttagggtattagtccaatgttcaaagcatgtatagaatctagacatcaatacatctgtttcagagaaagcaaatgcctacggtcggatgacaaatgcaaatagagaaaagacagtccaacagttaaaataccgctcttatgtacagactatttatacactacattaaaagttgcatctttcacaatttatttagttattactaagttgcacacagcatttaggagcacaatgagtccatgcgagtgcatttaaactgggtttgaaaagcccaagttttattaaaacacaaactctacaaaggccataccctcttgatactagttgtctacttcaactaccaattcatattctccaaaatcaaaagttgaaatctaaaacagaaggacaatagccacgtatattttagcatcaaaggcaatatgatattttcactaatttatagaaagttattcagttacaaagaagacggatcctgcatgattacatcataatgataaggtatgataaacatgagaaaaaaaaggagcaaaactgagccaccaaaaaaaggtagaatcagtcagatcaaagcccaggcccccatggggccactcaaacaaaactgaaattaccgatatgatattaaaaagtacataattgaacagaaacctgaaacttacaggaaagagtatgatagaacttacaggaagcaataaactctgccactggaatggtcttatcatcggcataactgacaaaacaatagctgacagtacaccctgcagttaagcatttaagggaggtgctggaatcagcaggaagcataagaggaaaccagggcacatagttacaaagctcaagctaacaagcataccagatttgagcatattaccacaatctgcttctccaacagagcagcagcaaataactctagcacctgcagtgaaaaacaattagttatttttatgcaaactgagcatagaagcttacgtagggacagacaaacagactgctatattgagtttaataatagcaacggaggactattttgccgatgtaatttaatgtgctttgcccttatagagtgaattgtgctatttctacttaggcttcgccctttctttaagaagaaaataatagcccataggaatgcttgttagcttgtggatgatgtcaaggaagaaaccctagtgtggaagacagcgggggttattcaaccatgtaataacgagaatcactgattagagttcgcctccgggcctgtaacttttttcgttcagctcacaggatgagggcctagccaacatccaattcgacagtttactgtcattgtaagctatctgtattgtttcattacctttctttcttaatgaaattggtcgaccgaatctttcggccgacccggcaaaaaatagcccataggaattaccatgcattggaataacgatctaactatgcgtcctagatagacagactttctatatatatatactcaaatacactctatatttgctacaccaccaaaccaaaatctacataagatacgtactactcaaattaaacaaacaacctaaaaacaagaggaaagacagtatggagctctcattccccgctcaccagtctacgattggctcgacttcttttgagctatgagaaatgcttaggggagcaccttctttttttctgggatctctttgtagccaaggagatctatgaagcctagcggaaagcttgataaggcctatttagtgtattttcccacccaaccactcgcaggttaatgaaggcagcagaaaaggggaaaaaataacagagatacaacttcattattatacttactactacaagcttaccctgttacaagatggctagtttaaaaatgggggaatacagcacaaaaaaatggagccacataggtaaaaacttagagcagaaagtacaacatacactttcgagagacaaagcacgacaaattgtagctgtagtccatatcgataatgcgatagcttcttctgcagccgccaaacgggcattgacctaataataaaatttcatggttagggaagctgggggcattgtgcttcaaaacaaatctctaaagaccacacattcacctcagttttttctactgaagtcaaaccattgtctgaaattgtgtctcctaaccccaataaagacaatccaggccgggagtatttaacaggttgcagatgttcaagggggtggaaaacaagttcacctccacgaggtggcagagcaagagcatggtagccacaaacaatctgcagaggttcattgttgtgtacctattttatttttttttttaaaaaaagaagtctattattagaacaagggccaacagatgccttttgtcaagcttgaacgtgtcagacaaaccttagcccatcccataactttttcatcatcaacaactatttcttgcttcatatttagttcttcttcttcatctgacccaacacctttcacagaactgtcagaaaccacggcataattaatgagtaaggtaaatagcatgaaaaaactagacataatatagtagttttacaggaaagaccacatgatttcagacatccagcagatctggtgagtgatgaccataatttgcactcgacaactgcagaatctatgttttttcttctaattatcagggttacctgtgtaaagactccatgctctgtgcacgcatgattcttctggagataggcgaatgtgtggagagaagatctggggaagtatgtccattctcataagtataacttgttcttccaaagctatcacaacgggatcccaagttctctgatatacaatcctcatattgttggaaactatgcctgccttccttctcgagttctcttatgtaactagaatctgaagtctcactagccgacatactttcaggagaattaggctcccaactcctgaacaaatatgaaggaatctctccctctgatggaagtcctgatgaagagatgagacctgatatactgttgacaggtacagcatattctgtccaatcattgtaagaaagctcatttgcggattcaaaatcctccccatttacttgactttgctctttcatagagcgggggattggttctgccagagcaatttcactagcaaactgtgttatcctgtcaagcctctcctgagcaattatgctgttcatacaaacaacaccatacactattggttagcagagaattgagggagcacagactagccattttatacataacattgttcttaggccagataaatcaaagcaatcttgaaacttagtaaagatagccaacctgtttagcatctcataatgcagctcaaaaaagggcacttttgtgagtaaacagtaacatcgtggtgcagaaaccaagaaacgacttggcttgtaggaagtagggtttagtggtgaaaccatgcctagtatacccggtgctctctgaactatttcctggacatgcagacaaacaccatatagtggtgcattatctgatacctggtgtcgtgaacaacaatcaacaataagaagggtaaatagatgattatctgaatgctaacatccaggaatattagaaaagaataaacaaactaaccttcatggagaaaataaaagacaggtcatctcgacacagatgttcctgtataaaatttgttatagttagatagtactttgaaagaaagcacattagagtcaagttagatagtaatgcaatctccacaagagtattcatatttatagtggagacatgacaactgccccctgattatccattgaccaccaaaatttagactgaattttaaaacgaattttgaacaaccatttactatatctttctacagactagcaaaacagtcgactgcaaataccaggagatttcccatatcctgctacaactagtctcacctgcccaaataccacttcattcagatcactcattgatggagtcctctctattaagcgggcctggaaatttgaaattaaaaaatcaatatatatatttacagcagaaaatacatatcccaataagaatagaaggaaaaatgaaaagaccattttttttgttggttaacactaacaatacctaacactacttagtattccaatactccacagaaaattatcgaaacaatttaactaatttttttagtccgagtcaaatgaaaagaatcaagtcctaggactataaaaagtatcagcaagtaaacaatttcagataatcatttgcttatcacaattgttagaaaatagaacagcattattatgccaaaaagaagtgtgtaccactaacactaacaagtatcattatgcattcctcaggttccggcaaagaagtacaacaaacaaaattcattttacccttaactgaatcttcctctcagacctccttttaatgaaacaaagctagataatcaacatgcaaccatagtactactaaataatttttgcagacacaagatatcaaaaccaattgatatgtttcaggaaaaaaaatcaaccgatggacaaaaatccaaaaatatagaagagatgaatcatgactccatgttcaaacacccagatgaatgatagatatcttcactcaaatttgaattacttagaaaacaacatatgccagaagtaaaatttctgtcacattagagacagttctactcaactaagaaaaccaaagggcaattcattataaatccaatatgtacagtacaaattcagcgagaaaaaaaaaactaagttagctgacctttacaccctcgggaaaacagaatgacggcaaatcaatttccctaatttccgctttctttccaggtggatacttgaaaagaatctgcaagtaaattgctctttgatcatcttttaggtctagagaccaagtccaacagtctaaatcaggatagaatcttgggatgtgccatataaacaagatagacgttttcagagttcatgaaactagagttatgtgcacaagcagaagaattccatgttttttttttcaaagaagcacacctgtggttccatggttggtataggtccatgatattgaatttttctaagatctacaatctccgagtgttctacattagattcccaagctttcttctttgcaaatgcatcctcaatgactccaacatttgcataagaatgaagtccgactacgaaaaaatgttcaaagagtgttgttggttccttatactgcttattgtcctgcagaaaaaagaagagtaaataaccagcgtagtaacaaggggaagttcacattgaatacaaaccaaaataatgcaacagaaactaacatgggcactagcgcactgcaatacaaaaggcagatctctgtggttctaagggaagtacttttgtacttgagacatgtttgatacttgtagatcaaaatattagaggtactatggtgtgtgaatttgctctggggatcacactctcaaataataccaggttcaccgggttatgattcatgagaacatcagaatgcatcaactacttcgctacaagtatgaaaattcatattgcaccattgcggtattagcaatttgatcgttttctttaacaatatagctgttgagcaatgattccgttgttgaaatgcatacaacacatagtaagataggtggaagcattagagctcattgtctgctgctgttttctactatctgattgcgtggacctgcccatttctacttgacctcgaagactaaagctatttgattgatttagcacttttgttctcagttatcaattcaaataggttttcagtcactcctaagcaaaagttgcaaataaaatgcaagaatatcataagcaggattgagtgaaacaggagagttttatacccgtgacttggattggatttgataccactgccgcttctgatgcgccatagcttcaaagttcactgtcgtacgcagcagctgctccctggggctcctctcgccgccgcctccacttccaattggcccccatttccacgcccgctgcatctgctgccggaaacgctggaagctgccggtgcgcacgtgccgcgcctgatgcttgatctgtgacagcggcgacgacgacgaggtcgacgtgcccgatagaaccggcgacgacggcgccgaagagatcctcgacttcgtctcctccctcgctggcgatccttcccccaactgcgcggccatggaattctcctgctcctccgcccccctcgcacgctgctccgatcgcaaaaccgacggcgacgcggcgcttcccgtatccacacttcccgactcctctcgcggttcagaaaccgacggcgactcatccccgccgtaggcctccacttcccctgcgcccgcggccgccggctcgtcgccggccagcgtcctcgacgctgatggcgaagaggactcggtggtggcctcgccgtctggccgcgccactgccaccggcgactccgtggcagtcgacgacccctccactgcatcctcaaacatccccgccccccgcggcgacacctccggctgccccggcggctccggctccggcgccggcgaggcggtctcgccggagagttccatgcacgcacgagaccggagcaagtgggaattggaattcgtaggcttcgccttgtgttgtggatgaaatattaatgccaaattgccaagaatcaaacccaacggaaggggaagagaagaggacgagatcgtagagagaataataataataaatgataaatacagaacaaaaattaaataataaaaaataaaagtcgatatctcgatagagaaaaaactgaaaataaaaaattggagcccgacggaaaggctactgccaaacggcggcacgtcagcacgtggtcagcggggcaggcacatgggacccacctggcagtaatgttctcgtaggtaggagtatatcccactgacatgcgggcccggcgcttttcagttccgcgtgtgcgtttgcttggccttttcccggggatgggaagtgtgaattcgtcggtcataagtaaataatcgctttctatgggctttttcgcaaaaacatggactaacattccagtcctttccatttcctgtttattacaaatacgtgcttgacttgatgcatgcgcaggcgcgcagcaagggcgaaaggctcagtatattggaaattaattgagggcgaaagtgcaaatacagggcgcatcacgtggagtataacgtctacaccaaaccaaagcgaccaatacgatacgcgtattttcagttggcccccggttggttggtgtgtaggcgcgatcgccggtcaacgtcacggcctcacgggtgggagacggaagaaggttcgagccgccgccggccagtggcaggcaaacttctcttctcttcttttcttcgcgtcggccgcccaatcgccatatggtccacggcctcgaagcagttcatggtccagcccccgcacgcgtggcagatttgcaggcagcagcaacacgtacttccttcatctcgtaaaaaataaatctattactgaatatgatatattttattataataaatttaaataaagatatatccagatttataatcctcacatctaatattatattggtttcttatgggacggagggagtatgcccatgaggccggcgtttcaacgctctctcggagtacagcaaacggcaagaggaagtaaagggccacgcctgatttgtctcatcaaggctttcagaaacttgaagagtttcagttaaaaagtaaaactgtattgacaaagcaacaggtttcagcgcaggtaaaaactagaaagattagcaaagcaagcggccggtggcatatgcctgaagaatctgttagtttgtttgttgtggactatctcggcatctcgccatgagcaactggacaatagctatgtttgtgtgatgatgtaactgaacctgaaaccagtgtgccgctcgcatcttgcttgtgtaatttttcagtggtcccaaatggatgaattgacggtaacaaagcgtaagatgagcagccacatgcatttcttttgttctaaactcagtagtaggtactaactaccacatgataattacagtatacgattctgaaaacatcatccatatgttggtacttggtactccctccgtttcacaatgtaagtcattctatcatttcccacattcatattgatgttaataaatctagacatatatatctatctagattcattaacatcaatatgaatatgaaaaatgttagaatgatttacattgtgaacggaggaagtgggaactaataaggtgaaaccaaaaaatatatatcagtcagttgcacagcaaaagttgttagtcgattgccacgacaaacgttaaccaatgcatctagtgcaacttgtgatcccctacgtgattgaaacaatcacaagtcacattgtttctgcaaggtaaatcgatccgggaaacaccgcaacacaatggttctatcttgtttctttactttctaataggtttctatttcactccacttatctatttaactgtgtcactccaattctgcatcaacccggtgatatttaacaacatatttggttcactatcactgcataaaaaattacttgttttttaactaaatttcacattggaccccattttattaccctagttgcacaatgtactatgggcctatcaaactttttacttagcaccatctaaccttgccaaaacatagtagtttggaccaaggggtagtggggtaatgcttgagttgctaccatggctatttcacccagggaggagaatgaggtaagcactgagcgcaaggggattagagccaatgggtcctagactcctagtgccttgcattgagaggtccgtggcaactgtatagccgattcgcatggctaggcaaaatcgattcagaaagcaacaagtttgatgcttacgttatggatggaggcaacaaaaattgatgattcagatagtcgtagttataagtctgtgtcagtttcgaatgtttcagtgtagccatgttctgtcgcccaccggagttgaggacgaccaccaccgccctgtgcttgctcccttctagatcaggttcccatggtaaccgcctcctcttgtgatctcaaccactcgtggcccgggccgcacaactgatggaaatgcttggaagggacatggcgggagataacagagacagaaagagggagagcaatggcgtcgtcgtgtctctgatggcctatcggacttggagaggatgagggggtggtgttgagtaaaacaaatagtaattttaagtggtccaaagtgaaaatcttggctaagacatgatccaagctataacaagggtaaaaatatatggccccaactgcaattttactcttttaattttaaaacatcgtacttatgcagtatcttagcaaaactattttcggttaatggaaaccgatatggcacttcgtcatagtaagatcattgttgctcatctctatcagtattcacaagcttcgcatctttatcaatattcacaaaccaacgagcaattcctgtcttgcactgttatattattatccatgcattggattagaaacaaggagcaaaactccctgatggttctcttaaatcaaaacattaataattacaaacaggcagatctgaactaaaaattcattcagatttaaccttgagcctcacaccgttacaaaacggagggagtagtattcacaagccgcgtagcggttccactgtttacaacgttgtgtacactacatacatcggagtactgaatcacaagaccacaaagcaaaaattggctgatggttctcttaaatcaaaactaattcaggccatagctaaataagactctgctgcatcactcagtgatgtccacttcaccactctgacctcgccggacgcatctccggtgaagacgacgccgcgcgacctgacggatatcgtcctgacctcgtcgtcgcagataatatcccctctcttcttcagcgacgggagatcgtagacacggacaacgccatcgccgcgggagacaagcagcacgggcttctcgtcggcgtcgtacgttccgtccatggaaacgacccgttcgtcttccttgtgggtgtagtgcacctcgaggtcgaggtcgtcgtgatcaggcttccactgccagaccttcacggtgccatcgtcggacgaggagagcaagaaccgctcccagcagagcaatgcggtgaccgtcgacgagtggccggcgaagctgtagatgcagcggtgggtgtcgaggtcccagaccctgatgctgccgtctgttgagccggagtagagcgcgcccttgccctgcgcgagcgacacgacggccttgtagtggccggtgagcgcggcgacctcgtcgaacgattgctgttcttggttcatcctccacatgaacacggcaccgtcctccgcgccggcgaagaggtggtcctcgtcctcggctagcatggcggtgatctgcgacgcgggccctcgcagccggagctccttgccggtccccgtgtggatcgccttgacggcgccgcgcacgccggcgaggacccacgggcccatggcgatcagcttgtgcacctccccttcttgcatctcctcgacgcggacgcactgcccggtgctgcagtcccaggcgcgcaccgtgctgtccaggctgccggagaacagcttgtccgacccttccggcagcgcgaagccggtgaccgccttggcgtgacccttgagccgcgcgacgccgcagaagccgtcgccgacgcaccacgcgccgccgccgcatcggcgcttggcaggcgtttccggcggcgcctcaacctgccgcttcgccggctgaaccggaggagccctacccttgccatccgaattcgcggcgacgcaggacgggttgacccacgtgttgctgcgcgtgttgacggcggcgatcggcggcgccggatcaggcgcgtcggtgtggaggaatcggcaggggttccggctgcacctgccggacttccagtagtggcaaaccttcggcggcgctggcggcgtgttccagcaaccaggtttgccgcggcgcggctgaggaggggcggcgggaggaaggggaaggagctgcaccgccgccatcgtcgtggttgggacttgggagagtggcggatcggcgattgatctcacaagagatggccagatgggccgtccgcttatatcggttgaacgggccagtccgactcggactcgtttagtgggctgcaccgccatagactacccaagccactcaaatagtacgattttctgactgaattgatcgggattgaatttcaaaatatccataatttgccttaattaaactaaataaacgcgtctatctaactcggcagtgaataggttacactggagatatggttagttggacacaaattttggaccgtattcatgagggcccatgcacccttgcttgttttaaatgggccggtatcagatagagctctaatctgttgtaattgtaatctaatcatattaaatccttagtttttgtaaccaagctctcgatcaaccacagcgcagctttgccctgctacagggtaacagtagctggctgcatgtgcgtcgtccgattcggtgctctcatcctatcagagccattcgttcccccatcacctcccccgttgctactctggcaccctaatccctctcatcttcccacgagccgccgccaccttggctactcgccgttttcccctcccaaaaatcctccgccgcctgctcatggtctcatggagcctgtggtcagccgccgccttcccctcgagcttgagaagccggagccgctgccttcctctcaagctcgctgaaccagccgtcgctgacgtcgtgtggagccagtggttaccgtcgctgtcttcccagcgagccagcggcagctgccgccaccttcttgcgagttcgatgtccactgtcgccgtcatttcgtctccttctccatcccacgcgagcttggttctgcaagatctgtgccgcatcgagcgcctacaagcacgcggtaaccaacaggtgaaactccacatgggtggcagcagccaaatctcctcctgctgatatgactcctcaaattgatttctcagttctctttacagtcctacatctcatgctctcttcttatcaaccttacataactggtggaaacctctacttgatttttctgtggtgcatggtcaatcaggtctgaacatatgaggttacaaatgccttacctgcattatgcttctgaaatttcactgttagaaggccatattccgttgattcagaactttttttttgatgtgcaggcctgcttggaagcacaaacgaaaggatcacatatgtatgtgagtatgtctatttgctaattactaccttttcctgcaaatacgcatacaccacttggatgtagatacccattctgcattgcttttcatgttaattaacttgattgggtaaatgtttactacattgatcggccggtatctcagagtacaatcaataagtgactgaagataattcattagccttttatgtctatatatgatcataaaaatggctgcagggtgcatcagacaagcaaaaggtatatggtaagtgatggcacatttcttagggaagggatttacgagttcaatgtcaaaatcctctctatcagtcgcctcacattttcaacttacctaggttgcttccctatttttagctacataagaactatatgtatgtcaccccatcagagttatttatattcacatgttatattctaaatccatatttgttgagatgtgttctataattgatctctatgcagagtatcctatcaaaacattaacaatgttagaccgtacttttagtgggtgttgcatgcagttattattatcaaagctatcaaaggtattttacattgttacatctccttcaccctttataggtttctatattacaaatgctcatgttattgttttaattctttttcgaccagtacaacctgattagctattcttactaattctatattacagatgctctgtgatattaattgtgatcctctttcattatacaggtatgattccttctatttacattttaaatttttttatccgatggatttgttttgcctcccttttactctacaattgataatttacatggctattgttccatacgcaggaaatgcacggacagcttgtaaagtaaacttgatgaagagtggtttcctatctccatcaaagtttgtcaaattcacttgtctgctgctgtattgtattgcttacaagctatttttcttataccatcatcccatacgcttagatgcatattgtacacccttgcctcatgtaatcatgtttgcagatatattttggtacatatatagtccagtgactctacgagcaactcaatttactactagaaaaaagatacccagtgttcttctcctttttatttaaatattttagtagctttcattttctttacaaccttacaagcaaaatgtttgatcttgatcatggtttagaaattggccgcctcttcgaaatacaaggtaaattaaccaaacattgacctactatatatgcttgcgtatgtcatatgtagatatactcattacttgaagaaatgcttgacggacatagtctacaggtattatatgcattattggttaggtactaaaaaaatgcacactgattttacttgattttagttttcccatacggccagtaatataaggtctcataggagttgttaaatattcaatcgttttgcccaaatggttcaattgagaagaacttaaagttagctattgcaggtagcctaggccaacagaaagtctgaagttgttatctccttattgtttgcagagatcacatcgcaaccaacttgagttgtatgttacctttagcttgatttggtcctgaaattgttctcacaatttaggaagcatttttactcagtgtatgcaccttaattttcttctagactactatgaagtgatgtgttcatagttgttttcttattaatcttaatatgtaaatttgctgagatgtccttcaaatatgatgacttcaaatacattgtgcatcttttattctctcagatttatattattatcccccacaatgatggcttcaaattaactgtgcaccttttactgatgttgatatatagttgtgattggcagatactctagccaacaatgagtctatcatgtgcttatgttgtatcacctctacaatttccaaaaggaaaccctccttagacacccaaagattttgagcaaatggatattttcatcagcaagccttatgtccacattcacctctttcatttggatagtagcccaagctaaaggagttaaaccaatcaactaaatgaactgcttgtgtattttaggatcatagccatcaaccttgatttctattttattttgttaatggataatttagtacatactgtaaaacatatgcaatatgagttacgtgctccgctgttgtaaaacatgtccacctgttcatgttctatttaattcttctgattaaaggttatatctaatgcccgcgcaacgcgtggggggggggggcacggctagtctggtattaaactcgttcccctcgtcccctctgccctccccactccgcgccgcggcaggcggccgcgcgcctggatccccctctccgccgcgcgaatcccttcctcttgtccgtcgcgtcgagcccaattcggcgcgccacctctcctccctccgccgccggctcagtcactctcgccataagaatcccggaaccaccgccgccgcataacctcttagccgccccaaggccgggtgttcgccggcacgccggtccaaggaaagccgtaggaatctaaccatgtcctcaacacagtccttcaagagtggcgccactcgcagcttcacaactactatgcggagaggggccaatggcgcccccctctgcttctccgggagcagggaaggaaagcggcgcgccctcagtttacccaatggcagccaaggaagaagcttgcgcttgcgcttgtgttgtgctcctcccgagtccaagtggtggacgacgccactgactcctgacgatctaatcgagccgacgggacatggccaggaggaactggaggctatatggaacgccctggtcgaagaacctctccggcccatcctgactgcctttcaggaaattaaggccactaatggcaacgtcttccgctgtcgctgcttccacgcgggcataacgtcaggtatgcatcttgcgtccctcagaaaagaaaaaaaaaactactgtgcatgtatatagcagttactgaacatgtcatgtatctgtgcaggtttattagttctcgtgattcgtatttgtcagttccacaaactggcgcctggcctttgcgtggattttgttctcggatatgtatgctacaggatgagtgttttagcagcggagctgaaaagaaatgggaaagcaaacaacatttgtgctaggatacagtttggtgagtccgaaattgtttctacacattagtgttcatagcaccaaacaatctgaaacgcgatactaactgtgaccataaattatgaactagcatccatctgtttattgggttatgggtacatggcaatgcacgtttgtattagtcaaagcgaatttactagtttagctttaactgatgaggcaaaggcaaacctttcagtgctgtcctactttgttttgagttttccatatactgagtttattttttgctggctacatgttttagtatcgcaaacagctattcgaacacactcatcttacatagttttctttgaaatgcagttattatgcttttgttgttctgggctaacaatcctattaaggtacttttttttttgctgaaaaagaagtacgcctaggctccattctttcgcatgagctcttttgatggattctttcaataattttactaaatgatccttccccccttctaataggactcttgcttctacttcacacagttgatctggtaagttcttccaatgtttcatgcatggttaacttttccttatcattatttgcgacagaaatccttttacgcatgatttatctgcattctgtaagtggaaaccattacatagtttttgcgcattgtggaaggaacttcattatctagtttgatatgttaaaaatatctagttttatacgatatttcttatttaggattgaagctctcagatacctgacacatttgtcaagttgctttagtagttgaaagttccaacaacaatgttaatgtcattttatatatattcctcatatggatctgaggattttgggagggattttacagtaaatgaactaattctggtcaaaatcctgtgttccaacggagcccttaggttatgcatcaatttatagcactctcatgttgattcgtcccttaatctaagaaaagaaaaaaaatcatcaaaggatggtagtatgcactgaaaatcactagggcatgttcggttaatccccagggagggattagaggagatatattccacacctattgtggtatgaaattattccccctcaatcccctccaaaacaaacaaggcctaattgtgtaggttggaagaacctaagattcattaaacctttggatataaaaatgggcgtaaattgtcattaaaatatttgtagcatagattatgttgacatctattatcttacaaaatcttgactggaaacgtcatttgtataggaaacaaaaggaaaataagtgaaatagtttaggggagtactgtttacccttctacttagaaaaataacataggaattaggaagtccatagttctctaatgacgcgtccgagagaaaaatagctctctattgactcacattgctttagaaattggaacatgagtaaaaacattatgtggcaagtagattgcataaaacaattgaaggcagtctgcctgcccactgcctcttatgtaagtgttcagtggctagttttcacagaattgcatgaagacctcttcgttaagcttcaaaatctgaaatgatatgtatgaatttcacttgtgtagctttggaagccagaacatgattaattcagtctaatataatgttcttattatttttttatgctgaaaagacccttgcacacattcttttacacttttattcttctcttcgatagcctttgctaatatatttgtgtatagctcgtgtggtgtgcacacgtcttctcatcttattttggcaataccgtgctatagcctataggctcaaactgtcccattttgtgaatcaaatccctatactattagattgttgatttgttgctttaacttttgagcctaaaactaactcttgtcatgtgagattaccaccaggtcaccaacatgtaaaggcgttgttaaaattgatggtctaattaaatagatgggaagtcattttctttaaaatttgtacagttttcaaggtttgctgtacaggaactcttggaaatacataaccaacataaaatcacagaactctgtatcaaaagtagccatttgtgtggaccaagctggctacaacttacagtatccagctagaaggcaaaacttgaatacaagaaggaacctttaccagatattaacatagttgttaacaaacacttcaaacccaaagtactccctccgtcccacaatataagggattttgagtttttgtttgcaccgtttggccgctcgtcttattcaattttttttttgcaaatataaaaaataaaaagttgtgcttaaagtactgtagataataaagtaagtcacaaataaaataaataataatttcaaatttttttgaataagacgagtgattaaacgttacaagcaaaaactcaaaatcccttatattatgggacggagggagtatatgacaatagtgaaacagggttaccacatatgtcgccaaagttttcgatgct

SEQ ID NO: 6267 - DNA, 2470 bp, Oryza sativa
aatttgatttttgctttctgttgtatactaatttttgctttggaacatttggtaccatgatttgtttatacgtttaaaacaattatctgttgatacaggtactttgcactccatgtgtattcctgcgctgtgttctacgaatacattggtgtaaagcatcccgcacgctacctggaagcaatgttttatacaatactaacaaccaacggtggcctgatgaaagtacttaagttcatgtttttgggacaagaatgagaaacattttccttgtctggtgatatagaattagggggatattataagttcgatgtataaatcaaattcaccatggggattgccagatgtgatctacttaatgaaaatgggattttataacgttacatgttccttcaataattcattttagcatgaccaatttgattatatgatcgtgatttcgtgagttcgtgaccagggataaaaataccaggccgccctggagccgctggctggcattctgatactggccagaataatttaaatttcaaatttgaaactgtataagtacatataaaatatttgaaaattgcgattgctatcaggtaatagactattgcagtactattttcttgattaatagtttaggtacgaacttttattcgctaaggaccggtagctgtttgcataggaacatgtacttgtttgaaacgggctcgtgaaaactcaagcagctgatccatcctatgactgcggtatttgatagtaggatgtttatgatctatctgatagtacctagtactagtaaacaatctactgtcctcgccttgccttttgtactgtaagttagatacaatgaaattccattttcggtaagcatgtacaaactggatgttactaatgttagttaaacttgcaataagcagaaaaaaaggtataaggcaagcaataaaatattctcttaaaaaaagaaggcagcgatagagaatgatggatttaagacggtatttctcccggagctgtttttaggtagaaaagttattaaatcaggttttgtcgactcaattaaggttcagtttgtctttaccctttatcaatgtcgttcattctttgtcactctttcaaatgccatgctttatactttaaacatcagcactatatacgtttccacaaagatgtgaggaaatggaaagattttaataagcaaaggcagaacacaaataaagtactaaaaaaattgtatatgaaccgtcacaaaaccgaagcaggatacatgcttcaatgtcgtcaaaactagttagaacacttatatgtatgataccgatatatatcttgcatggtggcaagcatctcttctaaactatgcaggaagatcagtcctggtgaactcagtccttgactcgctcccgacttacgccatggctgctttcccccttccaaaaggcacaatcgaagcgattgacaggcgtcgaagaagtttcctgtggactggagaagagtcctaccatggttctaaatgcctcatagcctgggatcaagtctgtcgatctaagaagcaaggaggcctaggcataaagcacttgcagacacaaaacaccgccctcctcgtaaaaatgctacacaggcttttcacccagccctccccctgggcatcctggatctcgaaagaacatcaaaactacccacttggatcaattgacctcggcccgcactggcgatccctgatcgccttactgcctcttctacgcaaacatacaaagatgttaccaggtgatggccggcatataaacttctggcatgatgtttggctggatggacagttatccgctaaattccaagctctttatacccacactgtcaaactaaactgtttgctcagctcagtccttcatgaagatttcagatgcttctttgtccccagaatcactcctactgcccaacagcaaatgatgcaacttcagtacttgctgcaaaatgtcaccctctccactgagcctgatgaaatagtgtgcaatctcaagacaaagaatggtctcatctcctcctcggagctctaccggtctgaaatggcaacatttgaaacctggccgccttggtctgcaatttggagaagtgcagcccccccaagagtaaaattttttgcttggctgatgtccaagaatagattgccaaccagagttaacctacataagaagacaatcctccctactcctacatgtgaactatgcaatgccaacctagaagacacatatcatattttcttaagatgccccatggcagcagccttctggaatatgattcaaatcatccctgagataagctcgctatcagatctccacaacctggaactctcagggcccctaccgacatttctgagttctaccttttttctcctatgttgctggcggctttggaaccatcgcaatgaagtcgtctttcagaaccttccaccttccatcagtcggctgataaattcatgcctacaagatgcaaa

SEQ ID NO: 6268 - DNA, 1646 bp, Oryza sativa
cttgacaagatgctacgttaggtcatcgaaatttgagccatatatcagtctactaatcgaatcctcaatgcaagcctgtaaaatataaaactgtattagacaaataaagggcaaaatagcctgtttggtccctgaaaattatgagtttagtccttgaggttccaatgtgcccatccaagtccctcaatatttcgttttcgttcaaaagtgtcatcaaagcaaccaaatatggtatggccaatcatacttaccacttgataacatgttgtgttgtattcagtcctgggtgacatcagacttctcagtttcactctcaggtatcttgtcttgagcttcatcatttttagcactgtaaaatagacaatgcacgggtatcattgtatgactgtcttatcccgtttcctaaaaccaaaataagttctgcaactatcaatccatatccatacctctggttactttcattcttcaatttattttccttgtcaatttccacagcagctgtttttaccacttgatagaagaaactcagcaattctccgacctacttggtggtcttcagagagtcatagagttttttgccaaccatgcaaacgatggtaataaagaaagctttaaacccagatggtttttcatccgaattactagcttcacgccatactttccagaaacagttaaggctcaggataatcccaatagcgatatagctgtacacagtatagattgcctctttctttccacttgtatcaatcataaactcaaagatagagaccttcattttctcccagcaatcagacaaagacagccatactcgcgggattttcatcgacccattgactttcttcttgtcgtcttcagtatcatcatcctgtttctcagtaagcttaatctcagaagtatcagcattgagctttgcaaacataactccagtactaggtaccttgcagtatgaaccatatttttataaggaaagatcatcatcacaactatattcacaggatatatctttgattgcaattacaattaagaggactaacaattacattcacgggctgagaggattaccaatatatcacccgacaattttttttcattaaaatcacacggatgtaactacaatactaatgtactgtaattacaatgtaactagcatgtaagtcacatcccatataataaacacctaccactgagtgagaaaggtatgtgtgcgcgatcgtgatggtcgtaggatccccgcagcgacacaattaatgtttgtagtttcttcaatctcttaacctagccgcatcgacgcgtaatgcgtgtactcatcaattctatgccaagctagatgttgctggcctcatgcgtgcgtgggaaggaaacgtgcaatccttttccagcgttcgaaaaaaaagagagaaggaaacgcatcacaaccgctaattaaatcatacaaagactaatccaagggaagcaaatccgagtgatttcgggtcaaaaatgtgtcgccagatgttcaaaatcgatatggaatcataccatcgggttgttgcgggaagagtattgggtcgtagtagcagtcttggggaactaccgcgatcggagttgggggtggagaaaaccctaccaaaaccacacaagtgcacacaagcagtaacgagatgaga

SEQ ID NO: 6269 - DNA, 9024 bp, Oryza sativa
  unsure (1)..(9024): unsure at all n locations
tctgacctcgccggacgcatctccggtgaagacgacgccgcgcgacctgatggatatcgtcttgacctcgtcgtagcagagaatatcccctctcttcttcagcgacgggagatcgtggacacggacaacgccgtcgccgcgagagaaaagaagcacgggcttctcgtcggcgtcgtacgttccgtccatggaaacgacccgttcgtctcgttcgtcttccatcgtccgcggcacggctgaggaggggcggcgggaggaaggggaaggcgctgcaccgccgccatcgtcgtggttgggagagtggcggatcggcaattgatctcacaagagatggccagatgggccgtccgcttatatcggtcgaacgggccagtccgactcggactcgtttagcgggctgcaccgccatagactacccaagccactcaaatacgattttctgactgaattgatcgggattgaatttcaaaatatccataatatgacacattgcacatctaaatacccagatggataaggttcatggcatgcttcatacagcacagatactgtagcatcgtgtatcatcaaccctgataattaacgaactatgacatttttccaatgtacaagttctatcgcaggaaaaaaaaagaagaaaatatcgacagatacggcatggatgaggatttgaggatggtacagtgactaccttcctgacatggcaggatacacataccaatcaatgctcccaggtcgtcatggatctatcaactattgatgaaatgattcttcacaaatcttgctagacatcaagcaagcccaaacatacgaaatagaaagatagaggcagatggcaacaagccaatacaaaacaaaagggtggtgatggatggtttgccgatgtttcccgcataccactacacagttccaatgactacagatattcagcctgacagtaactcattttaccaatttcaactaaggattgccatacgtcaattaattgctagtatgtgtgctggcctcaacttgctcttgaattaacagtttccggacttcagtgccttcatcagccatctcagcagggacctggccataagtattctccttcttggcacatgccccagctttaagcaagagatccacaatacccagatgttcccctctggcagcatgatggagtggctgcacggagtaattgcagaaattatacatcatgctgatagcatttagctgaaaaaatggttcatgtaatacttaaagctcaagaaactttacagtgtcgccttcagaatcaacagtgttgagcattcttgttacgcagccatcaatgttcgcagcaaaattcaaaatgtactggactatatcactaaagcctacatgaaaagtgtttattagattacacatacaaactgccaacaaaagggataaaaatagccagagcgcaatgcataataaacatccatacctccagcacaagcatcatgaagaggaattgctccttcttcatctttgcattccaagctagcttgacgttccaacagtagctgataagataaccacagttaggatacaactaatagcagagcaaaaataattcaagataacaacattaacctgaacacaaggtagatggccatataagcatgctatgtgaagcagagtatcaccatcttctattggatcatcaatgttgccagaataattatctgcatacacatatcaataggattttaacgaaagatctgcatctacaacaatcatctgtgtacaaatgcttttgctgatagcagcttccacttgcaagtaattgtccaatgagccaacagaaaaaaaaaagtgaggtaccttaagaatggaatcatttttgctatgaaatttagaaaaacgaaatagatttgccacaacacactgagatggttagcatggtgaaagcatcacacatatgtaatcattacaggattgcagcaatgtgttaagaatgccataaggacatgacttattaaagccctcactagaaaagaatggaaaatacaaagcattggcaacagtttttgaactcaattctacccaatcaatagcaaagtgcttcgtttcagtgcagcttctgtgaaaattaatgggggaaaactactactcttcaacttgataagtttcaaacacaaacagatgaatcaaccaggacagcctatgtatgcacggaagttcactgttccgaatatacaactgaagaatagagaatacatcatcagaaaaaatcaaggtaaccacaaattggtgttgaaagtgaaacaaagatttaaaaccatccaatgaaggttaataggaacatagcatgcaggtaaaaaaggaacaagataacagattcacaaactagtgttgtcccttcaaattacatgaattgcccaggacaaaatttcatgggttgggcaaagaagaaattggcattgttgtggattttcaaaagggattatgttctgctattttcaaacctgtttttttactataataagaaaagatttatgtgactaacgttatcccatcacttcctcggcacaacacgccaagctaactttacatcaaatgcagataactagacacacaacagttacaaatatcacaaaaagtgcatggtcaggtgctacttttagattcaatcaccagtttaccacgttttccaacaaaggggtactatagatttcaactaaaaaaagatataattagccttgttttttatatttcaaaagcatgtctccatctagtctagtccatatgcagactcgtattaaaataccaagtgcctgcacacagagttgtactaaaattcaagctgcttctatgtaatagtggcaatcaatttttcaagccgatactgtttttgcatcacatagggcctctgcagaaacgactcaaacccataggccagaaacatccagtacaaacttcagactaccacagttcaggttgaactactacaggagctgatccacaaacacggaagggcaaatctagaattgcgctgcataggtaaggaccaacaccaacctacccaacatgcgtacccccaatccaatcgaacgatctacataataaccctagaaaaactcgaggattgggagagagtgcacaggatttaagcctcggtaccgagcgcggcgcggagggcagcgacgttgccggactgggcggcgtcggcgaggcggaagagttcgtcaggcagttgcgcctcctcgtcgtcggagggggccatgtactcctcgccgatcccgtcgtcgtcgaaaggtcgtcgccgacgaggtcgtcgcggcggccggggactgccatctgcggcgaggaggctctccggggttaggggtttgggctcgcggcgtcgggacggcggatgaagatagtgacggcggggttgagcaagtgggggaaaacctagctggcggctgaactacttgtagtatctcgaaacgttggatggaaaatggacgttcagatcgtatggtttttctcggtgacagctaggctcaattattagcaacatttttcacaatagtaatcatttaaacacaacttttttagttgctttttatttgaacacaataaacacaaaccttaaaaataaagaaaacggttatcaaaactgtagaaaaatatggagaaatttttataagatatgtttgaatgcaacatctaaagtcaataactcccctaaccgtacaaattttctccttttttggaattttttttcagctcctcggggaaggataagcgtggttgactatttttgcaaaaagctcatcgtttttgtacaaaatattacacagatccttgaatcgactgacagcccatcatattttatccggaaacccccttgtcttctaatgaaatacaatgtgaagaagagaaaattccgattctaggggtagcgctctaaacatgaaaagtatagggtttttctgcaaaacatccatcccctacccccaatctccaaaccctcccggcctcccctccctcgtaaatataatagccatataaattttacataaaatcatatgacatattaaaaaaagtactccctctgtgccgtaaaaaacgaatctacgtacagatttgtaggactagaatatgtcacatcttatactaggttgtttttttatggtacgaagggagtgcctcaaaaccaaaggaggaacttggtatagaaaatataaaaatataaatgctaaaaaataacaattttacgatcgtgtcactatatcttgcttcgtcaagattaaagcaaagattaaaaatgagccactgcttcgtttgataatatcatgatacagaaacagtgagacaacacaacaaggattaaaaaaaaaccagtgcagaccgtgtggtggtgagagtaacaacattactatatacagttcaatggaaaacgacacatccattccatggtctttttagttgcaaattgcaggtcggccttacaagattaaagaaaaccatggcacatgacgcacttccaatacatcgcaaagaacacaagaaaattgctccacatcccatgaactgcaccatcgagctagctagctgatggttacctgcaactgcaagacaccctaccctgcaactcgcagcacttgtttaccaagcatcggcaccaactcgaacctgaatacacgcctcttcatctcttcttctcattttatttgatccggtcggtcatactgagatgcgtcaggtagacgatcaaacgcgatgagaaggtgaaattcgaggcaggcagaggattgctttcaggctgcccaatctgtatagaactgcattaacaaatggtacgatcattctagttgctcagatactcggatagcatgcctcaattctcaggctgaagattctgccagacggtacattctgctgattcttgattagtttagtttgcaggtcaaatggctttgggacatgttaagttgaagctgctttcactagtgtttttttttttggggagcaaggttggagctgcttttacgaaagacgcgcacttccggttcagagaagcaacagttgcttctctcgacaggaaaccatgcagtagaaataccaggttctgttttggccaagaaaacccgagaaggtatctcgtgtacggtgtaatgccagagagctcgacgggaacagaggatggcctcatggccgacatcatgtaccaaggtgtacgagatcattcaggtcggaacaacgcgttgcataaggataatccggtcgtcagcaaacaatgcattcaagcaggcacaggaacttgacatacagtaacgatccagcgattaatgaccagctttacttttccgcattttgaaaggcatcgacgagcagatttatgaccaaccccaagtaggggtactccgtatctgccaacaacttcggacaacaatactttcaaccatgattacactgataaaattacagcacgacactcacttcattcagttttcgcgctgcaaggaggaggcgagcgcaacatcaagcatcatcgaccacaggacggccaaagtcggcagacgagatgacggcccgaacatgtcaaaggtttgggggaggatgggatgggcagccgcacgcgggtgggtgacgcgcggcccgcccgactactttatttactgcgtcacataaagaccaagcgccaccgaatgctacgcgaccccctctccccctcgtttttctcctcttctttaaaccgcgccgcgccgcgcctacccaaatatataaccgtgggtgcagccgtgcgccgagccgtgcgtgcagcaggcgcaggccgtgctcgtgctcgctcgctcgggcagtcggtctccctccgcgaggagagaggagacccttggcaagcgtggaggacgactcggtgccggccgagtgcggctgctgctgctgcggctgtctcctgccgtggccgcgaaatcatcgggttggccggtggtcggcgcacgcaggtactacgtgggacggtgccgtgtggctcgtccgtgcggctctgtttttttttctctctctcgggtttggcgttaagtacggtgagaggcagctgcttcgcgtcttggtttcttgttctaccttgcgttttgtttggtgtctcgtcgtcggtctggtctgtggtggccggcggcgagatggccgagctgattcagaggaggtgaaaaacctgagaagagatgcagagcagagcaagaagttttgagttgatttgcttcttcatttttggtctctcttcaggtgctaagagctacaatacctgagaattcagttagtggatcatcagttcgaggaaagctgcgagaaatggagatggacttggcagtcgagcagtacgggtaagcaccattcatcatgtctccgttcctgtggatgcagtggatcttttttactagcaagtcgttactgatcactcgtttgtttctcctcctttttttcctcttccatatgcaagatgcgtgcattacaggaggaaatgcaagataagggcgccctgctgcggcgagatcttcgattgcaggcactgccacaacgaagcgaaggtatcaccgttttttccttgtctcagtattacatgctttgaattgtctctggctaggagaaaaaaaccttattgttctgcttactttgttacaggactcgttggaggtcagcatcagcgaccggcacgagatccctcgccatgaaatcaagctggtcggtgtccctgtccagttattttggctgccctttccagcgtatcactatcgctgttactttatcggatattttgctgcatttgatgctaactgtcgtgtcggacatgatattagtaatttgcgctgcccaatattcttggaaatgattgattactgctgcttcagttccatcctgaatttcttttccttttctactgtacgcttatccactactactgtatactccctccgtctcaaaatataagcatttttttagatttcgacacatttttcgagatattattatgatcaacaatatgtataaagataaaatattttaaataaaaatagttgtatattatgatagtttgattaatgataaactattagcatcaattttacatgattgattttttttgtcattaatagtcaaaattagaaatgtttgactttgcaattttctaaaattgtttatattttaggacaaggagagagtagatacttagccagattctgttgatttttttggctacttaatgtgtccgtgcagcagtataggtgcgtcctccatattaagtactctctccgtcccagaatatagcaacctagcatgggatgagacctatcctaagaccatgtaagagaatagtcaagtgggagaaactattgtaggcatggttcaccgttagtcaagaactcaggatgatttgaagcacagcatagttgcaaaagaatagattgtaccatcaactacacactcctattattgatggctgactataactggtgtttcagaagttactcaaagactgaatgaactataactaacagtgcaagttcatatcctaaagattgaattggttgcatgtccgatctagatcattatctgaaaatgttcatactagatcattatctaaaaaaaaaaaatatttcactacgtgcccatagaatctagttttaaactcagcgtaaaaaaagtcaccaggtcacaaataactgcacagattaagtagagaagacagctggagtaaaaccaatagccgttatcaaatttcagaatctgcgactgcttgtatggttgaaacgggcaaagtctgttcttttgtggatatggatacaagtcactatctcccctttcgccacttttggttgtttaatcataatgagcctcctccaccaatataatgaccttttttttgagataccaccaaaccatatagtgatcttattgagactgttctaccttcctcatcacaggttatctgctctctctgcaacaaagaacaggatgtaagttgccaataactagtaagaatagtcattatctaaaaaaaaaactagtaagaatagtgtttatcaggtgtcatcagatttggctgttcccatcacataaaattcgtccgccttttgatttgtaggtacaacaggattgctccaattgtggggcatgcttgggtaaatatttctgcgcaaaatgcaacttttatgatgacgatgtaagcacataaagaacatttgaaccttgtgctgttaatgaaactaaatagcattttgattatattttttgggtggtatttctgttcttttctctgacttgcgtggctctcgctcttgttccaggtatcaaagaaccaatttcactgcgatggatgtggcatatgcaggcaagttgtgctaaatatgcattcctgtgacggagtaatgaaatatgagccctttttgataaatctcaccatcacattttacagaactggtggtgcagagaacttctttcactgtgacaaatgcggtatgtttagggtcgagtgatttcatcaatttcagattttggtattagtaaatatttgcattgacaaatattgtggttatcaggatgctgctacagctatgtgctgaaggattcccatcattgtgtggaaagagcaatgcaccataactgccctgtatgcttcgaggtaaatatttgttgtcagagaaaccatggactctgaaattttctgtattctactaaaataaattcccttatttgtttctgtgctagtatctatttgactcaacaaaagacatcagtgcactgcactgcggacacacgatccatctggaatgcctatacgagatgagatcccatcaacagtaagtaatcacagataagacttacaccatggcctctcccaactgattgctgactatggtgtcaatctgtgacatttcgccagattctcttgcccggtctgcctgaggtctgcttgtgacatgtcccatgcatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6270 - DNA, 262 bp, Oryza sativa
cacaaaggtaaggtacccaaataggtggagagaggaatcaccatcaggagtgacgagcgggtagtcaccagcgtcgaggtgcacgaaccagtcccagtcctggcctacccgcagcagcaaggaggcgccgtgcagcgtggcggcgagcgtggacgcgccacgtgggttggcgaacccggggtcgccgacgacgtggacattggcgcggccagggccagcccgcgcctggcgggcgagccgcgcccggtcccccgcggacgcg

SEQ ID NO: 6271 - DNA, 182 bp, Oryza sativa
tcatctgccgacgctcgccgcctcatcccccgccactggcctcctcctccgccgccgcctcgcctcgctagagcagcgcgagctcccgccgccgccgccgcctaacctcgccgctgccgctcgccgccccccgcttgccgctgtgcgcgtgagacagagggtgagagaagagagagaggaaa

SEQ ID NO: 6272 - DNA, 2308 bp, Oryza sativa
  unsure (1)..(2308): unsure at all n locations
tgcactctctatgctctactccattgttgaacacccttgtcactgcagcatctatgcccttgcctgcatcagtagacagtactaggacttctggagatccaattgccttattcaaacaaaccatgaaccattcccagtttttctttgtttcagatccaaagacagcatagggcactgggaacatccaattgtggccatctataccaatagctgaagccaactgccctctccacttgcctgttaacacagttgaatcaatgcctaaatatggcctgcacccattcaaaaatccatttatacaaggcttcaaagcaataaacatcctactaaacctatgcttctcattaatcacatcatactctatctccactatactaccaggagatctcttctcaatctcagctttaaaactatacactacctcaaaactttgctcccagccaccaagtatctcatctaaagccatctgcctaccatcccatactacatagtatgacagggtgattaaatacttctcctccaaagtcttctttagagcagcagcccctatggttggatcttctctaagcttgttgataaccctgtctttaacccaagaattgctggccatgcaattattctccaatttgcctgtgctagcacacctatgctcatatggcatgttctttatctgcaaccaaaaagggacagtaaacatccaaaccattattcagttgcaaaacattaaatgacaaagaagtaaaacaaaagagctacatacctgccaagttctaccatctggcaacctagaagcatggatcctccatttgcacttctttgccttgcaataagctctgtatcttgtggcctcagagtagggcactgcaagctcaacctctttcaggacagcatattgtctcatacacctcttaaaacaaattacatcctaaaaagtaacaccaacttctatccttggattgcctacatcagttatatggattagaggctcacaacccctattatcattgacttctaaatcatctactggatcatcattctcttcatcaccatcagattcctcaggagtgtaatttggatcattagcctcatcatctgacaccagctcattgtaattctccctctcatcactaactcctacatactcaacctcatcaaactcaccccatggatctggatttggcattgattgatcagtagctttgtccctggacttgctatttttttttggtgggaaccttttttgtggtagcatctctggtaggaacattgtcagcctgacttgcttgtgtgggtaaaaccatactcagtggaaccactgttttagcttcatccacacaagacacaatttgggaacaaggctcactcactgtcacttgcaatggaagcttcctaacatcccagtattggttaaatgcctctaataacacagcatcagaacaaatttctacatccctacccactctcttgtcccagaaagtcactctaagctcctgcgcactaccacggatgatttcatcatccaagtccttcatcaaatctatcaagcttattgtgtctttatctacaacccacttatgtggagatgatacatgataatcttggctaccattatccatatactcaacataagcaacaaccctaaccacaactctgcatgcagagttcggatccatcctacaatgcaacggcaaatgaagagaaaaaggggatcccaaatcagatccaccaaaccatgcatcctaatgcatcccaatcgaatcaaagagaggaaaaacgaatcaaagagaagaggaatccaaacttaccctttcggaatccatttcggcattggcggcgctgccgccagcgcagattccaccgcctcctacgacggtgaagccatcaccgccggtcaaacttgcatcccaccagcgacaatgcctgggcacagccagtatcgagggtgacggaatcggtgggaatgggcactgtttggatggaatcggtagagctagggttctaccacccgtactgcttgcgagtggataagaggagataaggcgcaagggtatttacgtctgaccgtgtcaaaaaacagcctcccgtcagccacgtcagcacggcaagtctacgctagacggcgcggtgttcatcaacaaataaccacgattatgggatgtctttccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6273 - DNA, 3022 bp, Oryza sativa
ccgccacctcacttgtcacgaccggaattaacccaacgatcattccatacgtgcgtgtattattccttgtcccaggaggcaaggtacaccaaaagttgatacaattcagagtttaacaagcggaagcgtaaatagttaatttattacatgggcgacgaaggcccagcacacacgaagataaacggaaaacagcggaagactagggcaacgaccacaggcacttgacggcaggcacgagctagacaccaaagtcttcatcctccaggaactcctcttttgggttagggaaaaattgagcaagattgagtacaaccaccgtactcagtaagacacacccacaaatgcagaataaatgcaaaggagtacaagggagttataataaaggggttagggtttgcagtaaacaacatttacaagacttttagttgcttagggccattttgtaaagacgatcctagagctacacagtgttattaatcaaggccgtgaacccgcacgaacctgccttaacccaaggcctacgatgattcagaccgaactggcaacctgacctgggtcccagctcgtcccaagccaacctaggccaaccattccatattttagttgttaagcaagttttaagaagtaaaccactaacttgggtacattgttaggcttgcccataaccgagggcgcggctattcgaatagattatactctgatcagaggtgtacatctttacccacaagacacatctttctcacgtgtaaccacgtagcacataccaccacggcatacggacgaaagatgtgacatagttcccaacctatcctagccataaacaagagtaccgacccaaccctggctacgaccgggattcccgagacaggtaaccaaggttgagcccctagcagtaggacaccggccctgtgccatgacatctcgactaccgggcgacagctcgtgtggccttcatttgccctagagatatccatcgagccccgactttgtccatctccatccgtgtacttttgcccatgaccagactgagccacaaactacgccttacccactagacatgtggaagtacagtagtactttgcaacagaggcctgaagaccggtccttatagtggccgaggtgctactatcaaaaccatgcacctcgagcctagcctaaaaccattttgagggttttgaatagagagggaggtgtgtgtccatttccacataatcaaaccattccataacgtccaaatgatatgagcattcccaaagtctaaggttataaaacgacctaatgttgtctaattaatcagcgaagcagctagctaaattcatactagtggaaccatgaatagggtacccactagttggggttttgtttatcctagggtgaacaaggtaataataacaatagcaatattaataaggtcataacaaaggtaaataggcatggctaaataaaatagtgataacgcgggaatttaaataaagcgataatgcagtaatttaaaccaaaataattttataaactgggattcaatatgttcaaggatgatgtgacttgccttgctcgctttcccaaacgtcggcttcaacctccacatagaaaaaggctttgttcaaggatgatgtgatcttccaaagctgctgcatctacacgaccaacggaaagaaaaaggcttttactctaataaactcgatataacaagcagaaacaaagcacaaaaatatgttcttgatttcttaaggaaaaattacagacttgaacggtccaattctgagttcaaacggccaagatatgaccatttgaagtttatatgctcttaatgtgaatatttacgaatttcttcatttaaattttaattaaaaatagggtttattgcgtcagccgagaagagggggcgtgcggaccgggtccacgggagtggtgggccctacgcggcagcccctcggtcgacggtggaccgggtgcacccgtggctcaccagccggcgccgtgggccccacgcgtcagccgcacccgagggcacgggcggctgacggccgagccccacgtggtggccacacggcgcgcccggaggcggccacgtcgttgcggctggcgttaggcggcgcccgcgcccctatggtcgccggcgccggccataggcgcggcggagcggcggccgagagaggggaagggaagggggaaagaggcggcggtccacggctcaccccagggcgacgacggcgacggaggaggcggccggagcagagggaggcggtggtgcggctcgggtcgacggggtcggcggagttccggcggtcagggaccgaaacggaggggtggacgaggtcggtggcagtgcggcgaagccggaggagacgacgccgaggtgggaagcggtccggggcgacgacggcggcggacccgagctcggcggtgacgccggagagagagagcgatggcgcgagctcgattccggcgggaagaaagtgcggcgagtggcagaaacggacgagggaggtgcggggagggtttatatagggttgggagtgagagagggcggccggcggggaaggaaaccggcgcgggggtcccggtcggcatcaatggcgccggtgagatttgcgggagcaaatccggccgtttgaacgcgggagagaggggaaaatgggggaaaagggagagggaatcacggggaacatttccccccacttaatggcacgcgggaacggtcgggggcagcgggatttgcggcggcggcggcgctagacgcgggcggagggagcggcgggagcggcgggaggagggggatgacgggtgggccccacccgtcaacgagggcggcgggcgggcccgcctgtcagcggcgcgcacgcggggagggagggaaagccgagtgggacgcggggagaggagaaagagggagatggagttgggccgaattcggcccaagagagaggggagagggttttagggttttctttttataaaaccttttcaactttgtttatttcttgataattattatatgtgctctgaaaattccactaaa

SEQ ID NO: 6274 - DNA, 1324 bp, Oryza sativa
ctttcactaggattttaattattctagacataatttaaaggatatattttagggtcgttttgggacgtgacaaacctaccccctcttaaacggaatctcgaccccgagatttggaagaacatgcaaagaggttgggatgggctgccttcagctcgtcttcgcgctcccaagtagcttcttcctcggcgtggttgctccactggaccttgcataaacggataacccaattcctggtcctacgctccattgtgtccagaatcttcaccggcttctccacgtaggtcaagtcttcgcgaacctcaatctgctctgaatcggcttgctcggatagcactcgaagacatttcttgagctgcgacacgtggaacacatcgtgcacattgcccaaggatgcgggcagctccaactggtaagcaacttctccgcgtcgagtgatgatgcagaaaggccccacatacctaggtgcgagcttcccttttgtctgaaatctgtgcactccccataatggcgtgacccgaagatacacaaaatcgtccactgcgaattccagatcgcggcgtcggttatctgcataacttttctgctgagactgtgccacctttaggttatcctaaatggttctgactttagcttcaacatctctcagaatatcaatcccgaacacttggctttccccaacttggtcccacaacagtggagtccggcatttgcgtccatacaacgcttcatagggtgccagttgtatgctggtttggtagctgttattgtaggagaactcggcataagggagactcttatcccaggtcttcccaaaatctagaacacaggcacggagcatgacttccaggacctgattcagacgctcggtctgtccatctgtctgcgggtgataagcagtgctgaaattcaatcgggtggccagctcttcttggagcttcttccagaagtgagaggtgaattggcttcccctatcggatacaattttcttaggattgccatggagactcacgatcctagcgaagtaaagttcagctaatttgttccctccataggtggtcttcacagctaatttgttccctccataggtggtcttcacaggaatgaaccgagccaccttggttagtcgatccacgactacccatatagaatcatatccgccttgggtttttggaagtctggtgatgaaatccatcccaatttcatcccatttccattctggtacctgtaaaggttggaggagtccggccggtcgttggtgctctgctttgacacgctgacacacatcacaaagggccacgaactcggcgatttcccgcttcatact

SEQ ID NO: 6275 - DNA, 1542 bp, Oryza sativa
ccgcttcatactaacccaccaatatttctctttcaagtctaagtacatcttcgtactgccagggtggatggaataaggactttcatgagcttcctgaagtatcactttttaagttccttgtcgtccgtaacgcatacacgatttccgttcaataaggttccgtgttcatcttccgtgaagccagcggctttaccctgcttcattttcttgaggatcccatgcatatccggatcattcttctgagcctcgcgtatttgatcaagcaaggtgggttttgcttctagtgcagccaagaatccatggctaacgacacttaggttcagggcttccaactgttgattaaattccggtggaatgccacggacgcaaagagtactgcaatggccttttcgactcagcgcgtcagcgaccacgttggccttaccagggtgatagtggattcccacatcatagtctttgatgagctctaaccatcttctttgccgaaaattcagttccgactgggtgaagatgtatttcaaactcttataatcggtgtatatttggcagcgatttccaatgagataatgccgccagattttcagagcatggaccatagcggccacctccaaatcatgggtaggatagttgccttcatggggtcgtagctggcgtgaagcataagctaccacatgaccttcttgcattaacacacaccccaaaccttggcacgaagcgtcacagtacaccaggaaatccttgcgagtatctgataagattaacactgacgaggaaaccaacttttctttgagagtttgaaatgctctctcacactgcggactccacacaaattttttttccttcttcagcaactacgtcatgggcctggcaattttggagaaattctcgatgaatctccgatagtaccctgccaaacccaagaaactgcggacctgggtgaccgtcttgggttgcttccaatcggtgacggctgttactgtttcaggatccacagcaactcctttaacagatatcacatgccctaagaacttgacttcggacaaccagaattcacacttgctgagcttggcatacaactgatgttcccagagctttcccaacaccagacggagatgctgatgatggtcttcctctgactgtgagtacaccaatatgtcgtcaataaagaccacaacgaacttatccaggtattccatgaacaccttgttcattaaattcatgaagaaggcaggagcgttggtcagaccgaacgacatcaccgtgaattcatacagtccgtaccgcgtggtgaatgcggtcttagggatatcttcttcacggatacacaactggtgatatccggaacgaagatcaatcttggaaaagacagtggcacctttaagctgatcgaatagatcatcgatccggggaagagggtacttgttttttatagacttcattgagagctcggtagtcaacgcacatcctctttgtcttgtctttcttttctacaaaaatcacgggagcaccccagggggaagtgctcggctgtatatatccctt

SEQ ID NO: 6276 - DNA, 37679 bp, Oryza sativa
  unsure (1)..(37679): unsure at all n locations
cgccttgctcaatccactactcctcggaattgggtcaacaattcatcccgaggatcacatccaaatccttggtgtctataaggatcagatccgagggaaaaggaattccctggatctctataggtacggccgggctataatactttgctgtcatagctcctccaggggtggtgatgagcagtgagttcctaagcctttctaaccccagctgatttctccccacgaattgcacagatataaacgagtgggaagctccagagtcaaacaaaatggtagcggggatggaatgaatgaagaacgtaccgatgatgacatctggagttgtctgcacatcctctgcagtaacatggttcacacgaccccgagtggcatcctttccaccattgttggggcggggaggcgcttggccttcctaacgcctcggctttgggaatttatccgcgaagtgcccaggctctaaacagttgaagcacaaacgcggctgaccttgaacatccctgcgtccatgactaggctgcacggccggtgcagggggacggggtgcacggttcccttgctgattctgctgttgctgcggctgtggaacgcgtaccacaaattgaggtcatggcactgggcgaggttgttgctgctgttgttgtgaggaggatccccctggatagggattggtgtagcggatcctttggttagccccctgttgattacggaaattcgccaagcgacgtttgtgtgactccagttccttgtgcttggcctccaggcggatgctcttgtccactacgagctggaaatcagggtaatccccggagaccagacgcacagaaagttcagggtccattcctactagaaacttctcctgcttttcttcatcttcacgaacatcctccagggcgtaccaggccaggttattgaactcatgcaaatactccataacagagcggttgccttgcttcaactcccgaaattccctcttcttaagggccatgactccagctggcacatgggtcctttggaaagcggcggtgaagcgggcccaggtgattggctgtccttctggctgcatagcctggaagtggtcccaccatagtgatgcgggcccttgcagctgatgggttgcgaagataactttttcctcatcattgcactggacggtgtccaactttttcccaacggcatgcaaccagtccaaggcatcaacggggttattggagctagagaaggtaggcgggcggatgtggaggaactcggcaagcttggagtgctgtgggggtggtggtggtggtggtggagcattgtgttgcggcggagtctggatgtggtggaggaaagcagccatcatgttggcctgctgagcgaggatttgggtgaggatggggttggtatcgggtggcggtggtggtggcggagggggaggtggaggtgggctgccatggttgttgtggttgctgccttcggggtgactgccctcaccggtagcagcgcttctcctggttgtcaccatctgaagattccacacagaaccagcaaacagaaagagctgacgattaaaactaaccacccacgactaccataattcttgaatttatttctgctattaaattggttcattaaggttgaagttgcttatgcaaataaaataaagacaggctccgacacaattataccacacaccggtataaccatgccccacacgactctgcaagaaaacaaacaaaaagaacacacgcgcgtgcctactagctgctcgtctacttctgcgacgggccagggcggaaggtgagcaacaacacatcctccgtgctgccaacgccagaggctccctcctcctaaggaaccaagggcgcgggctcgacgcaaggagtctccacgaagcaggtccacgccaagaactgacgaacaagctcaggcctagaggtactcttgcgggcggtgatcttctggctgcggcaaacgcggcggcgcttggggcgacagatctccccctgagcaatcttgagctgacacagctgcgcctccacggcgtccaagtccttcagctgcaaattctcctaacgtagctccaggatcttcatgttgtcctcgaccaacccacggcgcaccatatgatggaagttgatgcggcccgtgtcgtacgcctccaccatgcgtgccaggtgcatgatagtagcgtcatcctccgagctagcgttccggccgtcggcgaccgaaacggaggggtggacgaggtcggcgatggtgcggcaaagccggaggagacgacgccgaggtggcatgggaagcggtccggggcgacgacggcggcggatcggagctcggcggcgacgacggagagagagagcgacggcgcgagctcgattctggcggggagaaatggcggcgagtggcggaaacggacgagggaggtgcggtgagggtttatatagggttgggagtgagagagggcggccggcgaggaaggaaaccggcgcgggggtccctatcggcatcaatggcgccggcgagatttgcgggagcaaatccggccgtttgaacatgggagagagatgagaaaatggagggaaagggagagggaatcacggggaacatttccccccacttaatggcacgcgggaacggtcgggggcggcaggatttgcggcggcggcggcgctaggcgcgggcggagggagcggcgggagcagtgggaggagggggatgatgggtgggccccacccgtcagcgagggtggcggacgagcccgcctgtcagcggcgcacacgtagggagggagggaggccgagtgggccgcggggagagaagagagagggagagggagttgggccgaattcagacctagagagaggggagagggttatagggttttctttttataaaatcttttcaactttgtttatttcttcataattattatttgtgctctgaaaattccactaaaatttatttacacattttaggcttttaggaaatataaaaaaatcctcccagccttatttgacttttaactttacacattttaatttttgatagatttgactaggattttaattattctagacataatttataatttaaaggatatattttagggtacttctgggacgtgacatcacttcactggcgtcatccgcgagcaaaaccgtcatcgtcgaccaatagttggacagggccggcgccttgttcttcttccccacgccgccatcgccatgcccttcttccctcctcctctgcgaaccgacatccgccgcctaaaaatagccggcaaagccccttcttttcccccacaactgagcttcgagctcttcttctctctctctcctccccatgccggccatcggctgatctccctcgttggagcattgccgaccaagccctcgcgccaataccttcgcctcgacgaggcaaacccattccctaaccttccccttcctttctccttccgatattagccaccaccgttacctcccataccggccggagctaagtccttgccatcgccgttccggcctcctctctcactccccctgccggccaccaccctccccggatgcgtgacactcgggaacacgttccaccgccgacgtcgtcgcctcccggtcaccggagcaccggcaccctgtctctccccctctctgtgttgctcgcgctggagaagacaagaaacggaggaggaagaagaagaagaagaagaaaaaggagagagaggacacctgacaggtgggccccagtacagtactatttcgcaattttcatatttaattcaaatcctattctctagaagcccatatctcctgaaccgtagatccgattctagtgaaactaggacctaaattcatctaaattcaaaccctacattttgatacccaatttgctattttataattttatttgaatttattcaaatattgtttgaccttatgcttgcattttcaaatactttcttttatcccaaattactctttagccactaaaaagccgtcggctagaactttacgtcttccatgggggtgttcgcggtctactgggcccgatgtcgaaccgttggttgtaaagcccaacagaaccaaacctaaggtcgaagtgctgctcctggcaccctacgcctcgatgcgtataacggtcggagcttcaccattaaatttttgaggaaaatttaaaactttttgaaagctaaagcatttaagagcataatagttgaacttagagtttgaatcctgtatataaaattaaaacataaagatttgttgggattagattagagctaatccaaaattagattttataatatatcgagttaacaaaacacaattcaaataaattggtttaaccatgaaatagaaatttaactcttttggttttgcatttcaacctaagcaaaatatttgagctaaatgaaaacaaatggaaatataagttttaatcataagaaaaaacctaaatggaaataaatatacttggttgtatgtgcattttattattttaggtttgtttttggatgttcttggtgcgtctcataataggtttcatatgcatgtcgtttctaaagaaaattcctaaaaataaattatgcaacaacaaattgcatctatattctcataaatactacacaacatcttgagtctatattaattttagtttcaaattaataaatatcacatcaaatgtttctcaaataattcgaacaactcatctagaaatttggaaaacagcatatcatttagcctactttgcaccttcaccaaaatttaaccataacttatctagctaaaccatttggtcagaatgttaactatagtgtactctaccacctggtgcaatggcttaattaaattcgaaattaaaccacctgaaatgagagccacaagttgcttaaacaatatttagactgcagtcaacatagtaatttagacctctttactaaattaccatagtaactcaaaaagtaatttaatcttggaacttggcacattgaaccatcaaatcattgtctaccttgcagcaaccttgtctccctaaaattctaatttaaaaggaagagaggagtagggaaataaactacatgttctaggcctcttcttctacatctctcttacatatggggccaagccattgtgggacccatgtgtcatcctcaccacggtgttgacagtgaaatttggtaagcccaaagtcatcatcggcttagagtcactattggctacggcatctcggaatcagccgatgggagttatcaagtcgccaatagtcggattcctgctatattcggttaaggaaattgatctactaaaggaaacttatctagaagagaccgagttcaaagagaatacggcatggcaagttatctattaattaagaatagtttgttagtttccttttatctttagaaaagtgtatttagtgtcctataaggactttatcttttccttttatctttaggaaagtttctttcttgtccgacaatgacttgtatcaacccatgggtataaatatgtacacccggggtctatgtaatctatcttcacggtcaatacaattcggcgcatcgccaccctttttacttctacttttgtttttacattccggcggaacttggcactcgacgcggggctgcatcgtcttcgatctccagcgaagggataagtccaatgttccgtcggtctaggcaattgtatcatctacgtcggcgtcgttcaaggctgcatcagtacattcgacctcttagattgctctggtttggatgatatatttgcctacccatttatcatatgtctctgttaatctagtcttagcatatcaatttagctttatcggctgcttctcgttttagggtttctgccggtatcggctaaatcgcgttgctagattagattagcttagacatctactaccctgaaaatcagtcaacggcttgattgtctagatattgtgtttcttttcatacttagtgctgcatcagttaagtttgacctactaagtcatgcttagaaccgtaatctctagcatgctttttgactgccaataagggtttcatcagggtttcagccggtgagttatctggacgttgcatcggctcataaggattgcatatacatataagttggatttagccgatgacaacaaaggtttcactgtttaatctaatctcgtggatttcatgacatcggaccaccagccgatgtgtgctttaaccttcggatcaatgcttattctattatatcaatactagccgattggtttatactggactatattattgttatattttattatcagtagccgattgtctatatatcattatttactaaagtgttagaatctacattggacgtatagccgattgcttaaaccctatcgctatcggctggtatcagcatcggctattatcggctaccggctggaactactccatcggcttgtcagccgatcggtattttatctgttgtttacatatcttgtcagttgcaggatcaaactgactggcacgcccgcatctcatcaagatttggacctgcacaggagctaagcagatctcccaggccgatgtgttcgattttttcgtcaacacagattggcatgaacaattcttcctcatggccgagaaacaaccaccaccactatctccagctagcccaggctctgttaaggaaaagatgctgaaattaggatcgactgacgtcaatgaaggaaacgtcgtgccgatcgatccagaaaaattcacacctgagcagaagaaagagtttgaagcaatgttgcagcaagcatgggatcagttcttgaactcattcatgcagacccgcaaggggacacttgttcagaagtacaaaataaaagtggttgctgatgatcctgggaccagttcttctaaggatggagatgggaaacaagctctagacgactcggctcagccgagtaacaaaggtgctaccgacgtctctctaggaaatcaaggcgacaattctcaaggagtccatggaatgcaaggtgatggtgcccaagggttgcaaggaggaaatcttaatcagaatagtgatgcggcataagattttttcagtaatttccaagaccgggttgactacgctgtgcatcatgctttgatcaatcaatctagggtgttagtcaataccttatcaaacatgatgaagtcaatagccgatggttcaatagctgagcatcaggctgcaggcccagtttatttgcaaggtgtcttcccaaattatcggtctttgatcaccgatgtccagccatctattcaggcggttccctccgttgcaccaacaactcagccaacgacgccgacatcaactcccctacctgctccatcagcgatggcgccaggccagccggtgaaccctcggttgttaatgagagagcatccacagcatagtgggcaggttgcgaatcggctgacccaagattaggttgctgccacgtttctgccacgtcaacctgttgttgatccaatacagcagcagccgattcagcagacacccccaactcagcaggttgtacaaccaatccagcaacaggtcatgcaaccagttcagcaaacaccaccaaggcagcagcctctacagccgattcagcagacgctgttaagacagcaaatcgttcagttgatccagcaccaaggttcaataagcgcatcggccgggtttgcaacgcctggtggtcagcccgtacaacaatttttaaatcaagttgtccaagaacacttggttcaccacgtacagccggatggcacagtaatgcctcaagttgttcctgagcacttggtacgtaatatccagccgaaccttcataattaccaagggggtaacttgaattatcaatatcagcctccttccccgcaagcccaatatcagccagggggattggctcaacctcagtttgcgtctcaatacggtcagttcgagcccatgcagcaacaaggggcagctcagcaacggtcgtgggccgatgtgattgctgacgtaatgagggaacagtttgggcttaaaccaaaagagactagaagcttgtatcggcagccttaccctgagtggtttgagagagttcctcttcccaatcggttcaaagttccggacttctccaaatttttgggacaagatggtgtgtcaacttatgagcacattagccgattcttagctcagtgtggtgaagcatcggctgtagacactctgaaggttaggttattccgattatctttgtctgaatcgacttttacttggttttcctctttgccgtatggatcgatcaatagttgggccgatttggagaagcaattccacagctatttttacagtggggttcatgagatgaaattatctgacttgacagcgtttaagcagcggcatgatgaacctgtgcacgagtatattcagagattcaaggagatgaggaacaaatacttcagcttgagtttaactgatgcccagttagccgatctggcctttcaaggtatgattgctccgattagggagaaattctcgtctgaagactttgatagcttgtcacatctgatacagaaggtgtcacacccagaaattcactagtaatttccgaacttatttgtgcattaaatccttgtccaggaatcagccgaggtacacaaactgacaatttaatatacagattcatcaacgttacatacttacaaaagaaaagagaaaacagcagcggaattacggtctagcgaagctccggctccactcccacaggcagctaaactggggtataagccaaacgtcttctccttcgcaacttgtcttcaactgaggtttgattgtttattgcaaggtgaacatatgacatactcagcaagccacacagcaagtatgcaagtgcacaaggataccaaagaatggcataatatatggctcatttgcaaaagcagcatttatcaaacatttgagaattgtaaaacagtagagtaattaatcatcaatattaatcaacactgaacagcacacccatgctgcacaggcccaaccatcctgaacaaccatacccggctgtacagatctatctccaaaccaggaatgtgccattccaaaccaggagctaatcaaattattaccaattatagcatcatttattacggtgagaagtgtgagactaatcacgaaagacattgttagacccgcccataaccacgggcatggctattcgaatagttttactctagctagaggtgtaccactgtacccacaagacacagccccacaacatgtcaccatgcggctcaatgccaccacggtacctcggaaaggagctgtgacagtacccctcgcataacacaatccaccacagtgcaccgttcctggatcataatcacccccttatagacaaggcatggactccccagcgacccccgtgggcttatctccgccacttttcagtttggtgccccgcaatgaaccatgctatacaaaaggtaaagccgttgcccacgctgacttgtggttggcatggttaatgtttcacaaccgaaactcatgaaccggtccttaattgtcatgagcacgaccatcaaaaccatgtgctcacaacccaccattatcaagttttagttggcacattaattaattaaccaatcacaattagccatcgtgagctacaattaaatatccatcattaagtgatagcggaacattagttatcccaatcatgtgctaatgtttgtaagcatggctaagcaattatatctaatatctagctgaaccaatatataagtccaattagtcaaattgtcacccaaggtatcaaagaatagagtaagcaatgcaaagtggtcataacaaaggaataggttcacaccacccggtgacattcgaaaataaatgcacaattgaaataaatagagaatttaaatataggatcaacatgctcaaagaaattatgtttgggatctgtgtgacttgccttgcaatattcggtcttcaataaatcttctggaatacttccgacgcactcgcgaaccttcgcaacgacggaaacgacaagctaacacgcaaaacgaagaaaaagactaagaaactccaaataaatagtacatataaagtaaagaaacatgtagatcatgattttagatgaattatgagacttgaacggcctcattctaatttcatatgaattagttacaaattttacaagatttaattccaattaaacctattaaagaaaatactattctaaattaattaaacaatttagaaatgatttataactgagataaagattaaaacaacctctggaaaaagattagatcatatttggtagatgacatatattaaaaagaaataatatgccactgaaaagagagaacggatttatattgattttggacggctgagattaatcttgatcgagagttgaccaagatcggatggcttagattgatctggcaagcgggcctcacgagataccgactcaacgagtcaattctacgtgacacgggatcacccaaatgatcaaccgaaactggcgaacggaaccggctgctctgaacggctctaaactaaaggatgactccacacggacgaacgaacgaaacatgggggacacctcgttcgaacgaacgagcgaacgactcaacaacggttgcgactaaaccggtgagctagacacgattcacggtaaagccccggtacggcaaacgataggccggtaggaattaagggatgcaccaacggctaaacaacttggctaccgagcaacggctaaagcggcggctaggttaaagcggcacacagctgcgacatggcggtactagggtgacttggctcagctaggcggcggcgactcggcggaggcacgcggctagggttaggatgacggcacagcgacgacgacacacaacgacggcagactgtggctatggtagtgggacggcagcgacttggcatgcacgagcagcagcagcatggctgtagcagggagcggcacagcgacggctaggtggctagcgcagtggcgacgctagggcagcagctaagcgtggcacggtggcggctactcgatgacaaaaacgagagattaaaaactaaaccgagggaacacggatagaagtctcaccgaaccaaagcgatcggagagagagatgactacggtgatccggcggcaacacatggagacgacgacgatgctagacaaacaacggattagattgaattaagaccctagagataaagtacaccggtgaatggcataggagcggcggttgccggcgaaccacggtacaataatgcaaatggagggcaacgggagaaagaggaggcaacagcgatgcttaccaatacttacgcagcgatgaacggcgaaggagatggccggcgacgactttccggcgatcttcggcggatgacagatggcggacgggcttctcctcgcagctgcgaatcaaatggagacgacggcgaccgaaggtgacgacggacgacgacgaacggcgcggctggaggcacggcggcgacggcggcgctccggttcacgatgacggccaatctccggttggatttggcgcaaaagaaccagcggccgggatagagctcgactttgcggagccgcgggaggtggtggcgctgatcggcgacggccgaggcgacggcgcacggcggctggaacggctatcggcggcggagagagaaggagctcgcggggagggcgattccgacgacggcggaagatgagacatgaggggataggtagaggacgactagggggtcatttatataggcacgggagctcgggtccgagcccaaatcgacgggaaatctcgggaaagtctagggttctcgccggagtaaggaaagattgaaccgcgaaattggaaaggatttccatagaaacttttggggatttcttggggaaaaggaagaggagattgagaggattccattgccgcaactaatttggaaaaaggagcaacgaggtggccggattggtgggaggaggcggcacggctgcacaggcttgggacggctcggtctctgtctggaggttgaagatagagtactgtagcgccagggaagtcaaacagacttctctgcgggctgagaggagagaatggaatgggctgaattcggcccaagactaggaagaggattattattacttttcaaaataaattaaccaatgagatgatctttcaattgttaaaaatacttccaatgctcaaataattccaagaaaaatcttgaacatacttgaacactcagagtatttattaaaattgaaaccagctcatttaatgattaatttaatatgtgaataattactgaaatgttctttgtattattaaaattaggaattgagctccgaaaaatcttagaaaatttcagagagtataattaatcatggagaacttaatacaaattaaatctatccatgctttatatttaggaaattttatttcccacatttaacttcacttgtaaattaatgaacatttaatataaattatattaataatttattaaataatttataaatcctaaaacggaaattcaggctgtgatagaaggtaaccttgcatgagcatagatctgcagaagttaggaaaagctctaagaaggttaatcatgtttgtctgtacatgtatgggtcggatgatgatgaggacgattctgaaatagctgcagccgaatagatgaggagtaaaaaggtcataccatgtcaatgggtaaaaagttctggaaaagaggagaagtatgactttgatatgactaaagctgacaagatctttgatctactactccgagagaagcaaattcaacttcctgctggtcatataatcccatcggctgacaatacctaggcaatcaagccgttgactgattttcagggtggtagatgtccaaaccagagcaatccaagaggtcgaatgtactgatgcagtcttgaacgacgctgacgtagatgagacaattgcctaggccgatggaacattggacttaccccttcgccggagatcgaacatcgatgcagccccgcgtcaggtgccaagtcccgccggatgataaaataaagtagaaaaggtaaaaggtggcaatgcaccgaattgtattgatcgtgaagatagattatatagaccccgggtgtacatatttatacccatgggttgatacaagtccttatcggacaagaaagaaactaacctaaagataaaaggaaaacataaagtccttatcggacactaaacacacttttctaaagataaaaggaaactaacaaactattcctaattaatagataaactgccatgccgcatcctctttaaactcggtcacttagggataagcttcctttagtagattgatttccttaaccgaatatagcaggaatccgactattggcgacttgataactcccatcggctgattccgagatgctgcagccgataatgattctaagccgatgacgcctttgtcgattaccaattttcactgttaacacacggtcaacccatcatcttcacacctctcaattaatttatatttcatttctcaaaaggtgagaggagagttaaaaatacaattctcacctaccttaccacacatataaacctagagtatatctacatgggcccatttgtcacccatgtaccagccatctactcatgtgatcactcatttataatctatatatacttcatcaaagagagagagagtgggggagaaagagagttagagtccaagtttcaccgaagaactcaccatacctcccatttcttctgggaaacatctatatggggccactagacagccactcatactaggttaactgaagtacaagctgaatctcagccctaaactcgatcctctctccaaaaatcgtgtcaaagccatatcatgccacctatctctccattgccagcacaacatccattctttgattaaccacttcaccagataactcatcccactttcctcatcatgttccaaggaagaacttagagaaaactccctcggaatttccgagaacacccacttgttcatccttcccgaaggtgtttgatccgctgtatgtcttctctggtgagcttcgccacaatctaatcataagaacgtgatctatagatcctttccatggatcaaacacattccgtcgagctcgtcggcgtcctcggtgtccagagcgccgccgtcggtcgcttcgccgttcccgatgatccggtgcatctccgacctagccgctgcgccatgagcgtcgccaaggttctaggataaggcctgcgaagggaatcgcgctgaagagcagccaacaaggagatcctctctttcttcctcaagtccggccgccggccaacgtcgtccgttcctcgctctcgggtgagcttcggcgcagttcctcgttcgtgtagcatccttagattgtcgttgagccgttccacttctcttcttggcagtccggagtctggaagggggtcgacgccgttgccatgccgtttcttgccgtcgccggagcatccttcacgccgtcgtcgccattcaagcgttaccggcgcatgtccaacccacagtaagcttccagcaaccccgtagaggcacatgcatacactcattcacaccgagctcgacatgcacatgcatgccgaagctcaccgccgctcgcgctgccaccatcgctgacaccgaccaccgcagccagcgaaaccaccaccattagcttcgccatgttccactctgcattttctattctggtcgcatcgtgaaatctgccaccgttcaccgccggctacgctgtgaagccgctgctgtcgccgctgctctgtcctcctcctctcaggctagctgacatgtgggtccagttggattaggcactaaggactttcattactgaatgtttagatctggtaaggttgtaacttcaaataaccttacaatgacatgtggacccaagaacatgcatgtaaatagattaaaactcaagaactcttaatgaagattcaattaaaacgtgctagggacctcgggacctattactagaacctctaggaatctttctgcaaaatatctctcactgaccagtgggccctatgtgtttaaaatctggaaaaatataaggaaaatgccttagtgaatatctaatcaacagaaaaataggttaaattgtaaattgcatataaaattcattttagctccaatctggatgaaataaatttctgtagaatcaccagttatgaaccttaatatggaaacataaaacttggcacttgcagtagaataaatagctctaataattcacataagaaataatgaacatagagcaatctccaacttagaaaattcatataaaattcatcttaacttaatttggagtgaaccaagctccagtattctcacaaaaccatgttcttaatttacatgaactaaaacttgatactttctgtattaaaataatcaccaactatttaattggtaaaataactagtatagtgtatctagaaactataaaacccataagtgatttattttaactccaaatgagatgaactaaatttgttagtttgataaaagcatatacatttgttctgtagataaatctgtagaagaaaccatatccaanaacatcactcanatttgaataatgaattaaattaaaagatggtatagaaacttctagaattcatataaaatttaataccagtctaaaggaagagatctcaaagtttgttaggttataagaaccatgaccttagtttttataaaataaaatatgacactttcagtacccaaaacttgtctaaaatttaaatagttaacaactactataataaatcacttagcttgtaaaattcatagtaaaatcatcccaactctacaaaaatgtgaaaccaattttgttgaacacctgagaacatccccttcactgcagcaagccaacaattcataaatcatagacctaaaatgcacctaagaactattagagcttaattaatctagtgctagtattacatcttgaaaatttataactctctaatgcaaagtgataaaatataaattctttcatctaaattcatcttagaccagtacctaaccacactagtaaactcatgcattttagagcattttagatttttacatgttttggcatttatcgttaccgttatttcttttagacggtgaattcgttaccggtgaggtgattggtcttatagctgatctcaagaaggtcttatatcaaccaaggcaagtgtgcccttcctttgaacacattgaatcccatgttttcgggctaaatgttttgattgtaaaagttgcatgcgtaattcgaactatcgaaactggattgtagatatgaccaaaaaaaaaaaaaatttgcatgaacccttttgaaaatcactcccttgctgttttgaaccttaggaataattagagtacttttattgtgctcatatagctaagttaagcttttataaaatgctaatgcttagccttgcttagtaataaataaaaacatggctatggaatcacttattatactatttggaaaacctttttatgtgatatgggcagcgatgtgttcgctggatatttgtgaaataaaatgagatgaaatgtgatttttagacttgagcggcatgtggtatgcatatggtggtagttgcatactgatagggggagtattcgcccgagtcgattaaggaccgaacatatcacccattatgtttaccgtacatccacatgtgctagtatgggatggcctaagctgattaatctatttaggactagccttgcattctggtaggccggtgtgtatgagttagtcgataattctgagaattttgtcgataacttagaggaactacccatgagtgtgtgtttgtgatgatcataggatgatacattccctatgtgtgtgtgtgtgttccgtgaggggtgtactgatccacctcacggcatgggcgtctaagtctgtccaatacaacggtattgtgccacgtggtgggttcccgtcgtgtccgccaccacggcattaagtttaaggcgtgggcccgccacttaacggttctagacatatttccaagtatacctaagatggaggaacacgtatcgtgctggtgcaaggctagattctaagtagtgtaaaggcttcgttatgacctctagaccgcactcaacgtatagagtgtggtggtgcatcgcgagcacaaaacaaactagagtgttgttcatatcttgtgggtaaagctgtacaaactctacagagttctaaaaactaatcgattagccgtgctcatggtcatgagcgacatgatgatgtgctatgggtataattttgtgatttctaaatgcttttgaaactaaaggaaaaagtacgaattacccccccgaactattgcggtcgtccgaattacccccctgaaccacaaaaccggacattcttcacccccaactatgcaaaccggacgaattacccccctcgacccaatcagtggtggttttggtctacatggcgtacgcgtggaagtccagtcaacaatttatttattagtaaaataggtgggccccacctgtcagcggcctcctcgcgcgcccgctcccgcgccgcgccgcggatgccttgtcctccagcgcgcgccttacctctttccggtgctcctcctcctcccctcctgccgccgcggccgcggcgccgccgtcggacgccgtgacaatgacgacggcggggccgatggagagctgcagcttcatcgtaatcgcgtgttggcgtgttgctcgtgggaggaggagacggtggtcgtggtggtcgtggagttggacgagaacgcggcggccaacggtgccgtggtggacgccgggaggagctgctgctcaggcggcggcggcggcagatgatgatgatgatgccgcagcgctgcgtgacggatgaccggcagcgtcgtcaccacgggcacggcctgccgcgcacccgtccagagttacacgcatcctgttgctctatgaagctctccaccctgcaaccacacacacacaaccacccccaaaccaaaccaccgccattagcgcacactaaccataccacttaaccatcatctcatcaccaaacacaacaaaaacacggcgatcgattcgaagattgatcgatcatctgtacatgtagatcgatcgaacacgacacacactgaccaatcgtgagagcatgagacaaccagaaaaaacccatgggacaacctcgcctcgtctcctccgccgccgcctcacctcctccaccgccgcctcgcctcgccgctgccaccacaccccgccgccgctcgccaccccccgcctgctgttgtgcgcgtgcgcgtgagagagtgagagaagagagagaggaagagtgagagagaggagagagagagggggaaaagtgcaataggagtatgacaggtgggtcccagtatttttcaataaataaattgctgactggacttccacgcgtacgccacgtagaccaaaaccaccgtggattaggtcgaggggagtaattcgtccggtttgcatagttaggggtgaagaatgtccggttttgtggttcaggggggtaatttggacggccgcgatagtttggggggggcggtaattcgtactttttctgaaactaaatgatttgagttgatgataagattgatatatgtgatatgattgccttacttcccgttgtgttgtaagggaatgatgtctatctatttatgttgatatcatgccatgattaatatgcttcacaatttgctaaaatgttttgcttaaattacgttgcaaatggtttgtgaactaaaatttgctttatgctgaaaattgagactacaaatagcctttcctttgacatagagctttcatgtatgtaggtttgatagtgctctgccatgttttgtctaatttatgttttgcaggaataggcttagtttaatttgagtgatgcgggtttcgactgcttcttctaggatgtgaacttaatggggtaaacccctagtcggtgtgcttgaggattgggtagtcaagcttccgctgttctctgatatagttatatttggccggtcggcctatgtatctatttattagttgtaatctgagttttatttgctttagatgtatcttgctatgtatattcatacttaagatgaaagtgtgaatctagtgcacttcctgggaactagattcacatgagtatgagttaggaatatttgagatgttgtagctctttagccatttttgtcaagtctcctgaatgtgtaacacatatggtcgccgccttcgagtggtttgacgggcacatctcaggctgaagttgactggcaggctaaaggcccagcaatgtctccaatattcctctctcgaggcgtcggatgtttcattatgattgctcgatgacttgaattattcactttatctcccaattataatagaaggtccggagagcctacgacagcatggtatcagagcaaataccgactataggagcccctttaagttggtcgtttagaattgattcttaaaaaaattattttgagggctttgctctcagctacaaattatttgcgaaaatcatatttaaccttatatcttatccctctctggatattatttccctatgtctcatgttttgatttctaaaactccttatcttgttccataggaccgaaaccttttgaaagcttatatttctgtaaaaatgagtttgaaaacgcttattaatcgcaatagatcagtaccaaagtgttttgaaaagttttaaaatctatttgcaaaattctcctatgtattagaacggttttgcaaaaatctcgggttttggaatggcatatagagtgtaggttttgaagttgattaaataaattaaaatttgatagacatgttaggttgtatcacataaacatgttacttctgtaccatggtgaaatttgatgggttttttatgctcttctatcccagcatttcaaaatttcgttatgaccttgaatgggtagatttggggtaggatggaattgttgtgttatgaccactagattgaatgcttagatggaccacccaaaaatcttatagcctctgaatcttgttggtttcatgttatgatggaatggttaatttatcaaacttaaaacatgctatagaaattcaaatgcattagttgcacgtgttctgaaatttatagccagcaactttcacgaaattttgtagcccaaaccataagtgataagcatgccatcttttagcagtagttagtgtactaccatatgaagcatcatgaattttggtagaatttttgaacctctgcatcaaggtgtaaaaattcatatagtctgcatagtcaggttctgaaatctgtaggttgcatacttaacaattttatatctcctaaaccataaatgataaaatgaaaacctttggtcagtaacttgtattcttgtcaggaaagtttcatgatttttcgtgggatttttacacctgtagattaagagataaaaattcaacaaccatagataataacctgttccagaactgcatcatctgtcttcttctttttgaataaaataaagtacttgtccaaaaatcacaattccttcccagaacatagaaaactttgtaagcaacctgaatataaattttatttgaatttacaagccttctaggttggtcattaacttctattttcagcagattgacacctaggacagacctgaaaccacctagcttgttcatcttccataccacaatcctgcttgctaaaacttttaaattttaaggggggtagtatgataggttagcttcaatcatgcaagaatttagagacctcgaaccatctctaatatcaaactcaataaccataacagtcataggaatatctttcaatcttgctgtcctaaaactaaaaatgcatgaacttgatttaggaaagctaaaatttgatccctagtaacttaaatctagagctctatcgcagccgtgttcatttctgtgtatttgaatcattcctcgatgcaccatgtcgaaaatgatacatccaaccaaacatcatcatccttaggcttatttctaaaacttgttacagtttgatccaaaattctaaaaactttgagaaacctttgacatttgttaatgaaatcgaccaaagcaaaataatttttgaacactcccacagattgcactcccatatagcatcatctacacacatagatctgacatatctcatccacacacatagatctgacatatctcaaataactagatccatatatatatttctacagagacactagaaaggataccctcatctcaatcgggcggtaagccccatctcaatcgggcacagcgtccgtcacaggctagaagtcactgatgtgaagagttatctcaatcaggcaaacggccgtcacgaatgaatatatcttaatcggaccctaagtaaagcccgtcaccgatagctttgacccagacgaccagtcaaactatagcccgtcacagatgacctatctctatcgggccacaactagcgcccgtcacagatgactactaacctttatcgggcctaaactagagcccgtcacagatgatactcatctcaatcgagcctaaactatagcccgtcacagatgactgatgacctcaatcgggcctaaaatagagcccgtcacagatgactactgacctcaatcgggcctaaactagagctcgtcacagatgactactgacctcaatcgggcctaaaatagagcccgccacagatgacctcatctcaatcgggcatttagttatggcccgtcacagatgactataatccacaaaaaaaataaattttgttttttggctagcctcaggcctttgctagccatacccgctgcaaaaatgacagaaacaaacacagatatctaatatccccagctccccagcatcacccattcatatacatatgcattcacatacacagacatcaacatatttcacgcaaccacacattcacagccatctcatatttcacatccattcacatatttcacatccattcaaatatttatcatatttcacctgcaaaaccgagttaattagatcaaatatttatttagcaagttttaacataaacatatgaaatatatacataaatataagcatcacagttacatcatcacaattgcataataagtgttcatcattgcctaaacatagaagttcaacattgttcatcattttagtttaagcctaaacattcctttggggttaactatttcatggaggatgaagctggctatctcctcgtgaacctcccaaagctggtaggcagagacttggttattgtgccctacattgtcataattccagattagttgattgatcatatataagtactaaaatgtagttagtctatcataattgagaccaccgacctcaaactcagccaaggtcttcaccttttctctatacagaaggcgcatgttgtggcacacatggaatccgcactggtcacctatttgttgcttcaccgggaagtcttttttgtggatgagggtgtcatgtcctatcttcctgaggcctcctctttgcacgtattgggcccacgcttcatctatcgctagttgaattggggtcaaatcatatgcgttcttatcaattctggagttcaggtagtgacatgtactccacttaggtgttatgaccagaaggatccaatgggcactgcggcattaatatagtgaaagttaattaagtactcaaggaatgtgtcatgactattgattataggtgcacataatgtactccttgtctcggcgggaccataaggtgtcatagatgtagttgaccattccttgacggtcattctggagatttgtgacaatgaccacttgtggatcaaggaaggcaatttccggtgcatgcttctgacaccattgccaacttaacctacacacaggataaacgatcttgtaagaaagttaaaccgattgttattaccagattgagttgggcgacaatacttacaaggagtagcacttaagaggcttgtgtccaccgctcggagcctgtagaggtcgaaaagatccttgaagttgaccatgatataatttgttggaccaaggaatggctttccatcgtgctctccaaggatatcggtggctttattcggcttcctggcgttagatttctccatgtagtataagtgaaggtccttgcaagcggtgcccattgcggcaagcacgtcatctccaaccaatggcatgcctagtcggaactcctgtggagcgacatatttcttcttgacctctttgcccttagtctcttcctggcccttgcccagatctagcttccttggagctagaagcgaggcctgcacctttcctccccttcctctcctctttgcttcgggtttatcgagagtaattctctgaggggaagagtgtgccttcctgctcttcttcatcggtgggggttcatgaattgccttgctgtcggcctccgttcggtcctccccaaaatccgtgtcgtactgcaactgcacatcgtaagattgtgcatgacgatcttgagcaggaggggctgaaggagcaggggtgggtctctttggtagacgaccgcctggtgcagtgtttggcctcgctgtaaccctgatctcaatgaggtccttgggccattggatgaaggtaccacgggcatttcctagtgagaggacctcgtcgttcggtggatacttcagagggaacagctcgtatttgggcttcaccgagtcgacttgaacttttgcacagtcggccctgagttgcgctccatgcactcttgtctttggggtcggcttgtacgcaagtccctcggctgctagaaccgtgaaggtcggcatcaccctaactatgagggtgcagctcgttggttcctgcgatagattaatcaatttttttagaatattacatataatatggattcgttaagtctttcatgtattgagtaagttcacttttaccattatgtggtcgacggtgctgtcgaccgatgttggattttccgccaactcagttgatgcgcaactgctgcgtttttgggtgggacttcctaactcttcgtgcgccgcagcagcggtggcctgggggttctgttgctcttctcggatctcttgcctaatcttggtcctcattgactcgagcttttcgtcgaattcagatgtcagctcagctcttatcgacgcccggatattggcttcaagccatgcatctttctccgccttgttggaagtccgcttcttgtactgccacgcgtagtatggaaatccatacttccagggaacagaagacccaacgcctcgtgtccgtccacggtgttccttgttgcccaacactttcgtgaggaggtcgtcctcgcgtctttgagagcaggcctcttgcgagggttgttgctcggcaaccaactccttctgcattacaatttagtggggttaaataaactgcacgatgggaaacaatgcaaacatctagtttgactagatacttactatagcttcgtacactcgttgatcttctgcatttggcatgaagattgtgccatcatcattcttctggtacctggccctggcccagttcctagcccgagggtgtgggatatcaccaaacacgagtggcgtgttcgattcctccgcttcttcatcctcacgcggccattccttttccttaccggcatatccggcggtgccaagccggtgtggatgctggttcctggtctggagcaagtgatatgcctcgcttctagctctggactcgggggtcgacttcttcgcatggaattccacccagacctgttccatgatccaagaaaatttctctcttggatctggattcgtcgggttgtagacgaactcgccgactagcttagtcttgaagttcttccaagcattgcccataaccttgaaagcagcccgcctaagacggtcctcatgctccgcaggataatcgaagctctccttaaacgttagccaagcaatgtccttctctgcggccggcacgagcttgatgtcatcttgcagaatactgaatttttgcctccctatgaccccgcagatagacctaaatcggctccatattttccttggagatgtcgacaaccctacggcatccaccgctattatgcggaaccgttccttagggattttgtttcctgtcctaggagtacgtgcccttgaggacccactagttgtcgtcgacattggttcgccttgctgagacatcgtctactttttttcaaaataacaaaaatacacaattgagtgctacaatctattacaatgaattgaatgtcacttataaaaataaatgaaacatataaataaacaaaattgcgcatctcacagtaataaaacgaaccacatttcatctatttactaaattcattaatgcaccacgtataaataaacgaaattgcacatctcacagtaataaaattaaccacatttcacaataatttcattaatgcaccacatttcatcccaaacataaataaaccacattttatcccaacataaaaaaaccacatttcatcccaacataaataaaccacatttcatcccaacatgaaccacattgcatataaataaagttaaatgaaatacatttcatcaatcactacaatcatctatcacaaaattcataaatgcaccacatttcatcccaacatcgacatgtctcactcacagttcaatcacatatcatccacatccacatttcaatgacatgtcattcacagttagcagaggacggcgcgatggagtactcacctgaggatggccggtggggctcggtggcggcggagccgggctcggtggacggcgtcgccggtcggtggaggcggcgtcgggctcggtggaggcagcggtctcggtggcggcggcggcgggctcggcaaaggaggagttcgcggcggcggcggtgggctcggtggagggcggcgccggtcggtggagacgccggtcgggtggcgtcgggctcggtgggggtcggcgacgtgcgtcggtgaggacgcgggcggcgacgatgaggaaggccaacaccggtctggtcggtgtagaggctcggtagtggcggcggcgggctcggtgggggtcgtcggtgaggaggcggcggtggtccgaatggagggccgaggaggctcggtggtggcggacgcgggctcagcgagggaggcggcggccttggcctcggcgtcggtggcaacggcggcaggttcggcgagggaggacgacggcggtggcggcgggctcggtggcgacggcggcaggcttggcgagggaggacgacggcggcgctagggttctaagtaggcaggaaagtgtagcgggacttagaaaaattttcgatccgatctgagaaaccctagttatagtagagtgatgagtcatctcaatcgggctttacggtagggcccgtcacagatgactcatcggtgacgggctccatactaatgcccgattgagatgacattcaggcccgtcacggatgactcatctgtgacgggccctaagataatgcccgatagagatagattaatctctatcgggctttaactaaggcccgtcaccgatgactatttttccatttttccattcaagtctttatatttgtgagtacaaaaatatagctgctgtataataattcattttgttagtcataatacatttttggatagtaaatgatttcaaatcgaaatatggtcaacaacaaaattgtagaggttatcaagatctacaacttttattttggtcatttgtctatataactttgtttccaacagcttgaaattgattttgacaatataataaatctaaatagcatttgtaaatactaaatgatttcaaatggaaatatggtcaaaaacaaagttgatcctctcatcaggatctacaacttttattttggtcatttgtctatataactttgtttctaatagcttgaaattgattttgacaatatgacaaatctaaacagcatttgtaaatactacatgatttcaaatggaaatatggtcaacaacaaagttgatcctctcatcaagatctacaacttttattttagtcacttcttcatccgacaaagtgatagttatactattcacaaaaatcacatttctctcatctggtttatagatatcaacacagatatgtcaattttgtaaacattggtactatcactttgtcggatgaagaagtgaccaaaataaaagttgtagatcttgataatctgtacaagttagctgtttatggcttttccatttgaaatcatttaatatttacaaatgctgtttagatttgtcatattatcaaaatcaatttcaagctgttggaaacaaagttatatagacaaatgatcaaaataaaagttgtagatcttgataagagaatcaacttttttgttgaccatatttccatttgaaatcatttagtaaccgaaaatgtattatgactaataaaatgaattattatacaccagctatatttgttgtactcacaaatataaagacttgtctagaaaaatggaaaaatagtcatcggtgacgggccttagttcaagcccgatagagattaatctatctctatcgggcattatcttagggcccgtcacagatgagtcacccgtcaccgatgagtcatctgtgacgggccctaccgcaaagcccgattgaaatagattaatctctatcggctgtaaactaaggcccatcaccgatgactcattttccatcttttatttgttgtgagtgcaaaatatatagctgatgtgtaataattcattttattagctataatacattttcggatagtaaatgatttcaaatggaaatatggtcaacaacaaagttgtagagcctttcaagatctactagttttattttcgtcatttttctatataatttttttccaacagcttgaaattgattttgacaatatgacaaatctaattaacagcatttgtaaatactaaatggtttcaaattgtaatatggtcaacaacaaagttgatcctctaatcaggatctacaccttttattttggtcatttgtaataaaacaaaattagccatattaatgactacacatatcaagtctttgcaataaaacaaaatacttcattcattacaatagataagtacaaatccatcggtcacaaggttatgccttccgtatgatgtgaacgagcatatgccacaggctcttggggatcatcgtcaaggtcaatgtgaggtcttacatgaagattatggttgtattcttcttcatcgacgacgttgtcaactcctacaattcggcgctttccatccctcacgatgtgcatcttcttgtttgaagggtcttttatgtagaatatctgctcgacctgtttcgcaagtacaaacggttcatcggcgtatcccaccttagatagatctactaaagtgaaaccttccttgtcggctttgacaccagtgcgtagattcacccaacggcagcggaacaaaggaaccttgaacttgacgtagtttagctcccagatctcctcaatgcggccgtagtatgtgtttgacccaacttgatcctggaatgcatttatacggatgccgctgttttgcactgtgcttttgtcatcttgtttgacggtgtaaaatgtgtatccatttatatcgtatccttgccatgtgtctacggtccaagacggtcccattcccaacaactgtaatgtctcatttgggacatccgtggacattgtcacacgattcatgaaccattcgttgaaccgagaattatgttctttgttaatccatgcatcagatcgccccaagttctcatctcggattttcgctaagtgctcctcaaagtatgggccaacttctgccatatgttggagcacagcgtaatgaacctgcgcgtacgacgcttcatcgggcctaattcttttccttccgattgtgccaacacctgacaaccttccctcgtgacgaaacacaggaactccgataggatcggcatcggacatgtaattgacacagaactcaatagcctcctcggtcgtgtaaccttcaatgatgctctcctcgggtttagctctgttacgaacgtatgacttcagaactcccatgtacctttcaaacagccacatttcccttagaaaagctgggccacatagttttgtttgcttcaccagatgaacagggagatgaaccattatatcaatgaaagacagtgggaaaaaatatccaggtgacagagggtattcacaatatcaatctgcagcccatcttgatcttctggatctataaccttctatccaattgcattgaagaaggcgcacagacgttggatcgtgtgacgcactttcggtggtagaatgcctctgatagcaactggcaagatttgtgtgattagcacgtggcaatcgtgagacttcattccaacaagttttagatcgtccaatttaacatacttacttatcctcgctgaatagcccaatggaactttaatatccttcaagcatgataacattgcgatcttctcatccttccacagtgtgtggcaggctgagggaggtacactttacctgtctctgcatctcgtatgggctggagttcactgcgaatattcatgtcctatagatcaaggggcgcgttcaacccatcctttgtcttcccgggaatattcaacatcaggctaaccaaactctcacacacattcttttctaaatgcatgagatcaatgcaatgacggacatcaagatctttccagtaaggtagccgccaaaatatggattttttcttccacataccattctcctttgtctgctacgttttcttttcttcccaaactcattgcttttgtccttgaccatattgtggacctcatcaccggacaaatctttgggagcaggctgaagttctctcttaccgttaaaaattttcttctttcttctaaatgcgtgacgtagcgggagccacctccggtgacccatgtataccatctttcgtgatttcttcagccaccggcttcgtgtatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacaccttctttccaaagaatctctagatcgtcgataacaggctccaggaatacatcgatatcattgccgggttgcctcggaccttggattaacaagcacaacataatatatttctgtttaaagcataaccatggcgggaggttatagttcgcaataagaactggccaagtgctgtgagtactactcatgtcaccgaaaggattcatgccatccgtacatagacatatcctcatgtttctagggtcggcagcaaagtctttgtgttttcgatcgatattcctccattcaatcgaatccgctgggtgtctaagcataccgtcattccttctctccgtggcgtgccaacgtactaacttcgcttcgttcgggttggcaaagattctcttgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgttgggacaagcgtgaattctacggatctctaaccccagtggacacagaacctgctttgcttcgtatgtcgtctcgggcaatgtgttctcaactggaagcatagccttcaaaattcctaaaagatctgtgaaactcttgtctgtccatccactacttgccttcagcttcattaggtccaaggtaactgacaacttagtgtgttttgctttgcatctagcgtacagaggcgtctcggaatcactgaccaacctgctgaacttcattccatctctctcattctgggctgggtcctcaacgtcacgtaacatgtcttgcagcagatcgtgatccacatcaaccatttcacccccaatggagaaggtataaacatgtcatgctcatcttcatcttcctgattatgcgcaccacttctgtctgctgctgctccacttcctcattcttgctctccatgcttcacccaacatgtatagccctccatgaatcctcgttgtatcagatgaccgtgtacgtcctctccgctatcaaacatattctcttgcaatctgcacatggacaacacctgtaatcactgtttcttcttatccgatcctcctccgcggcgttcataaaatttattatgccctttctgtactccgtagaatgacgtttcaaattttttgcatacatccaacttcgatcaattgctacaaaataaaaaaaaacgaattagaggcacatattataagatcagtattgcaaaagtaagatgtgatgaaattgctcaattaatgattaatattactcacttgattgatccattttgatcacttttgggaatttaatttctgttttccttggaaaaatgacaaaaaatcgccccctacagcctcccaccaaaatagtgaacagtggcatacagttacactaggtggtgagggggtatttatacttgcaacaaatatctgtaatggccctacaacaatcaaccgtgacgggcatacaagtaatctctatcgggccttcataaaagcccgtcaaaaaagagtgtcatctgtaacgggcactaaacttatctcaatcgggcctctagttggagcccgtcacagatgaccctcatctgtgacgggtttcttttagggcccgattgagatatggaacccttatctcaattgggcctcaactatagcccatcacagataagtgtcatccgtgacgggctttagttttatgccgatataccatggttgtgcgaccatatctcaatcgggcgaaacttcagcccgattgagattacttcctctgacggcccgcaaattccagtcttgttatgggccgtcacagatggaaggatctgtcggtataaccgtccctgtcctgtcttcggtgattattctcatgatctcggtttttgtcgttgttgtgtcggtcattatgaggcgactgtctcgatcttcattgggggtattccctcggccgtcgtctctttctcaccgcgagggagagcaatgatggtgttgtcggtgcatagtaccgtcctcacgacgagaaggggagtgatggctgttgatggtcgttatcgatcagtttcgaccgtcaatattaccaaaatagagtagaactagtaatgcttgcaatgcataactatgtaagaataacaatattccactagtattaggtttactaaccttttgcagagaataaccataaagtagaggagaatcgatatcaactcaaacgataaatcagtcggacgatgtcaagaatcagacttatgtatgaatgggccaagaactcagaaatgacacgatcaattgggccaaaattcacaagtttgcagagaagaataatagaggaggccgccagccaaaccatgggatggttgggccagccccaggttcagccgaacctccctcatcgctgctggatgcagggtttcttctggacagtgtggattagctccaaatgatggttggagggtagttccgaccattccaaccgtcacaaccgtcattgggaggctatataaacccctcaccttctcacttcactcacaaacctcaagcaagagctctctcatttctctcaagtttagttcagtagtatctagctggtggaataggaatagagtagaaatcaggagtccggaagtcttcggaagagtttgggtatggctctagtggcttttctcttctcttttgtaagctttgtacttttattagaatactcttctgtatacatttatggtattgaaatactttccgagtatatgaatgcctactttacattatattcatgttatactgaatatacggctagcttaactgggagatgctttggtgcgggtataatgtttgcttatgcaattactctatgtcatgacgatgatattagagtagtatctggtagtttagacgtggtgtctagattacgggatatcattatttggggttatatgctgcggttgagaggtgggccgctgatgatgacagctcagtatggatattcctccaggcctatatagaatcctaagttaattctctagggagggtatggttgtatggtcatgatgggctgtcgtaaggaagtcgtcagtcaggggtggcttctcaaagtaccaggagggcatcggatagagggtattatctagtatatcggttaactagaatatatgtatactatatatattagaagtataggaatagattatctttctcttttctttccacttagcttagataatatattatgagaatgagtggctaatgcttgtgtgtcactctacccttagattatcttaacccctgcttaataatataattatcacaagtagcatataaattattagtcaagttctctctacatgatcttcccacgggataaaataaatacgatacccttggaatactctcgggtgaaatgctacaatggtatatctgtgcgcttgcggataaactctgtagccataatataccaggagtatttctgcgccattgctgggaattatatttctagtaatgtcgttaagaaataccaacaagcatttctggcaccgttgccggggaagattcataatagagattacctgaactaatattttatatttacctctgtataatcattttcctttgcaggctaaccttgattgtttttacttttgttgtgaaaactgggtagtgcatgactggtttcaacttgccggagaacttcaaagaaaatccagaagctttcttccagagcgtcaggccgcgagtcgttgctccacagaaaactctaccgacaaagaaaccagccgtaccagcgcaaccaaccttcaagactatggctgacaagacccttcgcgagttcgctgctctctctgctaacaatatggccattgggccgcaaatcaacatgggagacatggatttcaacttgaagtccaacctcatcacgatggcgcaggctagcccattctatggcaagcctaacgaggatgccaatgctcatctgcagcagttcttggagatctgtagcacgtacaccatcaagggcgtcagtccagacgccgttaggctaaggctgtttcctttctcccttctcgggagagcgaagtagtggttctatggcaaccgtgctgctgccaacacctgggatggacgactgcaggagtatgtggccacctgtcctcatcatgggatggacgactggctgatcctgcagaacttttacaatggactcaccccgatgtcccgcgatcgcctggatgcggcagctagaggagcattcttctctaaaacggttcgaggagccattgatttaatagagaagatggtcttcaatatgggttggagcgaggaacgactccagacccgtcagcgaggcatgcacaccgtcaaggagacggaactgcttgctgccaagctggacctcctaatgaaacgattggacgaccacgacaaacggctacaaggcaccatcaaggctttggactcacacgttacgtgtgaggtctgcagcaacacgggtcactctaggaatgactgctcggaaacccgtgaggaggcgatatacatgggcaacaacaacaacggtactgtccacaaggagatctggggtgaaaacaaccacgcccatattatcaaggaggtaacaacaacggtaacttttctaaccagccctccttgatggatctattctttgtggaagctaaaaccactgatgcactaagcaaaaagcttgcggccaatgacaagatcctagagaacataaatgttaagttagatggcttcgcttctgctttccaaaactagctgagcttcaataaaatgatagaaacctagctagctcagttagcatccttagtccctacaaatgaaactgggaggattccggggcaacctgactcctccgttgagaatgtcaaggcgatcacgacgaggggaggtaagtccactcgtgatccgccgtatcctaaccctgcaggaactaacgggattgcaaaagaagcgccatctagtgactcggctgacaaggaagttcagccagagaagaccatgctgcaggagtactgtgacacacgattgctaccgtttcctcaacggagtaggaaaccgtcagttgacgaacaattcgctcgttttgttgaagtaattcagaaaatccacatcaatgtgctgctgttggacgctatggaagtgccaacatatgcccgttatctcaaggacatactcaacaacaagagaccgctcctaacaacggaggtggttaagctgacagagcaatgcagcaacgtcatactccacaagctcccggagaagaagaaggatccgaggtgtcctacaatcacctgctcgatcggggcacaacagttcgaccaggtcttgcacgatcttggagccagtgtcagcatcataccaaaggacgtctttgacaagctcaacttcacggtgttggcatcgacaccgatgcgcctacaactggctgactcatcagtccgttacccggcagggatagcgaagatgtgccagttaagatacgggatttcttcatcctggttgatttcatggtgttggatatgggcacagcaaaggagacgccactcatcctagggcgcccgttccttagcaccgcgggagccaacattgacgtgggaacagggagtatccgtttccatatcaacgggaaggaggaaaagtttgagtttcaaccgaggacggaacaatgctccatggtcagaataaagtacggggcgaacccacagaaaattcaagtggtcgaagtggagccacccaagacggatagcctggtgaagttcatgcaaaatttcctggataaggaaacaacgatgcccatgaaccgttattggaggacgccggtaaaaccaaccataccggccaagaagcaagagcagccgactcagaggaagacgtcttccgcacctaagacaaggaaggtgtggaaggaaaagccaaagacgcctgctccatcacctccggagacggatggaaaatccacgaactgaatcagaagaaggtacaatcttgcacgtcggactttaaatgacgtgacctttgtcaacaggtacattggtatgtatccgcatatttattttcaacaatttaattcttgcatcaacacatgtttgaatttcaaaattgtatttatgatttttgaattttgaggaaattcttcagatgaatttttcagagaaagccaaaataaagttttcaacgaaaatttactgttccacgatcacattgaccgttggaatccaacggtcgaaagtggggctggttgagcccactaggggtggttcggccgaaccggccaggcaacgattacgtgccacttttggcagggtaactgctagtgggtcccacatgtcatttatgaccgttgtgggtaccctataaaagccagccgaccgagagaggaaattcaaccccatttcaacacattttcatttcctcttcaaaatttgctctcaagttcattgaagctttgatagtttccctcaaattcaaacactaattgcatatatacaagttgctttggtgaaactaaccggcaggtgaaactcttgctattctaacccccatcgagttagtctgttcttgctccattgtgcagaatgaggaggcgattgtctcatctgttcaaggggtccggctcttcatcaagtcatcatgacgagtctagtactcgttcatcagctgatatctcgatggaagacgccgaagctccgcgatgactcatgaatggcaccgacctcggccttgttggtgatcgggaaagacaagcctactacatgccgagcgaccgggagtatgctcacacacgagaatactctccggagctgctgaaaaagataggtatagatgttgaatttcgtgctatttggaaagttgttggttggcagagatttgttgtggtagatgagcctggttctcgtttgcttactttgcaatttctgtgcactttgaaagaaatagaagatgtaatttcctttcgctttttccataaggagtatacacttacatggaaaggcttaagcacacatcttggttttcacgattcctgtaaaatcgatcttcagaaaggaatttctgggttcgagaaaaataggttttgggaagatatttctggtgctctaatttgcaagaaacctaggacgaatgatatccataatgctacacttaggctcatgcataaatggattgctatgactttgttttctagaggtgatcttagacccattaggggggatgaattgattatgatgtttgccatggttagaaagatcaaaattgctcctgtgaaataaacacaataatggcaacaatttgctgatgctcagttcgcaaacttcaacaacataatgcagcaacagcacgatgaccttcaagcgtacttccgcttccaggggttcaatccttaccaaggaccctgagcgaaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6277 - DNA, 302 bp, Oryza sativa
aatggcagctaacaggcctcccatgtaggcatgccatctcttttattggatccctgagagaagtggagctagaagactatgtcagcccctactattcagtggccatgttcagggttgcctattccacagttgtgcctccaatgccagacaagagcctatgggagaaagtggacacaggattcaagatgtggccaccaatactgaagagatcagctggaagacctagaacaaggaggttcattggtgttgaagaaggtggttcaggaaagaaaagaaggagatgcaaggggtgccatggcttt

SEQ ID NO: 6278 - DNA, 1764 bp, Oryza sativa
atgagcacacagcttatcaaatgacaaactcgatttcaactcaaaccctagaaaaattggggattgcaaagaacaacttacatattgtccggtgaggcatcgataaaacttgcggttgaaattctctttccttcttgcatgtccgctccactaccgttgaatcgcccttgcagaatggacatttcacaagaggcaactcactgacctgtgaatcacgccgaacccgagaggaagaagcacgtgagaaagaagaagcggaagacatcgtcgctgccaacgagctccctcccctctacgtctaccaaagggaccacgccgacttcaagcggtcgccgcctttgacgaagacgatcctcgccgccgccgtccagctacaatgccagattcactggtactgcttgcgaatggagccaaactgagtggataagaggagataaggcgcaggggtatttacgtccgaccgcgtcaaaaaacagcctcccgtcagccacgtcagcatggcaagtctacgctagacggcgcagtgtccatcagcaaataaccacgattatgggatgtctttccccaaagcttcactttcgcggtgtccctgatctaaatacacataatcgcgatgtcctgtagcaaaatttgccttttttttgttcggtttgatatttattactccctccatcctaaaatataaacatttttagagccaaaagttgttatattttaggacagaggatcactacaccctgtgactttagaataatttagttcagtttgtttttatatttcctagaataacttagatttgtaccaatgctaggatttgtaggcaatcctataaaaggcaaaatttgtcgtagtacattcggcgaagaaacatcaagtttgaggaaaaggtctacatgcataagagaaaataatttgaagtttatttcgcaacatagtaatgttcagatggtgcgaaacgccacgacaaccgtgttccttcaacattttcatttatttttgaaaatgtcccacggctaaattcaccttgcgacttaactgaaaaatctcagcacttggcataccccgtagtcaatatcataaacacaccgtaggaacatcatgaaaataatgattctaaagtcaaacgcaaaggttaaattggctcgagaaccaccatttgaatatttgatagacaaaaatctggtgcttgttgatcatctcctacagaattgcgcataaagtgaacagaaaggctacatttgacaaaatttcatgtgaagtttacacatggtttctgaaactgacaagatcatgtcatcagggtcaatattcaagagatggcctgcttatttcacccaatagataaagtgctcagctagattatagatcaaaactatgaatgctgaggtttcacagatctgagttacggattactacttcatgcttttggtgctgatgactgtccagaagaaagtctctccgacctcgccttgttagctttttccatgtaatcttggtgagattgatgctttgtccctgcaggatatgcattgcataatcaattaatcaactggtattcatgtaccaaaaatagtattcagaaacttcggtaattaagggctacttcaacaaaaatcaacatgcattctgaaacaaaaatcagcactaatcatatctgatttttaatgagaaacactttgatcactctgacaatgcagaaatgtgtgttacaaatagctaacagtttagtgcataacaccacttcgaaaaagggacaaaatcaat

SEQ ID NO: 6279 - DNA, 1652 bp, Oryza sativa
ctggtgagacaaacacgtcatctcacgggtgaatccattcattgatagtgtggttttgtaaaactacactaataaaatatatgtacttatagtgttaaagtgtgtgtggttttctacaacttggaccataaaatgtgtagttttgtgaaatttactctatttttaaattcgaatccacatcaatttaccgtttcctgggcctttaatgtgctgtgtttgtgttgtgtttcatctctagatacatattacacacgatttttccgtctcacggatcgatttgtccatacactggagttgctgtaagtgctatacttggatttatagatggccataatgtccgatgtccgacggcccagcccacggcacgatattttagcccggcccatgaccgccgggccatgcatgggcctccccaccggcacgttgggccggtccggcatgactgggccagcatggcacaatgggtcggcaggccggacccgacacataaacaatagggagtaaaattgacatattatatgtcacggtccaaagaatgagatgaaaaatagatttattttagctatatacgtgtcagcccaaagagaagagagggaaaatagacttattttagctatatatatgtcacagcccaaagaggagatggaaaataggtttattttaagaaggcacgatgggccacacgttccttcgggccggcactgcacggcctgacagctgatgggtcgtgcctaggctggaggtgcagaccatgagctggcacggcctagcacgaagtgccgatcgggccgtgacgacccgattgctggtggaccgtgcctagccgtgtctgggccgggccgtgccaggcgggtcttatagtcatctatactgggattcgatttcacacgcgagggaaacctattcgcgcgcatgagggatgtatatagaaatatcacgttatatatccgatcagttcccattaaaaaaaggtaatatatccgatcagtttccataaaaaaattatatatatccgtaaagaaaaaagtatatacccgtgcagctacatctcgccttctgtttggcatggggaagagaagacgaccacagacaacgtcgacgcatcaccggtactacctccgccgccgccacggcggcgacctgatcagcgagctcaacgacgacgtcctcgcgcacgtcctcggcctcctgcccaacgccaccgacgtggcgcgcgcgtgcgccgtgtcgcggcggtggcgttgcctccgggcgcgcgttcccagcctgcgcttctctctatctcatctaattaacccatcaggcgacgtgaagcggcaggaggatgtcgaacggttcgtcgccttcgtcaaccgcgtccacgccacgcgccgcgccggcgttgagcagctcacgatctccatcgagctgcacgagggctgctgcgcccgggccgtgccggccgtccacggcgcacacgccaacgcgtggattcggtacgccatggaacagcaaggggtgagatcgttcgccctgaaactcgaccagcccaacctgctgccactgcctgaacagcgacggtcctacgacttcgacgaagacgccgacggtttggtcctggacgagctccctagctcgacgatgctggagtccatggcccactgacctaccta

SEQ ID NO: 6280 - DNA, 3785 bp, Oryza sativa
ccgttggaggtgttctaatgtttgttgcctgtataaaaccttgaacgtgggagacggaatgtcctcttgcaagttgcaattttgtatgctgtacaaatatatttggttaagatcttgtttggttaatcccgaccacaagagaatcaagaggaatttgtatgggatttattcaatacctatttggttaatccatttaatcactcctttagtattaacctaacaagcctaacgcctaaggcctaagaagaaatacaatgctagccaggtaaaatatcatgctaaatcagtttgcccaaaaatcatgttattgcaataaacaatattctaccatttttttttgaagcgatgggtctgttcatatgatgcgactacacaatcatttacaaatatattgaaaaaatggatggcattttgcctaagaaggaaaagaagcaactgtttctacgagaaaaactacatatagaacataaacaatttactagtatgagatttattgttccaaaatgcaaacatgaatggaaaaaagcctggaattacttaagtgtgtgtttagtttggggatgaagtttgatggattaggttcgtcctatttctattttttttgggattggatgattccatctacatctacgtgcttgacataaaggttataatgatcctacttttttaagggttggaaggatgtggtccatacatcaatgagagagaaaattagttggattggtccatctgtgtttggttcacggtcatgcatggataggatatggccatccatattttgttggatatagcgatctaattttttgtttggtttgtatggatatggcgatccgatttcttgtttggtcggagggatatagcatggatggaaaaagccaaaagttagtgggacccatttgtcatatatatttttttatcaaaatataatcattcgagatcttgttttaaagatttaattgtaacaaatataatggtgtaatcaaatcataaattagataaacagtttaggagaaaaaaaatcatttggagcttacttaacagaaaatcaaaccaacaacagccaatcagaataggacacatcacccagaccaaaactggatggattcatctagccaaatcggcctgatgcactcatccagcatattgagggaatattccctattctgggccgcctcatccaccctgccctccaatcaaacactacaaaaaaccggacggccatctcctatccagtctcatccacccaaccaaacacaccctatctagagagaatatttcattctagagatcatgacttcttacctatcttcaagctaaacaccctgaaaagttctccccatctagacctattccattcctccaatcaaacacatgctaacattcactctgagtctagcttgggtgatgccattgctaactccatgatgccttatcataccatatgttcctatcatgataatagaaaaaatgattgaagagattcacctattgacattccgaacttcgtaaagcacatctagtactcctacttagggtttagggtatcactcagaaccacatattaaaggctagcaaaaaaaattaccacttatttctgaattgttttatttggttgtcttggagacaaaattttgggatagagttttggatatcttttaggttgagttttttttatttcactttcctaactccacctcccgaacgcagaattagtgatgctctgagaccaatgtgttaggttagtactaaagtggaaccaatcccttattttgaaactttagattactaaagttgctgagagcatcactagcagtaccctactccgtctccgatcctattttttttcaggatttttgatgaaaaaactgcttcaactgttccctacgcttcctctcaaaaatcagtactccattctacttcactctcgctctccaaaagttgggaatcgttctcgctcccaatttccgtcacttgagtgagaatgccatccgagaaaaggggtaagcggaagggcgttgacactagatgatatgatcttgataagttgcgggtaaagggaggcatacctttttatttttatattttagggagttaaatataagccatctattggaaggaagtatatacctatacaagttatccccacctactaatctcctgcactgtggttgctccacgtcatcaagttgatcacacccattcgatcataagagacatcttgaccatactctcacaatggccaattacagtactactaggggcagtagaataaaaaccacttcaaacaaaacgccaggcaaaaaaaaaaaaacaccaattctcaagagtggattttaaactctagagggaacatgtatatcactcgaataattatgaaaaaatttcaaaacaattaagaaattgtattaacatgtagtataccactccaaaagcatgcaagttataatttaacttttataagtaaaacacatataaaagagtagcaaattaactacaactagttaacatatattcacattaaatttatttttttcgttgcaacatataaaaaattaaatttaactttacatgtttatgaagttataattattttcataactaagtgtcatacaaataacgagatgacgtctcgagttcttcctgcagccaggttttgaaatttcggttcgaaatttccgaaattttgcccccccccccccccgaaatgctcacatctcgtccgaaattttcggttttttgcaatttttttgtgtatttggtcaaaattttatttaaaatcagcaaaatttcaaaaatttcgtaaaaaaaatccgaaatcggttctttcgcccacctgcagcagaaatcttgggctgtgtttagatacaaacaactttcagctttgaaaagaactaaacacagccttagtttggaaccctgcctgctgcaaaattataatatatgtttcgaaatttcaaacccagcctgttgtcgtcctgtactgtactcctgtgcattgtctggatgggcaactttttcatagcgaggcgagtcgtcgtgtgcgtgcgtgtgctggctcgtctcgtcttgttcggacatgacaagaacagaactgaccaaaaatggactggacgcatcagatgagggaggtccgagtatgcaggcggctgttatgcaaacagcctaacagcttaaacaaaatgctggaaacactgttgcttggcttggattttgctaaacatatgttatgattttgctacacacttcgtccttgttcattttgatttgttgtaatttgagaccgtaaggcgattaatcaggacgggaagaaaaaccactgaaccataaaagaccagactaaaaccagatcttgatgcaaccaggttcatcagatagattcatcattcatttataatttataaatttacccccattcttctacgggaaatttaactatttgccactcttgtgacatgtcaattaacgatttaccacaccttgtcaatgacatgtgggccctcatgtgtttatgacacgtgggctagtggcaaatcgttaagcaccactcgtaagagtggtaaatagttaaaagccccttcttctacagacagaagaagcactttcttcttgagctctcatacagcaaccaaatctagacaaaatcaaagaatccccaaatcctccccccaagttcctaaagccccaagcgaacgccatcttctcagaacccggccaccgccgcgccgaggagggcggcggcaacgagcacggcgccgctcgccacggtcctcccagcgttcccagtc

SEQ ID NO: 6281 - DNA, 2583 bp, Oryza sativa
cccgtgccgcagtggttgtagtcgtcccgcgtcacctccagcaccgcgtccgccgcgccgtcgaacttgaacactgcgccagcccaaccagagaaggagaagaaatcagaacaaatcaagaaacagaggaatccaagaaacactgaggaaggaatcgagctttgttgactcaccgaggttgtcgccgatgtggaagcgggtggcctcggcccacctgttgagcgcgtcgggatgcgccggcaccttccacccgccgccgttgttgccgccgaccacgaggtccctggcgttcgccacggccacggccgccgcgaaggccagcgcggcgcagagcacggtagccaacaccttcgccatcgaagtagggtgggaggactagcaaaagtagaacacgagagcacgagaggagggaaacaggggaacgaggaggaggagatgatgctgtggcggccatgggaggcggatataaatagggtggtggagtggaggtagccgttggggtattcgaacgttcgggaggggaggcagtagagtagcatcgggtgccgcgaagacgcgtggcgacagcattcactggcattgggatgggatgggatgggatgggatgggatgggaggagtggcaggctgttgctggcttgctgctgctgcttctcagcactgggaaaggatgcttctgttttggaccttaccgttgctgttttggccttttgaggaggcactgggctggatgggatggcactgttctggtgtagggctgtcacctatggcccgtggggctggggaggcttgggaccagtggagtggggtccacagggaagtgagtgagaattgtgtgaaccttggagttaatattcctcctggaagaagtgtttgtgttgtggcaataaaattatcattttttttaaaaaaaaagtcacatgaatcgagtggactgttgggttcagcctcgttatcaaaaccctcaccaaattagaccctgtttagatgggactaaaacttttgttcctatcacatcggatgtttggacactaattataaatattaaacgtagactattaataaaatacatccataatcttggactaattcgcgagacgaatctattaagcctaattaatccatgactagcctatgtgatgctacagtaaacattctctaattatggattaattaggctttaaaattttgtctcataaattagctttcatttatgtaattagttttgtaagtagtctatatttaatactttaaattagtgtttaaatagagagactaaagttaagtccctggatccaaacaccaccttaatctacgtcacgtcaacctatgtgatcctgaacaattaagacatgtttgatagagttctaactctaaaaattaagtctttctaaatcaagcttcacctcttgagtttattttgtgagagcactttagtccactctatttttttttattgttggagctaaaactttttgtttggacttccaactttagaagagatggagttggagctgaagatccaaacatgcccttgatttggtttgattttgcttgtagatgatcaaggcgtcgatgttggatgagatcatcgatcggctacgtcaagttcttgctagaggcggaaatttccctgttggggtcggagacccaccctaagggccgggatcgggggataagggggtgttcagttgggactaaaactttttagcccatgtcacatcggatgtttggacgctaatttagagtattaaacatagactaataaaaaaaactaatttcataaatgagagctaatccgcgagacgatttttttaagcctaattaatccataattatcaaaactttactgtagcatcacattgtcaaaatcatggcgtaattagattcaaaagattcgtctcgcgaattagtctaagcttatgaaatgggttttataattaatgtatgtttaatactccaaattagtgtccaaatatccgatgtgacaggtacttggaataagtcctggaaaccaaacagccccctaattatcacccgtgggtgaacgggggcgagccgaccgcacccttcatctcccaccaatcgctattattgcctgtgagtgaggcacgctgtgcgggccccagtggtgcgggtcatcaaagaggccagggacgaggcccgggttcatctcttctagtaggatggggccgggtggactcgcagggggagcagggtggacccgcacctgtctcgcccccttgccatacctagttcttgcagctcatcgattgtgcgttttgatttgagctcagctgatgctgatggcagctaaggatcgattagacgtgtcatagtgactgctttgacactgcaggatcagcaaccagtggcgaatccatgatttacatcaagatggggctaaagcaaactagatatatcagcacgatcagcatttctctatgaaacccaaatacactacgataaacaaagagataatccatgaaatgctattgacaaacatctaagtcccagaaataccatcgacaagtgtgagttctaagaaatgccatcgtacaaatgtttttgtcccaaaaatgcc

SEQ ID NO: 6282 - DNA, 12618 bp, Oryza sativa
cttggaactcacacttatcgatggcatttccgggacttagacgcttgtcaatagcatttcatggattatctcataaacacaagacgttgtcttcttcatcgtaatttgcactgtattaacatctatccaaaaaatttatgaataaaatgatatggtatactccttccgttccataaaaactaacgtaatactggatgtgacacattctagtacagtactacaaatttgaacattcattgtactagaatatgtcacatctagcccgagcactacttaaaaaaggcaaatagatgtcgccactataggtgccggcacacaaaacaccgacacctttatgtccaaatatgtgccggtttttaaataaaaccgacaactaaaacctatgtcagagaaatgtgccggttctagacccaaaaccggcacctttaatcttctccctcccccactagccgttggcgggccccatacataggtgccggttctcaacccaaaaccggcacctttgtttcaatagtgcttttatgaacgacggtgggccctacacaagggtaccggttcttggtatgacaagacaaaggtgtcggttctcgaccaaaaaccggcacctttaatattctccctcccacactagctgctatgtcacatcctgattttcgttttaggatttataaattatttaataaattattattagaatttatattaaatgttcattaatttacaagtgaagttaaatataggaaataaaattttctaaatataaatcatggcgggatttaatttttatttaattctccatgattaattatactccctgaaattttctcagatttttcggagctcaattcctaattttaataatataaagaacatttcagtaattatccacatattaaattaatcattaaatggtcttattataatcttgttaagtactttgggtgtccaagtattttcaggatttttcttgaaattatttgagcattggaagtatttttaacaattcaaagatcatttcagtgattaatttaattggaaaagtaattaaaatccctttttcttttcaggctgaaactggaaaagttcacctttagtcctcggctcattctcccttcctttcggctggcctgatccctcctccaaagtccatttttggtccctccttcaatccggcctagtaaaggaagctcacagagaaagtctaccttacgtccctagtactgttcatcttcaacccctggctgccaaactgagaccgagttggctcggtttttctcctccgaatccggccttatctctcgtgcattcctaaaattagttgaggggaaatattcctcttatcctcctctatctcttccaccaaaaatccgactttatccctttgaattcgacgcgaatttggattcgttttcgagtttatctctccaccaaaccctaggttttcccggcgcgattctttgcgttccaagcctgatctctctctcccgtggctataaatagtgtcccctccctctcctctttcggccgccacctctccctctctccaccgtcgcttgtagcgccgtcgccgcgttcgtcttctctctccgccgccggcagccgctccagccgccgtttgccgccgcctcagccgacgccctcctgtgccaccacatctctcggctccgcaaggtcaagagcaagcccagcagctggttcccttgcgccgaagaccccgggaagcccgtcgtcgccatcaacccgaagtccattggattcgcagctgcgaagtgaagcccggccacccttccattgtcgccgaaggtcgccgaaacgccgtcgccaccgtggacagtacctcgtcgccttttggagcttgtcgccggccatctcccgtcgctgtttctcgttgccgccaccacaggtgagttcgctgtgtcctcctattccttcctgtgccctttgtttccgttggagcatcaccgttggtcgtcgccgctgttgtccagagtcgccggccgtcttccgtcgctgtccgtcatcacgtaagggttggtaagaatcgccgtcgcctcctctacctcccggtgccctctgtttgcattattgtgtcgtggttcgccggcaaccgccgctcttatgtcgttcaccggtgtagtttatccctagggtcttaatccaatataatctaatccgtggttggtctagcgttgtcatctccgtgtgttgctgctggaacgttgtcatcatcccttcgtctccgatcactttggttcggtgagacttctatccgttctctcttttcaatggcatattatttctttttactatatgtcatctaccaaatataatctaatctttttcaaaggttgttttaatcttttctctcagttataaatcatttgtaaatggtttaattaatttggaatagtattttctttaataggtttaattggaattcatctaaaattatctaaaatcatgatctacatgtttgtttacttttatgtactgtttatttggtttttattagtcttttttcccattttgcgtgttagcttgttgtttccgtcgttgcgaaaggttcgcgagtgcgtcggaagtggttctgaagactaattgaagaccgattattgcaaggcaagtcacacagatcctaaacacagttcctttgagcatgttgatcctatatttaaattctctatttatttcaactgtgtatttatttcaactgtgaacatattcctttgtaatggccaattcgcattgattactctattccttgttaccttgggtaataaattgattagcttgaaccttatatattggtttggttcagctaaaagctatatatatatatatatatatatatatatatatatatatatatatatatatatataattgcttagccatgcctagaaacattagctcattaatgggatgaatcatactacattattatttatggttatatttaatggtagctcatgatggttaatcgtgttatgataattaattgataattaaaacttggcaaagggcggttgtgagcacatggttttgaaggtcgtgctcataacaattaaggaccggttcgcgagctactgttatgagacattaaccgtgccaaccacaagccagcgtgggcaacggctttaccttttgtatagcatgattcattgcggggcaccagactgagaagcggcgagaagtccgtgggggtcgctggggagtccatgcctctggttattgagggggtgattatgatccaggaatggtgcactgtgatgagttgttgtgcgaagggtactgtcacaattccgtttcgaggtaccgtggtggtactgagagcatggtgacatgttttggggctgtatcttgtgggtacaatggtacacctctggccagagtaaaactattcgaatagccgtgcccgcggtcatgggcgggttgagcaatgtttttcgtgattagtctcacacctctcacaataattattgatgctataattggtaataatttgtttagctcctggtttggagttagatctgtacaactggatatggttgttcagaatggttgggcctgagcagcatgggtgtgctgttcagtgttgattaaaattgattaattactctattgttttacattctcaatatttttgctaaatgctgcttttgcaaatgagcctatattatgccatcctttggtatccttgtgcacatatttactgtgcggcttgcggagtatgtcatatgctcaccttgcaataatcaatcaaccttagttgaagaaaaatgatccagaagaataagacgtttggcttataccccagttgagctgcctgtgtgagtggagctgaagccatcgctagaccgttaattccgctgttgttttcatttcttttataagtatgtaacgatattattatgatggatttgtatattaaattgtcagtttgtgtacctcggctgattcctggacgagagttttatgcacaaataagtttggaaattactagtgaatttccgggcgtgacacgctatgacaagacaaaggtgccggtttttggtctagaaccggcaccttttgttccaatagtgctttttatgctccacacaaagatgccggttgggaagacaaaggtaccggtttttggtctagaaccggtacatttgttccaatagtgcttttcatgcccaacacaaagatgccggttaggaagacaaaggtgccggttttgggtctaaaccgacacctttgttccgacaatagtacttatactccatcccatgccactcgagctgattgagcaagaagagagcggcacctctcgttcttgcccgatcagctagaggaggggaggaggttttgctctttttttttttgtgtttggttaaagattgaagcctaaaggtaaatattcattatgaatgcgaattatatgcaaatgtctagaatttacacttacaagcaaatgtctagaatttacacttacaattttttggacttacgaatttgacttgtgaatttctgagatgttgtagagctcaagcgatttagtcaagtctcctgggatgtgtaacacatctggtcatcgccttcgtgtggtttgacgggcacgtctcaggctgaagttgactggtgcgctgagtctcagcaatatctcatttgctctttactcgaggatatgaatgtgaattatatgcaaatgtctagaatttacacttacaattgtctggacttttgaattttagacttgtgaatttctcacctaaggatatatgtgcaaattaatgttcacaatttaggccgagttcgttaggactggttgggaacaagtatcctatgcacggaaaatagagcggtctattagcgcatgattacttaagtattaactatttttttcttcaaaaatagatcaatatgacttctttaagttacttccgtatagaaactttttacaaaaaaaatgtatcgtttaaccgtttgaaaaacgtgtgcatggaacacgagagataggagttgggaaaacttgctgccggacacagccttagacttaagaatttttggacttaaaaattttagacttacaatcttttgacttaggaattttaaactaggcacattttgagttagtttatatatgcaaatgtttaggatttaaagataagaattttttgacttacgaattttgacttaggctagtaggtttttatatgttatgaacttgtgatgaatggcttgtaggtttttatttgttgtgatgaatgtgaatgtgaatgaatgtgctgtatggatgtggggctctagggatgaatttgggtttatatggaattggggttgtgtggatgaatttactgcaattttttttgacccaataaataggtgccggctttaaactaaaaaccggcacctattttaacagccacgtggcaatttggcttagaatttgtgatgcatgtttgtctattattgtaaataactttcagtgattaatatatttgctaggaagttgtaagttatatatagtctttcagaaacactacatactgaaaagagaacgaacgtaatgattattgaaaaactgatttagctaaggaacactcctgttactgctcatgatagaagtacttgatcacatatgggtataacatgcaaagagccatagcatatacttattgggatggtagcatgtaaaagtgccaaccctttctacggtgactactgaagctagctagttataattagttatcaccaatcaatgcatcctgattgaggatagaaaaaattaaacatcgattaacttgcttgtagctactggccaagtgagtaagtgtattccattttccatgtaactctgtccacagcaacaatgagcatgcatgcgaaccgaacaaaatctgcattttcagtacaacacaaatgttaatgagaggaaaaactcgaaggaatgaattaattgtgttatgcacaaaaaaataggaagctgaaccttgaaattatagctgcaaaaaaaaatgccccctattacttatcgcatttgccctgttcaaaagtatcagttattccataagtacgagccttgaaataatggctttgtttcataatacctttttgtttaagtagttctaggaacagaaatcgaaacgggtgattagcatatgattaattaagtattaactataatatattttatttacgaaacatatcatttagaaattcgaaaagcgtgatcaaattaaatgataaagtcaccaagtccaaccgtagtatagagcacagagttagctagtatgaccagacattgagaggcaatagatatattgagcccagtgaataactccaacagaaatataaagtagccaagcaaatgatcctctaaatgtacaaatcataacaaatatgttagattagcataaagttctaaaaggctgcagcaaaatggggatttgaaaagagaaatgggactgacacaatccaagtgaggaggtttcattctctaacaaccatatacaatgagttgctttatgatggagagtatcagtcgaaccatgatctaattgatttaaaaataaaatggaaacacatttcatgataagaccaactgtagaatatactctcaaaatttagaattgaaagagctcccctaaaaaatagttagaaagagtttgtccctcttcatgtcattttaaaagaaaaatgtaattgtcattattttaagtcgaactaactttcttttaattatgattttagatttgtgtagcaaccacctgaaatgatggcgattgcactggttatgctaggatttctactattatctggatatgtcacgggattatccaattatctttagattcattgtgaaggcaaaaactacacaccagacaatatatacaagcgaaacatgcaatttttatcaatgacactgccacttaaggtctcatctatcctagatttgtttgcaatgatcatggccaatagcacaaaagaggagatataagcagttggatggtgtcgtgctgatattagtagtactacagacaatagttgtgttatgtatgcaatacggaacgtgcaaatagtttgagcttcaaagatggaagctaccatcttttacgacttgtgtgggcttagaatttcttgtcacactattcatttcaatatttctaaaaatatagacaagatagcaatactttgcgacccattttccttttagaacccataatataactatattgttctattacttatttttgccttgacaagtaaggcaactaacttgtctataaagtttgtcacatgaaggaaaaatctcatagcaaatggctacaactacaccatatatggccttgctgagtgctcatctgaggtcacaagttttgaatgccagatttgttttgaggatcttaaccaggccataagggaaaaggtggaagaacgtcaacaatttggtataatttttcatgacaatcgggctaaatgcttgtgcggattagagtatactcagtggggggccttggccctctacatcgcgtgggggcaaatgcccctatcatttttatgtatacattaacctattctaactaagttgtagactgtcgacccccactcattttgcttcctgcatttgcccctatccaaaaggaaaaaaaaaccccaataagtaggtacggaccctaaggccccgttagatctcaacatggagataaattttggattcacgcaaaatgagaaaccttattagcacatgattaattaattaactattataaatttaaaaaatggatttatttgcttttttaaatcaacttctagaaactttttttttaaaaagcatcatttaacagtttgaaaagcatgctaacggaaaacgaggaagttgaaattggagttgaagaaatagaacagagcctaagtctttatatgttcaacagtacctttcgccaaaaggctataaaactaatccacgtgatttctaaaggaactcccattttttcctaaataaatttgctcctactagataaaacaaaaacaaatcaaatccctacatcatttcatatctggtacatatttttccaattaaaaaattattggagcacacattagaccaaactcgctcaatttcataggcttgcacaaagactatggtccatggacaagacgacacggtgaaaggcaggtgatgctcgcccgccatggaccatgtgtcggtaaaggggaagcaaggggcttggcactgaaggaccaaaaccgctggcgaagggtgattgacggcttcgtcatgatgggctgtgcgaggccatttgaagctacaaggagcccacatcgatctttgaagaatatatgatgaaatggttttggtgttggcatcccttaagacaaataaaggaagatggcatgaagacattcctattggtataattattttcctatttatatttgaggatagaatgccatactattaagaggtatgcaacgtcgatgtgtttttgtatgtctcggtgcttaaagtgacctatttgagagaaacccattaacctatcctttgagtgattttggaccttctttttggttgagttgggtaatcctctgagtgagctttccataaagtctaagatcgtaaaaaatggacttccgatcaaaaagttatggccattttgctctctggtgtttttcagaatgtccaaaaatattttgaaaagaccaaaaattttcgaaaattccgaaaatggctgcaaaactaagattgttttctgttgatgcatttcggcacatccaaaaaaggaatctttgccagaaacgactagttttcaggggctctggtatataaactcctccacccctccattagtgatggctattcttgagtttgaaacatatctatccgaagtcacataccccctctctaatcccctagctaagtggtagatctttgtgagtgagatttgagaagagaagggagttgggttgagaaaaggattgggaagagaagctaagagctagtgagtttcacttcatactttgagcactcaagttcatacttcgtagcaagcaattcttcgatctccatctacatatgtgccttgttatgttaaacagtaatatactaatcaggaatgagaataatttagtgaattaaaaattatacattgagattatgcttggtggatcttcagaataacaatagctgtgcattgatgaaatcaagtttacacactaccaggatactcgcagatcggacacactacaagcagcaacaactgcgatcacgaagacgaggacccaaggaggacttgccggcgaccatcgagagtttcaaccaagaaatcagaaaagtggaaatgggaggtagtggaaccctacccctttaggccttgttgggttaatccccatgagggagggattggagggaatttattccatacctattatggtgtggaattattccccctcaatcccctccaatcctcttcaatcccctctaaaccgaacaagaccttcttttaatccctctctcacaagtggaccgagaggattcggaaggatttattctacacctattatggtgtggaattttttcctctcaatcctctctgaaccccctttctcttgcagattaaacgagcccttatggcggcgataaactgctggaaatggaggggaatagggggccaaactacagagaagctattggggattttgagtttgcctaacttgttgattgactgaaaattaaggagagaaggcgatctactgacctagattgattcaatgcgcaataaataaactgcaagaagaatcgactgaggttaattgacccaccggtgtgcaaggaagaacggaggaacagcactgccgggcaccggcggcagacagccatcgccagattgggttttcctattctgttacaggagagtagagatggagaggttcagggatgaggcgtggaaaagtatgtcatgtggagtcattactaccagcgctgaagcaagctggatggtgctcaaccgcatgcatagcaagcaacaccaatcaaggaatagtcctttggaaagaatcaaacaaggaaagagttaatttaggaggaataatgacatttccttgtattaagatggccacgagccaatataaactatgtatccagccttgctaaaggcaagcaatatcaatcaacttttcctaatctcccttcttccaccattgggtgtgcagggaaggttcctgacacctcaaccgagtcgagctacaaactgcgtagccgcggcccggctatcctcggcaccgacacgcttgacaacttggtatcaggttccaggcgttcctcctcccactccaatccaccatcgtcacccactccatccatcacttccaccatggctaaaccatccaccaccgagctcgccgcgctcatcaaggtgctcacggccaccgttgacaagctccagacttaggtcacctcgctccagcaggctgcaccttccggatccaagtcctcaggcgaccaccacaacgatcggcctcctcgcttccagaagatggattttcccaaatacgatagcaagtccgatcctctcgccttcatcaatcgttgtgaatcatactttcatcagcagcgcattgcggatgaggagaaggtttggatggcctcctaaaccctggaagatggcacgcaaatgtggtacattcaagtccaacaagacgaaggcactcctccatggtgtcgcttcaccgagctgctccacctccgttttggccctcccctatgttccaatcctctcgcacaaactccgtcatcgagtaccaagacaagttcgagtctctcttgcctcgcgcaggcacactcacggaggaacaacgcatgcaaatcttcatggccggccttcaaccaccgctcagcctcgacgtcgagatccataatccacagacgctcgccttcaccatgagcatcgcccgcaagctcgagctgcgcgaccagtgcgccgcagctgccgtaccagggcctccgaaccagtgccaaaactagcggggcctgctgccggcgccaccccagcaactcgccctgccggcgcctcctcaaccaccagtgtcagaccctgccacggtgaccgttgagggccgaatggtcaagcgcctatctcaggctgagatggaggaacggcgtggcctcggcttgtgcttcaactgcaacgacaggttctcgcgtggccacaaccgtgtctgccaacgcctcttcctccttgacttggccgtgcctgacgatgaccacgacgacgacagcgcccaagaggggaccggggagacggagccacaggtgtcgctccacgcgattgcgggcgtccgttgctgcgacactatgcaagtctgcatcgaccttggcggcgccgcactcctcgcgctgctcgactcgggttccacccacaacttcatctccacattggctgccaacggcaccaagcttccgctcctccctcgcggcaagatgcaggtcacagtcgccaacggtgaacgcgttccatgtccgaggttgtaccgcgacacggccttcaccatcggcgccgaaaccttccacgccaacttcttcgcgctgccgctggcgggctacgatgtcgtcctgggcacgcagtggctggcgtcccttgggtagatcttgtgggatttcgactcacgatccatgtctttttggcggcacgaccaccgtgtatgttggcagggtgttgcaggctcgacggccccatcgctgcaagtcgttgccggccacgacatcatgggagccctgctcgaggaattcaccaccgtcttcgccaaaccaatgggcatgcctccacctcgatcacgggacccctacatcaacctcgttcgtgcttggcgccagtggccgtccgcccttaccgctaccccgcttcccacaaggatgagttggagcggcagtgtgccgctatgctgacacaaggattgattcggtgcagcacattggctttctcctcaccggttctcctcatcaagaaagatgtcgggtcgtggcgatgttgcatcgactaccgcgccctcaacgccatcacggtcaagaatgcataccctattccagtggtcgacgagttacacggtgcccgcttcttcacgaagctcgacctctgctccggataccaccaagtcaggatgaatgctgccgacgtcaccaagaccgcgttccgcacacatgacggcctctacgagttcatggtcatgccgttcgggctttgcaacacccccaccacattccaagcactcatgaacgacgtcctccggacattcctacgtctcttcgtcctcattttcttcgacgacatcctcatatagagcgactcatgggcagcccacctacgtcatgtacgcactgtcctctaagtcctacagcagcaccgtctctttgtcaagtggtccaagtgtgctttcggcgtctcctctatcagctatctcgggaacatcttctcctccgagggcgtcgccatggacccgcccaaggttcaagccatctccgactggccacagccgcgatcggtgcgtgtggtacaagaattcctcggctaggcgggctactaccgcaagtttgtccagaactacggcacgaccacagcaccactcacaacactgcta

SEQ ID NO: 6283 - DNA, 1690 bp, Oryza sativa
ggatagacaggagcagccttcaccaccctcaagacagccatcacgaccgcaccggtgctcgttatgccccacttcgccaagccattcgttgtcgagtgtgatgcttccacctatggcttcggtgctgtcctcctccaggaccaccaccccacggcattctttagccacaccgtcaccctgcgacatcaatccttggcggcatacgaacaggaattgatcggcctcatcctcgtcatccgctaatggagaccgtacctatggggtcaccggttcctcgtaagaactgaccacttcagtcttaagtttttgctcgatcaacgtttggccaccatccaacagcatcattgggttggcaagcttctcggctttgatttcacagtggagtacaaggccggtgtcaacaatacaatggccgacgccctgtcacgacacgacaccgacgagaccatgctgctggccatctctgggccgcggttcgacttcatcgaccgtctgtgccaagcccaagacatcgatccgacgctgttggcactcagggaggagttcatggtgcaccagcacgccgccccatgggcgttgaccgacggcatggtgacatacgacggccacctctacatcccgccggcctcacctcttctccaagagctccttgccgcggtacacggcgacggccatgagggggtgcagcggactcttcattgactccgctgcgacttccactcacccaacctgcgcacggtggtccaggaccatgtccgcgcatgcatcacttgtcagcgctacaagtcggaacatcttcactcggctaggaaactctttccactcctagtgccgatgtccatttgggcagacatcaggctcgacttcatcgaggcgctaccccacgtgggcggcaagtcagtcatcctcacggtggtcgaccgcttcagcaagtattgccacttcatacccttggcgcacccatattcggcggagtccgtggcccaagcattcttcggcgagatcgtccgcctccacggagtgccgcagtctatggtctcggatagggaccccgtgttcacctccctattctggattgagcttatgcgtctcatcggcgccaagctccacatgacgtcggcatttcatccccactccgacggacagaccgaagccgtgaacaaggtcatcgccatgtatctccgctgcctcaccagagatcgtccctgccagtggctacgctggcttccatgggtagagtacatctacgagacggcttttcagtcctcgctcaagcagcggcaaggaatgcaacaatgcactactcggtagataggggaatacaacagcacatgcacctgcatgggtatgcatgcctgtaggctctacaggcgcacggctgtgtggtgttgagtattcgatatttgtgaaattatcagatgtccaacatgtggcatcctcctaattatacgcataatatcgcacatcttgaattgttgtttcttccgtaaataactccaataaatcccttaccccatattattgggcttagctattagcccaatatttttaagagtaaatttcacaaaactacacgttttatggtccaagttgcagaaaaccacacatattttgacacttggcacttaagtacatatattttggtagtgtttcacaaaaccacactatcaatgaatggatccacccgtga

SEQ ID NO: 6284 - DNA, 4379 bp, Oryza sativa
  unsure (1)..(4379): unsure at all n locations
tcgacgccggcgagctcctggagctgtccctgatctgggacggcgtgggcctgaccctggtggagctcaacactccaaagcttcgtgttcttggcattgaatgctacttcatccaccacaccacgctgacgatgtcggcgccggggctagaggagctgaaatcatccttcaactgggaaactttggagaggctcgacgtcggcgacataatgtcgtgcgtgcggagcctcaaaaatctgtacttgagctctgatgggctccgcatcggcttcggtgatgtctccggacgccttctccggcgatgccccgccgtcgaatccctcgatgtccaccttgcttgtaaggtatctcatgccgatgaggaaggcgaggaggaagaggaaggggtgattgatgacgtgatgatgatgaacgacataccacatttgcctcttgtcacatctttgacggtaaatcctttttctcccgaggacgagactttttctgatgtagacgagcatacaaagggactacctagagaactgttgacagttttttaaggagaaaacttgctcttcctcctagttttttaacgagccaattataaactgttgacagtttataattacaatataattttatatataagtataatgtaactcgtatataaatattaaaataatatatgtaacactatatctaaattatatagagatgataatgtagttacagttcagttacatagtagttacgatgtagttacaatgcagttacattgtagttacattgtaactatattgtaactaggatgtaactgaagtataactaaaatataactcatcaaacttctctaaaacatgcaacagatcaagtggctagcatgcacgccttccaggatggagctctctaagatatgaacgacgcttatcttgtggtaagtcccctcttactgaattgatctcgacgtctatttcgataaacttttgttagggttaatttgcattgctgcacactgcaaatgtgctaatttaacattacaacaatcaaacattatgaaattagcacagtttgtcagttcattaaaaaaaattaaacattacaagttttgatatgctaacaactctcggattttttttctctccttttaattgtataggagcagacgaaaccaacagatcctgctggtaatcaagccgattacctcagcgtctcgttaccacatctcgtggaaattgggataaatggcttccaaggaacaaagtgcgaagccaggctgatggaatggctacatagaagtgccccagttgttaacaagatttgcttttttgaaacttaagacgcggaaaggaatatgaagatttgctacctcgaattcctttctctgtgcttggtagatggacggcaacctggactcatcgtaactgtgtgggacgtttgtgtggacgccgacgtctgaagaagagagatataattatatctcgtgagtttccaagatgagaagtaaacaaaaatggaagcatcatgcttattaaaggaaaaaaatgtgcgtatttactattgggaagtaatttaactatttgtcactattagatttgacaactctctatatgccccttatctattcatacaaatttgtcactggagagagattgcttcttaatttttttttcattttttgcatacatgtcatgaggactactcatcatcgtcttcttcctctagccgccaacctcctacctctttcttccttctcccatgtatggttaaacttccgcaatccaaaaaagctctcacccaacaggcgacacccctgccttacgcctcttttcaaatctctctctaggaaaaaaagtgggaaaaatagagagatggatgggaataggaaaaatgaaaatgttcaaaatgcaacagactcattttttttaacagtttggggtgctccgcctcccacaaccaatgcccatgatgggctgaaccgagcgaaaattaattgaaaatgggccgagcccaccgcgccacaaaaatgacttaggcacctcgcatcgccaaaagtggacaaaaacacatgggccaataatggtggggcagatctgatcaagcgctacagagttgcacgactgatcgccaaagagccatttcgatacgagtatgcagtgcagcggtgagcatggtgttttaggagaccatgtcccggtcaggcattgtgtcgagcaccgttaaatttctccaatcctaaaaagctcttactgaacaggtggtagtgacacccccaaccacccataggcacaacttgatccgcggtggtggggagagcttgtcggtgaggctatcccccacgggctgtgagggcagcggaatacgtggacggttgtggcggaccgcggtgggaggtttcactggtggcgaaaccatctttcgtcggtcggccgaattccccaagagtcccgggtggcgataaaaatcggggctaaagatgatctctagtcccggnnnnnganggnnncnggnnnnnnnntnnnnagnnccggttnnnnnnntnnnannnccaaccgggactaaagtcccacccctatatatgtcttcttcctcctctagctgcccgagcaagcttcaaaacatcttcaaaaaagaggggaggtcatgccaaaatttctagtgaatttattttggtgattatatacaaatcggaggtgcctaaaaggttagcaacttcatcctacaatgttttttttgtcatattacatttggagctatgttttgcacacttttttgtctccaaaatttagttgtaagttgatgagagagaaaatttgtgtggggaagaaagaatatatagaaatttagtttatttgctaaagaaggttttataaaatagttgagaaggaaaatatagtgaaagttaatcttaaataatagaaaacaaactaaaatgaaaattaaaagaagtaaaacacattaatattagtttaaaacattagagatagtaaataagaattatttggtgtaatattttataatttttgtataaataatgatatgtcattattgtatgactgttgaaagagtttgtaattattttataattattgtatgattgtcattattgtaagaataattatttgtgtatgattttttttcatgtcatgtagatgaatcggcaatggatgtacactgaccggcggtccaaagagtttattgacggcgtgtattattttttgagagtggccgaaactaacaggcataagggttttatttgttgtccatgcaataagtgcaagaatcagaaggagtattttgcatccaagactattcatttccacttgtttgagtcggggttcttgctaagctataattgttggacatcccacggagagcgaggtgttgaaatggaagaagatgaagtggaagacgacaatattccggacttacgttggatttgaaagaaatcaaacgggcgaggaggaaagggatgctgatggtaacgacgttgcggatgatcttggtcaaatattgtaggacgccaaggaggactgcgaaagtgaaaagggggcccataaattagacaagatgttagaggaccacagaacatcgttgtacccaggttgcgagcaggggcacaaaaagttggataccactctggagttcttacaatggaaggcaaaaaatggtattagtgacaaggcatttggcgatttattgaaactcgtcaagaacattcttccggagagaaacaaattgcccgagacaacttacgaggctaagaagatagtctgccctctaggactggaagttcaaaagattcacacatgtccgaatgattgtatcctatatggcggtgaggagtacgagaacttagaagcatgccctatttgcaaagcactacgatacaagattagacgagacgatccaggaaaagttgatgggcagttaacaaagaagagaattcctgctaaggtgatgtggtatttccttataataccacggctaaggcgtttgttcaggaacaaggggaatgctagaatgatgcgatggcacgctgaagagcgtcaacaggactggatgctgagacaccccgccaatggtttgtagtggcgaaacatcgacagaaaatttaaagactttggaaaggacgcacgaaacatacggtttgctttgagtacggatggcatgaatatccttttggagatatgagcagcggccatagcacttggtccgttacgatgtgtatctacaaccttccccctggctatgcatgaagaggaagtacataatgatgccgattattattcaaggccctaagcaacctggtaacgacatcgatgtgtacctaaaaccactggtcgaagatcttaaactgttgtggaagaacgaagcagtccccgtctgggacaaggacaaac

SEQ ID NO: 6285 - DNA, 3277 bp, Oryza sativa
caagcactttgaacataaggcggaccatcgtacgaagcctaaacatcgcagcgggaaaatagtgtttgctatggttaaagatcttaaagtagtgtttggaaaggggcctggaagcagcctatagagagcaaagatggtcacgcggcgatgtggaaaaagaactctatattttgggagtttccctattgggaattcttggacgtccgccacgcaattgacgtgacgcatctcactaagaacctttgcgtaaaccttcttggcttcctaggtgtatatggaaagtcgaaagatacactggaagcacgtaatgttctgaagcatatggaacaacgcggcgaccttcacccggaaccaaaggagaaaggaagccattacttgagtccagccagctacactcttagcaaggcatagaaggaaagtatgtttgaatgcttagagagtataaaggtatcgtctagatactccacgaatatcaagcgaataataagcacgaaggagaagaagttcacaaacctaaagtctcatgactgtcacgtgttgatgacacaactgctaccagttgtaataaggggtatccttctagacaatgtccgggcaacaataacaaaactatgtgcattcatgaatgcaatttcgcagaaggtcatcgatccggatatattagaagcccttcagaatgatgtggtgcaattccaccttcattttttaatataatgacgcatctgctttgtcaccttgtcaaagagatcagtattctcgggcctatgtacctacagaacatgttttctttcgagaggtacatgggtgttttgaagaagtatgttcgtagccgtgctcgtccagaggcaagcttcgctaaggggtatggaacagaggaggtcatcgaattttgcgtagaatttattgaagaccttcgtccaattggggtacctgaatcgcgccatgaagggagactacggggaaagggaactctcggaaggaaagcaataatgacggtagacaacaatttattccgtaaagcctatttcacagttctgcaacaatcttcattggtagctccttacatcgaggagcacttggctctagttcgggccagaaacatcggtcagtccgatgcatggattacacggcatcacattgatactttccccgcgttgctacgacaacatctcatgggtaacgagacgatcaaccaacaactggtcttcctggcaaggggaccatctgggtcgatcgcgacattccagggatatgagatcaatgggtacacattctacacgagagcccaagacatgaagagcacgaaccaaaacagcgctgttcgtatcgatgccatgggacacgatggaacaactggcatgtattacggtgccattgaggacatatgggagcttgagtatggtcctctcaaggtccctctgttccggtgccaatgggttaggttgactggtggaggcgtaatgattgatgacagtgggatgacaacggttgaccttaacaaggttggatactcggacgaaccttttgtccttgccaatgatgtaacgcaagtcttttacgtgaaggacatgtcaagcaaaggaaagaagggcagagggcctgacgagccgaagcgtcacgtggttctctcaggcaaaagaaaaatcgtcggagttgaggacaagactgacgaggattacgatcagtttgatgggcaaccccctttcacggtgacgattgaccctagcatcctcctatcaaatgaagacaccccttactcacgtagcgatcacaaggaggaaacaatagtgaggagaaagtacgtgcggtcaaccgtcaccgccgatgtattgccgtaattattgtgtacacgatgtaaactattttggatgtattgattatccatataaatcaatttttgtatggcatatgttaactacgtacgattattagaggttttaacaattttaaatcatgtaattgctagttatatgcgataattagaatttttaaaagtcttaaatcatgcaggtggcatttacatatgatacttagagtttttaacaattttaaatcatgtatatgctagttatgtgccataattagaatttttaaaagttttaagtcatgcatgtggcatttacatatgttacttagagtttttaacagttttaaatcatgcatatgctagttatatgcgataattaggatttttaaaagttttaaatcatgcttgtggcatttacatatgttaattagaatttttaacaattaatttaatatcattcatatgctaattatatatgattattcaaatttttattaattttaaatcatgcatgtcgtatgtatttacatatgttaattagagtttttaacaattaatttaatatcattcatatgctaattatataagattattagaatttttattaattttaaatgatgcatgtcgtatgtatatacatatgttaattacaatttttaacaatttaatatcattcatatgctaagtatatatgattattagaatttttattaattttaaatcatatatttgcttattacgttttatcgacttaatttactacagacaacaataatttttcgaagtaattgtcattaatttttcgactttaaataattttaatgcattattttctattttagaaacacatatgtaatggaaattaatattcagtccgcttatcagtagtcccggttcctaaccttaaccgagtttaaaaagaatttggaaatagcaggaaaatatctttagtcccgattgatgagaacaacccggagtaaagatatctttattcccggttgttgagaacaaccgggactcttatctttagtcccggttgttctcaacaaccgggagtaaagatatttttatctttactcccggttgttctcatcaaccgggactaaagatctaggggtatatatattcccgatacgcgccctcatcttctccaccaacactcagaagttttttccccgatcgatctctctcggcttctccttcgccgccactgcctagggcatccccgcaccgacgccgccgtcgtatctcgccgtcgtctcgtgcgcgtcgtcgtcgccacctccgtcgccgcctccccctctctctctctctcttcgatctcgatctctctctctctcccgaaaccgccgccggccgcctcgttgccgacgccaccgcctacgtcgtcatggccgaacacgactccgccgcgccgacgatgccgaccccgaccttgatgcggctggcaccggcgacgctgtcgccctc

SEQ ID NO: 6286 - DNA, 7722 bp, Oryza sativa
ttaacgttgtatttgaacgtaggtaaacaaacgaacgtgcgtgcacgaaaagtgaacttaacaagaacgcgaacattacttaacgtacgttaacgtggacgcacgtgaacgaacgaacgtaggtgaatgatatacgtgaacttaacaagaacgcgaacgtgaacgatcgtgaacgaaacgtgaacttaacgagaatgcgaacgtgaaatacaatatatgttacttcgcgtttatcctaatacatctttttgtatgttgcagaaaagacgttgtcgtcgtcgtccctcaagccggagtggtagctagccctcgaaggaattcgcgcaggcaagtgatgtaaatatatgattgttagatttttaatgcaattaagactattagatttaatatacgacacttagacttagcattataattagagttttaatacaatattatttgagttttaatataagattattagatttgtaattagacttagcatataagattatgtagggttctaatatatgactatttgagttttagtataagattatttgagttttaatataagattattatatttgtaattagacttagtatataattattgactagttagggtcctaatatacgtcacttaggcttggcatagttgactattacagttttaatacaatatttgagttttcgtataagattattatagttttaatataagattattagatttgtaattagacttagcatatacgacagttagacttagcatatatgacttagcatatatgattgttagcatataagattgttaaagcaaaaatgtctcatgacttagcaactatttcttgtatgaacagatggctgaccacgatgaggaatagatattgtacgatacaatcgcggagggaagcagctagtactggaacgaagaagaggggaacgaggatccaaaccagtacttgaacgaggaagggaacatggagagggatgcggaggggaaccaggaggggcacatggagagggatgtggaggggaaccaggaggaggaggctagtggaagtcaaccctccgctggatagaagaggacacgtgggcaacgaggtgccgtgaagaagcttgagggttggcacatcataacggaagtggacgaagacgaccgacctagtgtcccggcggaagcagccaagaactacgtacgtcacagcagttgggttatgcgggataacatgcctgtcagtacggtgtactggcgcagaacaaggacacgcagagatcatgagagctttgtcccagattcggagaaagagatgctatggaccacaatgctcgagacattcacccttcccatgggtacagaggacaaagtgaaaaggtggactctaaagaaaatgacagaacagtttcagagcttcaagggagatctataccagaaatacatcctgaaggggcagacaccgaacttcgacacattcccaaagctaagggatcactgggacgagttcgttgcatataagataggtcaacaagggcaggcgatcatggaaagaaacaaagaaaataccaccaagaagaagtaccatcaccacttggggtcaggcggctatagcgtcgcgatgccgaagtgggaggagatgaaggcaagcttgcttgagaggggtatcgaaccggctaccgctaattggccagatcgatcgaagttttggtactatgctcacggtggaacactcaacccagttgatggctccttggtcttcagcgatcagatacgcgaggctgcgcatcgactaacggacgcagtggaagcctcttctcagggcatgttccgacccgacagagagaaggacgagctgtcactcgccctgcagactccagagcatccaggacgaacacgagggaaaggggtgattccttggaagattgggttcaaggaggacatccacacgtacaggagtcagatgaggagcaagagagataccgaggcgaagattgcagatcttgagtacagggtatcgagctacgagctcagcatgcaagaggaggtggcaagtaaggttgatgaacgcatggccgcacatcggtcccatgatccccagccgaccattcctcctgcaatgatgagcccttcaggaaatcgtagcagctgcgcctcaacagggcaggtaggatcacaaagcatggacgccatgcaaacccaggacgaaaccacctgccccgttgatgacatcactcagcggacaccatgtgagctgcatattccctttaagaacttatcaataaaggtaggctcataatttatatatttttgatttgtccattccgcaagttgctgcttatatatgttgattactaataaataacctctcaccacgtgaaggtggcgtcgggcatggccatcccaacagacccttcaggtacttaccactgcaggccgattctagcaggatactccaaggtcgaagttgagttggtcgaaggtgcgtacgaggacctcgagttggattaccctagaggagacggcgagacgcatctacgagacacaagccacgccattatactatggcgcaagcggtacatcatcctccctaggcgacaagcggcgtctcgtgcaccatctcctccggctctgccatctcctcctcagctcttgcaccgtctcctcctcatgctcctgcaccgtctccacctcaggctcctgcaccgactcctcctcaggttcctgcaccgactcctccttaagctcctacaccaactcctccgcatgctcctcgtccggcaccttccaagtcaagggccccccaagctccaccgcctgccccccaagggcaacgaagaaggcgaaagttgacaccgccaagaacaaggacccggggtacgattgtacgcaagaggagcttgacgcttatgtggcattagaagtcaggagacaattgaagcctcgaagtccagaaaagaagattcctatagacccgagtgtcatgaacttcttcagggatatgtctgcacctgccaaggaggccataaagctatcggactatgagcgaacactcaagaaagcatcttctagaaagtccaaaccagtccctcagcttggagagcaaccaaatcaggagatcgagccgttggtgaccggtgaagattttggaatacaagaatttattaatgacactaggctaactacggatcaatttctacgaggcgcaccaatcgaaaaggcggaagtgaaatacatgtacgaactcggtaaattgcttatcaagcctgagcagctgcagtctctacccacacaaatgtacaagttccatcaactgtacatggagatgagcgccaccggtagagagatgatcggagcaaggatcagggacacggacttcacatatatttttgaataagatgaacggtcaaacatgtttaaaaaagtcaacgacgtcacatatttagggacgaagggagtatttcggtatgggccacgtgatctcatcggcaacaagagccatcatcaagtcaacagcatcaaatatttagggacggagggagtatttcggtatgggccacgtgatctcgtcagcagcgagagccatcatctcattgttgcgcccccaatcctttttcctcttctcatcgtttaattaactggtggtaagagctataatgggtttgccttatgtatacacaaatgaatagagagcctagctaacaacaaaatgttaataggtaaaaatcgaatgctaaaaaatagatatgtaacttcagtgaatgtctacttactatgataaacacaccttaaaaaatagggaacaatcgcaaaaagtttactttagtcgtggaagttatacaactaatttaaggcttcagttgtaaaaactgcataacaaatttaggattataatcattgtttgttatacgataaatttataaagcttctgttgtaaaaattgtatgataaatttaggattataatcattattaatggcatatattctaataagtgcgaacatgttatagtttatttataataactagcaatgatgcccgtgcgttgcaacgggtaaaggtaattttaatcatgtatactggtgggaaaaaaaataaaggaatcataataataataataatattaatgaaataaaattgcagtgacctttggtcaaaaagataaaaatatataattaattttccattaattccattagctaaaaataatataatacgaagtaggaaagttattctcaaattttagcaattttcaaaaagcttaaatagagcaaactaattatataaatgaaaacaaatttaatcacctaaataaaacaattagacctgtaattgaaaatctgttgtcagttcagttaaacatgagcctgcgggtgtgtatggtatatatctctcactcgtatgtcgtggtctttttttttgacatagaaaaaatgcccatgggttgcgacgggtaattaaaattataacaaatataaaaatattatatgattaaggtttagttttacatgatatgaggtctttaagaaaatatatttataatgaaataaaaaagttcagctgaagtgacctaaagtgaacttgttccatacggagcgtacacatggtcaatgaggcggcccaatagtgtgggcggcctaggaatagaatcggggaggaacaacttaagcgacctaaagtgaacttattccgtgtgggcggcctaggaatggcgttcggcctgacgtgggagaagccagagctgtctgatctgatagacggtcatcccgacctatataaaagttcaacagcccaaaccctaaccctaaaatcatttcccctcccccctctctctcaaaacaatgtggcggcggcccgacataccgacatccctgcgacggcggtggcggttcagcagcgacggcgacaccctccccttccggcgtcagcgttttcttagtgttcttgaatctgatattgtattcttgcagtagtgttttctttagaatttaagtccaaatttgatgcggtctctcattttttttctttcttttctttttttattttttgccatcggaaagggattaaagcgggatcaatcgcacgtgcgatagcatttctataacccataagccatacaaatttttttaattaggtatatgtagatattgaatcggactttcctttttttttcatttttttgcccttttttggttactacggatgtcagaaacatctttaattttttttaccacgtcacgtataatcagattcgatttttttcgccgatttctttttcacgctttttttcacggatggacaacggaaacactttttaatttttaagtagtagagatagagatagacatacacatagagatagagaaagagaaacggaaaacttttttcgcaacttttttttttggaatcggacagaaaaaaattttacgcttgttttttaccgcgtcgatggaatcggattcgatttgtttttttaccacgccgtgtcacatataataggattcgattttctttggaatcggacatatacttttttctttttggcccatttctttaccgcgtcgacggagtcggattcgtttattttttttccttttttcatccttatttaccgtgtagaactagtcagattagtttcttttttttcctttatttcgcccctaatcggacttattttttttctttttttttccggtttttttcccttctttcgcccgttttgatcggactttgtttttttttcacacggtttttttcgtccgcggattttttttgtttcgtccttttttttatcggacatagttttttcacccggtttttttcgcacggtttttttctcccacggttttttgacggacgatggaagcacctcttattttttaagtatatatataataataaatagagatagagatagagatagagatagagaattgttacttcatttttaaaataccgtacacttcgtcctggtgtgatgatctgtcgtagctaaattttagtgctgggtctgccagtgaagatctggaatgccaaaatcaaatattacccgacagatttgtcgaactgaaaaatagggcatgaaatctttatggcaacttgaaaattttgatcgatgaccaaacttacgtggcaacctaaaaaaatgtatgatcgatgtatgctttcattgtttctttttcattacatggaaatcttacaaaaatgtatgatcgatgtatggtttaatgaattcttttttttattgttggtatgattttaattcgatcatccacatattttggttgtttgattcagattataaaatattatcgtagtgttagtacgggcatgccactagtactacttaagtatcaaacatcagtgcccctccacggtagggcattttttttctaaaataactcaaaattattggactgttagtccaatctaccctatatttgaaccaacaccgactggggtatttcctcgcaaaaaaagaaacaccaactggtgtattaattaatcaatttttgttagggccaaacgtttctgctgggcttcatctggatatatacgtgtattttttggggattaattcgtacacgatctactgctgttgtatcaggtgacccgtatctaggggtgaaaacggtacggaaacggacggaaacaatctttatcgttttcgtttccatatttttttcggaattggaattggaatcggaaaccccggaaacgaaaacggaaacgaatattatcgaaaccgaaaacggagtgaaaacgaaccggtgcggatacggtaacgaaaatttattggaataaaaaacccctcaaactgagcttcaaacttttgtcaagtccaattctaagtctcaacaaacaacaattcatcatacaacccaattatatgaaatcgtcttaacagcaaaatatattcttctataccttcatataatttgcataacaaatattttaaaaaaattacagcaaaacagaacagcaatatattcttctataccttcatataatttgcataacacccttgtataagatatatagtatacactattattcagtgctatactgctaatctgctatgagctatcactccatcatcagtacatagttcatcaattgtttcggtcatcacagaacagcaacacacatcaatccatcagtacagtacttggatcaatcacaaaacagctacttacatttgatgattccatcataaatctgcagcacaaaagaaatcaaatcaatggtttatgatcgtcggctcgtcgctgggctgctggctgctgccgctgggctgttggctattgccgctgggctgctgctgctgctgcgactgcgaggcgaggcgtcgtcggctccttggtgtggctgtggcgtcgtcgtcagtagtggtagtggcggtgaaacggcgggacggcgccgcggccgcgaaacggcactgcgaaacggcgggacagcgtcgcgagatggcggcggtacgagacggcgaagacggtgggggcgaggtcgcgaggagccgaggacggtggaccagcggtggcgcgggcgccgggcggtgggcgctagcggtgggtggagcgcgatgctccaccgccggcttgcggtctcgcaaagtcgcgatgccgtgtggctgtctctctcctgtagggttagccgctatttggatagatgccgcgatttgggttgggcttaaaacttggggacgagttatagactattgattctatgggtcttcttaacttcgga

SEQ ID NO: 6287 - DNA, 7558 bp, Oryza sativa
gatcaatcactgttatatccagattaattccacgacgacccaccatacatacgtgccgcgcgccgccggccggcgcgcatgggcaaactaagacgcgtcggcggcgagggaaacgacctaatcagcgagctcaacgatgacgtcctcgactccctacccaccatggccgacgtcgtgcgcgcgggcgcggcgtcgcggcggtggcgccacctctcgacgcgcgttccttccctgcgcttcggcttcaccgaggacggcgtcgacgcgaagccgaagcggcgcgagaaattcgaccggttcgtcgccttcgtgaaccacgtcctcgacgcgcgcgccgccagcgccggcatcgagcagctggcgatctccatccaactgtatgaccgcggcgccgcgcatgccgtcgccgcgtggattcggtacgccatgcggcagcggcacgcggtgaaatctctcgctctggatcttcacctgccggaggatcccaggttcgcggacgataacaccatagatctggacgatctttcgatggtttccaggagactggagaccatgacgctgtcgttagcctatgtaagtctccggctccccgctgctgccaccgccaccgccgtggtgttcgactctcttgtggacctttcgttcaaggggatacggctcgtcggcgccggagccggagccgatagcagccgcctactcagccggctcgtgttgtccgcggctccggaagctacggctggtgagcgtagtcgggctgagatcgagcgctgtggctcgacgccgacgttcgctgcaacagttccctaggaaccgggcgtttggtgtgcttgagctcaacacgccgaatcttcgctccctcaagatgtgctgttacgcccctggaacattgagaatctcggcgccgaggctggaggagttgagatcctccaacaacgtgatagacatgaggtggcaatgcgtagagcaactcgacgttggtgacctgtcgtgcgtgcggggactcagggagatcgacctgagctctcgtgggcaccccgtccgcgacgccggcattaacgatggccccattcatctcctgcggcgttgtactgccatcgaaagtcttggtgttcgccttgtttctccagataaggtgtactccctccgtcctaaaataaaccgattcctaggacggagtggttgtcccccaaaaaatcgattcttacccagaaaacgagacacatttaatatcttgcgtggtcatgggtggtccagaaggagccagaccatcgcagcttttcctttctctctgttcagacggtaacctttcctctcccaatctccctcttttcgcttctctctccctctgcctctgtcatcctcccactcaatctctcactccagctccaccctctttccgctcctatctgcagggacagcggcaaaagccgcggcgacggatgcggcggcgacgacgcgcggcgacggatgcggcagcgacggcgtgcggcggcacatggatgcagcggcgacgacggcggtgatggatggatgcggcggtgacggcggcggcggcggcgatggatggatgcgcgacggatggatgcggcggcggcggcggatgtaggatcccgattttatttttttttcctctctattcctagttcttctttgtttttcttcttgctattttttttcctctattcctggttcttctttgttcttgctattgttcttatatgtgaattcaaaccatttctttttcttagattagagagatgttccttccttgcggcaatgcatttcgttttttcttctcctctgagtactactccttcttctctaaagtactagtagtaaattaatgtgactgcagagattgggattgttgatggatgtagtaatgagggtacttcggtaatttcacatgaatcctaaactagccttggggatccaggaatcgattttatttgagacagagtgagtatatatgtgcacactccttggtttttattcccatatgttaataactagctaggttgcctgtgcaattacgcggctagcatccaaacaaaatcatatattttttaagtttgattttacttaaaatttattaaatagctatctcattgtcttaagactttgaaagaccaaaccttatcatccagtgtttctaattatatagttttttaaagtcacatcagttgctaccccttatgtcatcttctactttatttgcttggtcgatctaccacttttctattcattctccttggaacctttaaaaattagatattatagtttttagagtttattgtaacgttgggtttcatttttataatttctagacgtctcgtcaaacgttgccattatactcctctatggcatgtccactgtctcttctctttaatgtcattgagattttaaaaatctaacataattatcgtttgggttcatttttactttcacaagtcctgccaaactcgctcgctgcctcccttctttattgtcattgagattttaaaatcgaacataattatcatttttattactttttagaagtttcgaacctttaaaaattggaccttgtatttttagagtttattgtcttgttgagtttcattttttttataatttttagaagccttgtcaaacgatgccattatgctcctttacggcccgtccaccgcctactctttattgtcatcgtgattctaaaaatcaaacataactatcgttggaattcattttttattttctagaagtccagtcaaccatcggtggctctgcaactatactcctatacaccccgcccggtgcttctcctttttattgtcattgagagtttaaaaatcgaatatgattatcaatgcggtttattttttttactttctataagtcccagtaaccgtcttgctcatttgcttcacagcttgcttgtcgtccctccttttaattgtcgttaggattatatttggtgttttattaacagtttttatatgtcatatcaaccgccaccactctactcctttataggcatgttacttaatttatctcgtcatatgttttagatggtcttttctttcaatagtctttatttttatcacaaattttagttatttataaattgtattcttaattgaaatcttatttttctttttctaatttcataatttatttttcttcaaattttaattaatattgtattgtgttcttttaatatttttactttttatttttaatttcagttgtttcaaaattttattcctacttgaactccctattaagttttttaattttggatattatattattttttatgaatagtaattcatctcatattgggttcttatatggattcttctttcaatattgcttatttttaattccgaatttctgctaattttaaattctattcctacttgaactcttcttttattttttttcgctaattttggattttattttttattcctaattttaattaatctcgtattgggttcttatatggactcttcttttaatatttcatatttttaatttcgtatttcagctattttaaaattgtatttctacttggactatccttttcttttctaattttagattttattttatttttatttcgaattttgattaatctcatattgggttcttatatggaaacgtctttcaatattgcttatttttaatttcgaattttagctatttttaaattatatttctaatttgactctcctttttttttctaattttggattttattttgaatttcgattaatctcattcaatattgcttatttttaattccgaatttcagctatttttggattgtatttctattttaactctcatttttttttctttttctctgattaatgtgagaatttctagcccccacagcgaacgtggtgcctcctttcaaagctattttaacaatataaacatagatgcgagttatatccctcctatatgtatattatgagtacctttacgggggagtattttaactaacaatattgtcactagtagtagtcgtaatcttaagggttgatttatgagtagtacaactatatatctatagaaaaaaaatattttttactatgaatagttaacttgttgtggtagtataaataggaatgatcaattggattagaaaagactgtgaatggtataaaggggtacttatattataatgaccattgtaaaaaggggtacttatatattataatatatatccaagctataaactgtacatgcatatttttctatataggccgtgtttagttcgtgtaccaaaatttttttaaagtacacggacacacatttgatgtattaaacgtagactaataacaaaacaaattacagattccgtctgtaaactgcgagacgaatttattaagcctaattaattcatcattagcaaatgcttactataacatcacattatcaaatcatggcataattaggctcaaaagattcgtctcgcaatttacatgcaaactgtgcaattggtttttctctttttcccatttaatgccccatgcatctgtccaaacatgatgtgatgtttttggccaaaattttttggaatctaaacaaggccatatatatctttttcgaatgacattgattatcctctgtgcaggaatacgtagttatctgggatgcagaggcagaggaattgatagatgaagaggaagagaaagaagaggttgatgacatgatgaaagatgtaccacatttgcccggagtcacatctttgacaataagggattctaccctaaacgaacgtgctcttatgactggcgtaacatgtctccttgcacgatgtaactctctcagatactttcagctcaacatgaccagcccgattatggtgagttcctcttgcattctcgcattgatcgttgcgtccatttcgctcgcttagctttcttttcaggttttaagtactgtgatgtgttaactgacaacaaataatattagaagttatagaagttatggtatcacaacctcttagacgacagtagaaaaaaaaactttactgcatgactactctctctctgcttccataatttaacgttttggcattgtctccgaaaacatatctttgattttctattgtaacacatctataaaaagtaagtaaatatttatcttttaaaagtactttttataagactaatctgtacatcgtggtatggtgtctttaaactaaatgttctaaaagttactattaacagtcaaaatattatttcctctatcttaaaatatagttttatactgtttatgttcatgtccaatatttgatcgttcgttttatttgaagtttttttatgattagtatttttattgttattagatgataaaacatgaatattactttatgtctgactaattttttttcatatatttttcaaataagacggacgatcaaacgttgaacacgaatacctacggctacacctattttgagacggaggtagtaattgtttaataccttgtctaaacttcaagaatcatgaaacggacactataaccagagtagtacaattatttagtttcttgtctccagacatgctaagatttgctgctcctttatttaattgcatttgcacaggattccaccattgctgctggtaatcaagctagcatcatctcgcttccacatctcacggaagttgagataagtggcttccgaggacggaagtgcgaagcccgcttgatggaacggctgcatgcaagcgccactgctctcaacaagatcacattacgtttcgactggctgtttacagtagaaagtagcagagaggaacgcataaattcgctgcccctaatccctttcggtgaggttggcaagtaggcggcggcttctggtgattttgagacgttcatgtggcgcccctgcgtgaacaagacagaattctgtggtgagaggaagcaaatgtgagactaaagggagtaataaaccatggaagcgtggctagaaaatatttattggggcaggagaaattatgtcatgacatagtagtacttgaactaattaagtaccttttattgaaaaatatgaacattatcttatatatgatattcctatagcaatattataggattattataccatgaaattcatatatttgtataattttctgaggtagttctaggtttctttgattttttttccagttctccaagtacattcatatactttcaaccaaaacatgcgtatatatgaagatatacagttttgttttggatgaactccggttagaatgctctctgctaaaatcgaaagtgagatgctttgtttgaaatcggtattgatctcttggattttctatgagctttcctaagagagaatttgttttaactgtggctagaccatgatgtggaccagagtcttggaggtgtgactttgatcacaattttatattataaaaagattattaaatctaacaagttcatagattacaaaagtacttttcatacaaatctatgagacacaaatctacactttcgccaaagcgattttcgcacaacggcgaagagggaacccccctataaagatttggctaggggcgagttgaggtcatgttcgtttcgcgtggggtgtaaaaaaaaggaatacaataaggacacaagaagtatacaggttcaggctgctcagaagtgtaccctactcctgtgtttggtactatgtggatacgagagtgcacaatacaaacttgctcactgaactaggcactagtggagaaaggggctttaatcccggttgggaacccccctatagtcccggttatgcaaccgggactacgaatccgggactaaagatgcctatctttaatcccgtgtgaaataaccgggactaaaaatccatctttaataaccggggctaaagagggtgggagcagtcccggttgatttttttttctcaaatcgatctgctctctaaatatccccgatcatattcccaaatcatcctcaaataaaagtagcatcacagatctggaaagaaatacatcacatattggaaagaaatgcatcacagatcacaatacatcacatcacaaaatctccaacaaaaaatacatcacagatcctaaaagaaatacatcacatctctcagatcagatccaacatcacatacatcacacagatcaaatccaatgaatcacaaattaaaaaaaaaatcggcagcagagaggaaggcgccaccggcctcccgaccaccgtcctcgcggcctccacgccagctcggccggccggctgccgcgccagcccgcgcggcgcccgctcgcccgcccgaccaccgcacccgcccgcctgcccgcccggccgcctcgcccgctcgccgcacccagacggccggccgccgccgctcccgccgggtgccgctgctcctgcccggccgccgctcagagaggggaaggggaggaacgggaggggaaaggggagaggaaggggatgaagggggagaggaagggatggaggagtaatgagaggggaggagatcgagaggagtgcgcgcggataatatctgagttggtggcgcgcggtcggggtactctttactccc

SEQ ID NO: 6288 - DNA, 11100 bp, Oryza sativa
cattatcccctctaaaccccttgaatttaatgggagaattaccatggacgattgtttttatcgtgcctcgggctccctgacaaggggcccaggacagctgggtcttgcttccctcgccacgtgctccaaactaggcttggtggacccaagccaagtcatagcacatccatcatcgtttttctcatttcttgatggtgaagtatgaaaccacctaccggtgctagcatctaactgtacatgtgtgtggccgtttagagctagcataaggtgaattactacctacctggagatttcctcccaaatggccccgttgagggtcgcttcctgcaacaccgtgtccatctcgggtcggatcgtgagcagctccagtgtatcctgccgaagccacctgttgtcagccgacgagccattctcgtcacccttcacgctggccagcctatcgtggttgagggagctcccgtggctccaccgagctgctcacctgcctgctcctgcttctgccttgttcttacagccagcgatggcgtctggggtttgagggggaggggggagggaagggggccaagcaaacggtgaaaaggcgagacagagcaacgtcaatggcatcttagagttcaaaagcgagggctgggacggtggattgggagattaggggagcgatggaggttcgaggcaacgacggcggcatcgtcaagggttaagagggggagaggacgagagtgatgctgcggggattggcaagggtggcgattgagggatggaagtatgctaggtgggaggtagaggcgatctgagacattggatctaacgtagatgggccgttggatttgacgaatgaggtgcgcaggagtgtagttagtgaactatatggtagatacctgtcgaaacaaattttcggcaatatgaaaagggggtagcgcacgagacctaaaagtggatggatgcggagacaaaggatttagacaggttcaggccctctcgatgagaggtaataccctactcctgtttggggatttgaatccaccgggtgtatattgatctgacgatcagtttgtgtcatgccccctagagggcctcctgtccaccttatataggatggggggcaggattacaagatagaaaccttaaccaatacggtatcggtttcctaaatctattttacaatattatcaaatcaggactttaggccgcttcataatataaaaggaaacgtaatacccaagtcatgatcggttaaatattccatagatataagctatcccctatgactagtcggataaccatgccgtgtgggtatggggtacccataatctccacagtagcccctgagaccttcacagtcggaaagataatcttctctcgaactagattactccaaagccgtgtgcttcaatcatcctcgccatgatctcccgagtacttttaccaaatatgaagactgtggagggctgaaaaataaagtcaggtgcatcgagtagatgtacctaatagatgcaccaactgagtggttttgataatcgtagtcaaacaagtaacttaatattaatatatagcatatgcggtatgaatccctgaataacatgatccgagtgatataccgacttatgatgcgtgcaacctaaagctgactacattattgaatacacatagcaaaacagctataaagaagcttgtatgttgtgaataaataactttccaaagtattgggcatacaccatgcgcacactgctttaacagatgtgcttgagtccctaaaagacacatggtttcactacacctgaaaatatatggcatatgtggtataaaatccgagtaaataaactcataaggatttatcaatcgtctgaaaaatgaccaaaatatataatcagcctaagccataatattggtcaataaaaatacacacttacgtggcaaaaagcaatgatgttgtatccaatcaattgcttgataaacccaaacagcgccatgactatataaaaaagtcagcggggcagctatataaagctttactgtttgacaccttttaagatgcattgtaccaactcctaaaaagttgagtaactgcggtataaaaggattttaaggtattggacactagatcacgcgcacttttgcctaagcaaaaagatgcctaagtccctaaaagaacgtgacatgccacacctgaaaatatgggctgcagacatattaggcctaggccaaaaaatatgccttcgacaccctttaaaggatgacgcatgtaacatgctcccgagtaataaatcttttcgggtgatatagaccaagtgtagctcatatgaataacttctgatctcagtgattatcctttatgggatactccaaaatagatataacaattgaattccgactggcgcaagtattcggttgataacccttacggggaataataaatagtccagtctttaagcataaaaaatagacccatgatcatcaaattcatgttgcatgtatccggaacaagtccaaattgaaggtatgacacttgtgtttgaggtagtaagcccctgagcatatagcgtgtccttttgttgtagtcacaattgtccattgatggtagctgacgcagttggcatagagacaagacgaccaatatagagagaatattgcccaccagaggtggcaaaaatattggtggtagtgaagatagtgataccaatcaaaagtgatgaagttgcacaaccgtgaaggcaaagaaaccagtcggcagcagtcaggtcagccagcaatgaagatgaaggcgcccagcgataaagttgtgtagccatggcagcgaaataatcagtcggtgacagacgatgcagttggtgaagaagatgaagatgcccattagtggcgacataataagccatccataaaggcgaggataccggtcggtggtgacgaaagcaagccgacggtgaagatgtagacacgcatcaaaggcgatgacgaaatccaccaatcatgaagatgaagaaaatagtcggcggcgacaaacgcaaccgatagtaatgatgataagcagcaatcatagatgatcaaatataatgacgaagttgcccatcaatagcagtagagtgggctatgttgaagaggctatgttgaatagggatattgatgaagatgacgatgtcgatgatccagtcaatagcagtgtagcaaccgatgataatgacgaagacgctcatcagcgtttgcatagtaggtcaaccgtgaaggcgaaataacaagtcggcaatgacggaagcaattggagacgaagacatagtcatccattagcaacagcagagatgtcagggccgatgaattagaggtgctggtgatgaagtcaatgacaataatccatcaaactgttgagaagatatcgaagctcgagtagtttccttggcgcgagagtgtgtataacgaagattgatgcaaagctccttgatttataaagatggcagtagaatttggtgttatagctgttgcagattcttcacttggaggaaagtagatgctcttgcccaactcatcaaaactgaacttattggttgataactccaaactcccgaacatgtagattaaatttcaaaattgatactggaaatatttggagtagattgtgacggcgtgaagaagccaaaattgccggtgtaataattggagtcgctgaaattaaatgacggttctgaagcgtagacgaagataataactccccgaattgactcgttgattgattgattgcttaatcttgacataaagcttgtcgaattttgatagtcttgtatttgtgtagcccccgactctttggttagttgagaaacaactgaacatagagtcgagaactgtagcttcttgtagtcgaatagtcattgcttgagtaaagatgcatgttgaagatgtccgagtagaaatattgaagattggaacaccacttgttgtaataatataacacggcatcatatttggtgacgcatgccgagatgtcgaagctcctgtagacgtcgtggttggtgaagtaggaaagcggtagtgaagacatataattgtgaagataaaagcaccagccggcggcggcataaccagtcggcgacggaagacgatgatgtccatcagtagtggtagctgtataaaccagacgtagaggcgagggcattagtcaacagcagacgagacgaccgacgataaagacgataaagccaatcaacactagcagaatcatgcagccatgaaagtgaataaaccagtcggcagcagacgtaggcagcttgtgttgaagatgctgacgcctattagcggtgacggcgatgtagccagccgtgaagaagatagcatcagttggcgtcataacaggctagccgtgcaggcggtgacaccagtcggcggcggatgaggcggccggtcagtgaagcggccggtcggtgaagacgtagacgcccaacaacggtggcataataggccagccgtgcaggcggaaacaccagtcggcggcggacgaggcggccggtcggtgaagatgtagacgcccaacaacggcggcataataggccaaccgtgcaggcggaaacaccagtcggtggcggacgaggcggccggtcggtgaagacatagaagcccaacaacggcggcataataggccagccgtgcaggcggaaacaccagtcaacggcggacgaggcggccggtcggtgaagacttagacgcccaacaacggcggcataaagcccagccgtgcaggtagaaacaccagtcagcggcggacgaggcggccggtcggtgaagacgtagacgcccaacaacggtgttgtgaccaaccaaccgtatagacgaagacaccagtcggcggcggcgacggcaagccagtggtgatgttctgactgatccattcctggggcgtaagagataagcttaaagccatgaatcccttttatgcatatctggatctggatcctgcagaacgaacatataggatgagtagtatctgatgtaaatataatacttcgagaaaaattcaagtattttaaaatatttataaatatgtatttcttctcttgtcaattttgatttcccctagcagatgactcattatgtttaaacactctgcccgactagtcatagccatcaagcaccgggagtcggcctaagcacttcccaaacatgcatatgagtgacatgagttcgtcattaatggaacaaagtttcatgggtcggagtttactactcgggtacttttgcaattattaagagcagaaaataaattatcttatctctatgcttttgatttattccgaataatacttagcaccttacgttattcggtccatccaacaagcccccaggtgctaggaatcggcccaaaggcaactatccattggcaaaccaaacggaaagcataggaagatggaactccataactcgataggcacttttgtattcagaatatgtcgcaagcaatcaagataaatattatgaaaattgtttaaaaaatatgatataacatctatagccccccgactcactagtcaacggcgaaccagttgatgtagtgaggcaaaggaaaaggcaaaatatcatataaagaataaaataaatgatgacttagctttgtcatattccccttgattatggcagaggtggccaatgtgggaacaaagtcgtccatcaataataatgaagacacccgtcggcggcgacgaaggcgatcgacggtgaaagtgtggacgcccatgaacggtggtgtggccgaccagccgtataggcgaggacaccagtcggcagcgacggaggcaggccggcggtgaagtcgtagaagcccaacaacagcggcataataggccagccgtgcaggcagaaacgctagtcggcggcggcgaaggccagccggtcggtgaagatgtggacgcccatgaacggtggtgtgaccaaccaaccgtataggcgaggacaccagtcggcggcgacggaggcaagccgccggtgaagtcgtagacgcccaacaacggcggcataataggccaaccgtgcaggcggaaacaccagtcggcggtggcaaaggccagccagtcagtgatgaagtacaagcgatgatacatgcaaagacaagaaattgcacatcaacctgtggttagatatttgtaaaaaaaaaataactgatataataatcaatagatccaaacacatggcttgattggcacttgatagagaggcctgcataaccataagcacaaaagcgcatgcacgattgcatgtggttcattggctcctcgttctgtccggcagctgccgtccctgtacaggacttgtataaccatcgacttgttcagcgagtagttcgacgtacaactgcatggtcaaaggactcggccgaatcgacgacaggaaatatatacagataatagattgatctgtaaaaaaataaataaatcaaagattaattttaataatctatgaattggaacagctaacccgatatctgaacaatttaataggggtgtgatctgcccggtcgacaatgacggatatggccgtcagtgggtatggtcgacaatccaatccagtcatcggtgttagatccattgatgagcgcgtgaggccgcaattggtggagatcatgacaccatgcgaacgtgcgacggccgtatagagtaacgtgacgtccaaaatgcatggatcaagacatgcagccggcgagttgcgcagcgacttgtgtcctgtactccgcttcagcctcgatatgatcatcaccgtgatagcatgatggcagtatgacatcaccacgcactcagcagtacatgcatgaaatcaaggagagaaaacaacgtagagtaacatgtgattagggatcaatctaaataaaattaaagtggaaagccaaaccaggtaatagttgcatagatcgatatatgtgatgatgccaaatattatggccacgagctagccggttgatcttgatctcaagcttctttatcgttccaccggtctgcatgcacactcatgattggttgccctggcaagcagtcggcggcttcacggcgtgcagcacgcacacacatcttgtgagcgagaatccagggaccagtgcatccatgcatgccaagatgatcatcagcgctgaacgtgcaaacgcccggcgacgttgctaattggatcgacattgatcttttttctttctgaagttgatttccatcgcactcgttgataggaaactcggcgtcacccctacctggcgcgccaactgtcgaaacaaattttcggcaatatgaaaagagggtagcatacgagacctaaaagtggatggatgcggagacaaaggatttagacaggttcaggccctttcgatgagaggtaataccctactcctgtttggggatttgaattcgccgggtgtatattgatctgacgatcagtttgtgtcatgccccctagagggcctcctgcccaccttatataggatggggggcaggattacaagatagaaaccttaaccaatacggtatcggtttcctaaatctattttacaatattattaaatcaggattttaggccgctccataatataaaaggaaacgtaaaacccaagtcatgatcggttacatattccatagatataagctatcccctatgactagtcggataaccatgccgtgttggtatggggtcattgtgttgttgataagcaggattcacaacatgaaggacctgtacattcaaagggtggaaatcttgtaccttcatatttttattgtgctcagatgtggagcttctgtagcaaggactgggatggccagccccagtgatatggccaaagtgatgacggccaacccaactgaaagtaacctgctgcaaaaacccaagtcagcagcacgtttttaggaggtgttgaggtgatgtcatatttttgaaacttaaagtagtgcgatctctaggaaatacaacacaactacaagatcctctttggccgaccaagagtcaatttctctaatttgaaatatatgccatcaagtcttacaatactgataattagtgggcagaattatccattagttagcaatatggtgcccaagtccaacaagatagttcccttgtcatatttcttctacgtgtactgaactgtggatttttcatgttcaataaagaataaactctgatgaacaatttcaatgtactgaaagtatcagacgtccatactcagtagagatttaggatatgtagtagatatcgtttatataggtgacagtaactgcattgtaccattagttagtcatattttttcgacatacactgatcttcagattctgctgttacactcaataaacactaatcactaatgaataatttcaatattatgcagcatcatagatatatatatatatatatatatatatatatatatatatatatatatatatatatatatatatatatatatatatatatatatatatacttcagttgaggcatcagacatgtaaatattgttcatgtagaagacaataacaatgttgtgcagctaccttactactctgatttcttcgggcatctccaatttaacaaaaacagaggcttgtgcaaaactagaaagatgtgaattactaaaagatgatgggcaattttcttttttggccaatggaatatgtcaaaagcatgtttatcccatagtaaaggtctgacgttggtacttatctctacatcataagggctaacattctgttactaactatagctctaaaagaatatcgcaaagagaaggatatccctaattctggcataagctaaaccattaaaaaccataaaagtctgattccttaaatttgcccaaaaaaaacaatagttgtttcagctccagacatgcaaagacgtgaaaagattgtctatagaataacatacaagattaacatcttttgagttaaaagatgatattaatgatccatgaccacattagaaatttctgtggagggcaacaatttgtaggtggaatccaagctcaaaggaaataatttcagaagagttagcaacaaaaaaaaaaagctatgttagctactatttggaaattaggttcatggaaagttcagtggttattcattagtcacaaatgactatatgtacctcagatgtcaggatcacgagagataagtggggcaaactgtttagaccaaaatatgcaccttcgttaattaagtcctcataataatggcacagaatgtcactgaattcttgaccgccttgcaaaatgtttgccacgctgtggaataatattatattttccagctcctctccaatggtctctgttggccaacaaaaaggttctgaactccttttcaagttttggatcagaagcaaagccattttccttcatttcatcataatactctaaagctctttgcatgcatccgtgtttgatcaaaccttgcacaactgacatatagtgtgaataagaaggtctgatgtcatatcttttcatttcattccagagcttcaaagcatgtccaggttcattcaattgaaaaaatctatcaataagcatgagaaatgtatcactcttaggaccacagccatcatccttcatttttttcaagaacttcagggtttcatcaatgttttcttgtctcagaaatgtatggtatgtcaaaatggttggaacaattcccttcagcatcatgtcctccaacaccatccgtgcttcatcaagcttgcgactttcgcaaagcggaactatcatactgttgtaagttttgacgtttggttggaggccttcatcgataattctagtgaatatattctgtacatccttcatgcaattctcttttgtcaggacatagataagagaattataaacagcaatactaggagtccaacccctctttttcatctcatcgtaaaccctcagggtatcaaaaaggtttccaacttttgcaaaacaactgaccatgagggtataagatgtgccatcaggagtaatgcagtaatttgacatttctctccaaattctctttgcttcagctatatcagtgattacattgcaccaaccatctagaataatattgaaaccttctgcagtaagtgggaagaatttctttctcacgagaagcaattcctcagcatcctctatgtttttatttttgcaaagagcacgaagaagggagtaaaatacagtttgatctgcttccgttttaaacttctccattgcatcaaatgtcttgattgctttgttcacttcattggcagctgcatacctgaaatagccatgtccttacagtgagatgaccgtcgaccattatgcaacaaataaaaacaactcaactaaaaaaaaacaaaaaaagaagtgctactacaatatggactgctgcaaagcaggcattatgatgtccccctcacagcaagacgacaaatggacccgtatatatttttcatccaatgcataagttcaacaagattaaaggagccaaatcccagaattaccactagttaaaacactaacaacacaggaaatggtaacttacggacttgcaacagctttatattcccaaacactaatccattcaataaatcgatccaaccatgaatatttgttgaccatcatagacaatagcacagttataacataatattcaagtggatcctggatccatagaagctgcttgtttgcaacagttttacttcctaatatgattgtgcaagctgataactgcttgttcaccaaatcaatatgatgtacaagtcccttgagggaggcgcacattcagtggcagtaccaatcagtaaggcggaccaaatcattcaaaatgcaggcatacatcaccataaacaagtagcaaacacataattctgacaagccaatcaacaacagttgaatactgcccaagcaatcaaatacttatgccatagcagtagcactatcacaaagctgtttcttatctcaacatggaaagctatatactcctctgtacagaaaaatggagacagattacgaagaggagagaacccacctctccatcacgatgaccatggcgcggctggtgagcaccccgcggcgcagcatgcggcgcacgaccgcccacgcgaggtcgaaccgccgcgccttccccgcggcccatatggtcaggtgccacgcctcgg

SEQ ID NO: 6289 - DNA, 8374 bp, Oryza sativa
cggcggcggcgccatgcgaggtgggaggcgaggcaacggcgagtgggaaatgaggtgcggtgcggagagaggggggtgttttggggaagatttttggtcatgcgggttcaatctcgaggcgtcgtcgtctgtcgtcgattggtgtcatatcgtccgtttgatcacgagaaacatcatggaaaatgacaatccagtccaagctcttctctctttgcattgatccagtgcaatcatcgcaaacaacaactgtggcggcagctcgagctgaaatcaagcacaacgttaattcctttcatattattatgtttttcttatcttatgtttttccaatccgcaaataagcctttatatttttagaaaaaaaaattcaaaggtataggggttgttttgttctcccaaacttgctaaaggttgtcaccccttatgtctaacaagttcaattaataagttagtctattgattcatagtcacgcttgtgataaaattccatttaatttttctggtttcatatgtcaccaactcaaaataatatgttacaatttagataagcaattcaaaaaaagtatgataaatgttggtatccaagcaacctattagtatagcaacctacttgtcgacgggtgatacccgtagaccggatatagagggtattggggtacgttggtacaaggatctacgtagtacaacatcaagcaaacaaaagacaagaattatactggttcaggccctttgataggtaataaccctaatccagttgatgtgggattatatggtagaaaatacaggttacaaagggaacaagggaacttgtcggatccggcgagattgtagtcgagttgtttcgactagctcccgatgacttggctcctcgtaggctccggcttcgtaggctgtgttggttgtgttggccctgagattcaatgccctaaaccttccccggggggtcccttttatattacagatctggaggtctccacgtagaactcggaggtatcagaccctatacgatacgccaacgacccagttctgcccgagtatgattcttctcgtctgtagattccgtgaaaggtttctttataatatacaggaaatatccgcatgcgcgtgggtatgccatatcgatatgtaacgtatatcgaagggtaaagggtatgcgtaacccgtaaccctgacagtagcccccaacttctgcttaaaataaactcgtgcaaccatttgcaacttcgggtgtcgagattgttgttattcccggtgcgaggaccgcggagatagaccgtagtcgagcacgccatttgaagcccaacggtcacgagcgaattttaaactaaagtccagaaaaccgccgcgcgtaacggacccagaaatttccgacgggcatctctctctgttccctggaattcgcaccgtcgatagtgcgcctatttaaaggaattttgggagtccattttgaagtccgccaaacctgttaaacacacaccacctccaagcactctttgccttctccgccgccgcaagaaaccctagttcatcaacctaggctcgtttttcggcgaccttcgatcagcaatggacctcggcaaatcggcttccaccagtgcaacgttgaagaaactccaggaggatggcgctcttcctggtcgtggaaccatggagagggaagcaggaggtactaatcctcagcccatcttgggtcgcatgattgcgatcgaagattatgttctctccggttttctccctccaccttccgaatttcttctcctggttttgaatttctatggtcttaggttgacatgtggagtgcgcatgtcaacggtgcagccttcctatcttttccaggctagcgcttacacatgttttatagttgcaaaacctaattataataatccgcaaatctccatataacaacattaaactttggatcaccatgtcttggtcatacaaaatctgaatcgacccgttcaagtctcctaatatttgttataacctaaagaaccttgtgcctttctttttatgtattgttattgcttctttataggcttgtagctttgcttgtgtgcttcgcgtagcttctgtcgttctggaggttcccgaagcgtggtttgcggtcgtcgccgaaggttcggaaggccgttctctctgagcaaggcaagtcacatcatccttgatcatattgaatcccagtttataaaattattttgatttaaattaatgcattatcgctttatttaaattcccgcgttatcactgttttatttagccatgcctatttatctttgttatgaccttatcgttgttgttattgttattattaccttgttcaccctaggaaaataaaaccccaactagtgggtactctattcatggttccactagtaggaatttaggtagatgcttcgccgattaattaggcaacattaggtggttttataactttagactttgggaattctcatatcatttagacactatggaatggttggcttatgttggaattggacacacacctccccctctattcaaaacccccaaaatggttttaggctgggctcgaggtgcatggttgggttttgttagtcgtacctcgggtactataaggattaagctcgggcctctgttgcaaagcactaccgtacttccacatgtctagtgggtaaggcttagtttgtggctcagtctggttataaacaaaggtacacggatggagatggacgaagtcgggggtcgatggacatctctaggacaaatgaaggctacacgagctgcggcccggtagtcgagatgtcatggcacagggttggtgtccttctgctaggggctcaatcctgtctgcctgtcccggaggttccggccgtaggtggggttgggtcggtactcttgtttatggctaggatgggttgggaactatgtcacatcttccgtccgtatgccgtggtggtatgtggcacgtggttacacgtgaggaagatgtgtcttgtgggtaaagatgtacaccactgatcagagtataacctattcgaatagctgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatcttgtatagctctaggatcgtgtttaccaaatcgctttgggaaactaagtgacttttaaatgctgtttactgcaaaacttaacccctatattataactcccttgtactcccttgcatttattctgcacttgtgggtgtgtcttgttgagtacggtggttgtactcagtctcgctcaatttttcccaaacccagaagaggagttcctggaagatgaaggctttggtgtctagctcgtgcctgccgtcaagcgcctgtggttgtcgcgctagtcttccgctgtttttcgtttgtcttcttgtgtgctgggccttcaccgcccatgtaataaattatctatttacgcttccgcttgttaaactctgaattgtatcaacttttggtgtaccttgcctcctgggacaaggaataatacacgcacgtaaggaacgcccattgggttatttccggtcgtgacacgatctctaacaccggatttgaaggcgcgaattacaaaagcgtcggtgatttcaggaattgtgtttctgccctcgttgaaacgtcgaacatattccctcaatgattcacccgagttctgtgtcaacgcgtgtaggtcgtcttcgatcgcgtggcgcttgtatgttccttggaaattggcgatgaattgttgccacaggtctgcccacgaagagattgagtagggaggaagatgcatcagccatgaacgtgcagaacccttcaacgcggttggtaaatagttcgctaacgcgttgtcatctgctccggcaacatagagtactgtggagtagacttgaaggaactcctctgggtcggtgctcccatcatacttttctattgctccgggtcggaatctctcaggccatcggacatcacgtagggaacgaccgaaagctctacacccagcgttgggggcggtgggttgtcggcggtcgtgtgtgcttcgtggatgtctgtctgacgatgaggaggacgcggatgatgacgatgacgatgggtcgcttggttccagcgtacgattacgaggatgacggcctggatctcgggaatcctgtcgtcgtcttccgctgttgtctcggcgccgatctccatcgtcgtcatcgatacggcggcggccatgaccagtattgtctggcacccgtcgttcgcgatcgttgtgatcgtggtggttgtcgtggtcccggtcctcgtttgagtggtctcctcgatttccgttatcatggcgccgtgaagagacatgacgccgagagcgattcacgttgtctcatgtgcgtcgtgcttctcggtggccgttgatttaatctcgaagatcgccagtgccgcgaggtggaggggtagctcgttgaggtgattccctccgttccggatcttcaccattggcctcgctagttggtggctgctcctggtgtgctgcggtagcggcttcttcaaacgcgttgctgaggttagtcaccgattcccgtagttgttctgtccaacgctcgaggtcaacattcagaacgggatcgtaaggagtttccctcagtatcgcttgaacggccctgatgtgctgggctggagtagtcgattgattccccacttctgtgttggtgtgcgctgacgtgccaacgtcatcgatagccaatacctcccgcggcgcgctcgttgtcgatgacccatagtcctcaaggagatgtaagaccgatggtttgtgaggatcgatatcgattaccccaacgaatcgatttgaagttggagtcactctttgttacttgctgttatccctgatggggacatatgacttaggagatagagctttcatggcgccgagaaagactttgcagctcgagaggtcgtgattctttgtcttgtgaataggacaatagacatcccgagttggagaagtacgctgaattccacgttctttgcaggcgcgaatttcagcacagacgttgaggaaaacccagcaatcttgcagagtgtgtttcttggttttgtggataggacaccaagaccttgtggcttcggaagtcatctttgtcggctcgtggttcatgtcggaaggacaaagtttggccgtatcagaatccttctcgagcttggatgtcgtcgatattccgttctccgtctcgatgggaggatatttcgacatggaatcgccttggttcgtagccactgcgttctcgtctccggtcattggaggaccggttgagatcggcgtcgtggtgtaaaccgggaagacgatttcaccgacttgagtccataccagcattgttgaagtagtgagtacttggctgaggctggtgctgacgttgttgtcgacgaagctggatgacatagtagtagaaccttgagtaccaaggccccctacctggcgtaccactgtcgacgggtgatacccgtagaccggatatagagggtattggggtacgttggtacaaggatctacgtagtacgacatcaagcaaacaaaagacaagaattatactggttcaggccccttgacaggtaataaccctaatccagttgatgtgggattatatggtagaaaacacaggttacaaagggaacaagggaacttgtcggatccggcgagattgtagtcgagttgtttcgactagctcccgatgatttggctccttgtaggttccggcttcgtaggctgtgtaggttgtgttggccctgagattcaatgccctaaaccttccccgggggtcccttttatatcgcagatctagaggtcttcacgtagaactcgcatgtatcagaccctatacgatacgccaacgacccagttctgtccgagtaggactcttctcgtctttagactccgtgaaaggtttccttagaatatacaggaaatatccgcatgcgcgtgggtatgccatatcgatatgtaacgtatatcgaagggtaaagggtatgcctaacccgtaaccctgacactactatattctgagacgaaaggagtattaatttctagttttagcatcagctctaggctctagaataatcttgaattcatctatttatcaaaaaacagaaacatgtaatgcatttgctttacttttcttacatattatataaccaaataacacttttaaatatttcacactttcactggaaaaaaaacatttatgtcctatttcgcagaggaaaagtttcattttttgcacacagttgtcatttcatcgcttctccctatgactaatttgcctacaatcaaatttcctttgcgaattaactccaaactaaaaggggtacctataaaacattcgacagaatggaaaactttcaattgtaaatactatataattacattgtaactatattttataactatattgtaactgctatgtaactgcaatataagtaatatgtaactcatatataactctgaaaaattggatggatcaattggttagttgaatgagcatgcaagctacaggtctcgggttcgatccttgctgtgcagcacaaatctcaaagcatatcgtatggttaaaaattttacagttttcacccttttccatttttctctccacagcacaaatctcaaagcatatcgtatggttaaaaatttgacagttttcacccctaaaaactgttgacagtataatagcaaatccgaactaaaaaaaaataacaaaaataaaccttaataaaataagataaatccgatctcaactctaatcggatgtaaaaaaaaaatcataaaatagacgaaagcagcaactacgcacgtgcagccgtggaggcgtggactcactcgcaatcgcacaaaaacgaactacggcggcggcggcgatgggaggcgagaccaccggtgttagcggcgcggattccgcaggcggttggagtactacctgtacagcggcgagaagaagcacgtcgtcgccggcatcgccatcttcgccgccatcttcggcgttccctggtacttcatgagccgaggtacccctgatcatcactgccctcggcctgctctttatcattccgattttcttcgaatcaggcggtggagtcgttagattcacctaggccggagtcctgttccgcgttcaaatttgatccgcagccgtttaggggagctagggttcttggtaatctcagccttagcacagttcgtcgtgttgcttccccctttctggttgctggattggggcttcgaggtagtactagtagtaaggttgttaaggcgaaggttccattttgctcttgtagtgttaatggtatttggtaggacggagcagtgtgcaaaatagttcaatatgaggatttttggtttgagtattctctgtttctttttcatgatttgagaccattttttaggggaattgcgtgaaatgtatttggatcgtatgaactgctatggatttaaggttctatgtttcgtgcaaaacttgagacatttgaccggatagaaaatgcaagcattttatgtggaacgtattaacttcacaaaaatcataatagtagtagactattacaggccttcgttactacatcgtgttcagatcttctttaccattgtggttgcaatgttctaagattgccatggtcagtaagaagtataagatgagataacaaaagttggaagtaaatcgaacatgaaaagttgctattagtggataatgaattataagagacgtatgctcccctgttgattgatacacataacactatatgatgctctgaattttgtaaatttcttttgcttgacagcttcatttgacagctttagaatgaaagaagcatatgcatgtgcactgggtgaggagaattatagcttaaggcttcttgcaaccctgaattagcaacattttgcagtttagcatttgttgtgtcattaccttgatattcttatgaaccaaacagagcacacattaattccaaaccatgtagtattggatttcaatttgttatacactttctatatccttctattgaaattgataccccaacttaatatatggttacaggtgttctactcaaagtctcaaaccattcagcatttagttatggcttctgttaacttataggacacaatgtatagctttatcagtaagctatacgcataggtcatagggtgtgtttggatcgtgggcaagagagatactaacctaacttagcaaagagagctacttggtatctaaaataactctgtgcg

SEQ ID NO: 6290 - DNA, 31765 bp, Oryza sativa
  unsure (1)..(31765): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaccttggttgcggcggagatgggggtggcggcggcggcgagggagccggcgctagcggcgaatgtgatgctggacagatcagagtgggccgagaagaatgattcgggcatttaattgggccgtttccttcaaaaggtttcggattggaataagttcgggagtgactccctttactagtgaccttatctaattcgtatccctgaaccacagtacgaatatctcgacccctaactattaaaaccagtgcaatttaactttaactgttttgctgacgtggcggtgttgacccagtcttcatccaacatttatgtggtattagaattaaaaaatatatgtagtacccatttgtcactcacacaaaaataattgtgggacccacttattatacgggcccacatgtcatcccctctctctccttcccttctccctcctcccccctctctctcttatctctctttctccctcccccctcccatggggcctttctcttcacctgggtggagcggcggtgggagcggcggcngctgtgtggggagcaacggcgccctgagggagctgcgttgcacacgtagccgaggaggaaaaggcggtggcgcagcggcgcgagggcggatggggagcacatggccggcctgcacgccatggcggcggcaaggacgggcgtcgatccactgtagaagaagagcggtgggggtgtggctccacccgatgtggacgcggtcgacatggcaagggaggcgggtggtgacaccaaggaagacatctgtgcgcaccaccggatgcctccgtcttcgctacccaccacgccaatgtctccgcttgccactgtcgccgcccttcctctggccccaacacgctgctcccacctagcaagcggcaaccacccgcctctccccacctccgccgccgctgccaaccaccggacgccgccgccgtccccactgtcatatatagtcagataaagagagaagggagagagagaggaagaaggggaggagagggccccacatgtcatcctttgtgtaaattggtcctacacataccctttttaattctaattctacttaagcgctacatcaacgccacgtgaacgaagacccggtcaatattgccacattgatgtcacatcagcaaaaccaccctccaaaactactaagggagttaaattacaccagttttaatagtttggggtcaagatatccgtattgtggttagaattagattcggccactggttaaaggagtcaacgtaaacttattcctttcggatttgtttcgtttcgcaccaaaaacctatgggcttatggtgggttttgtgaaatcctctccggcctatatatagtcatctatctctcctctctcgatttggaaaaagaaaaaaacagtttctggtaggcattctcgaacgagatatgagtaatgaaatcgaagaggcgtgttgagtgagctcaaatcatcggagttcccattcaattgccttttgtttgtcaactgtgcaggttgatgctggcatgctgttagccagcttagcacacgttcttgtcaaatactcgagtgacaagaggtgttatgcagttgattctgtttctgattaatcttaaattgttaatcctcggatccaacgcacaagcagttgaccagttgagcaaagtagcaactgagtagtgtgtatcaacgacccttctcttcgcagcaaccagcaataccattaccagtacagttcagcaactaatcgtgagctgattagctgaagcacataacacgtaaagcgtccatgacgatggagaaacgcacgtcaccgcaacaaccgccaactttattacccaccaactgctcgacgcatttcctctacgcgcgcgcgcccaccaccgccggcgtcacacctcgccagccgcatcaaagcttccgctcctacctcgcccaaatgggcggcaccggcgacgatggcgccaaggcccctgcggccgccgcggccatggacgtcgtgtcgtcgtcgtcttcttctccggcgccagcgccgtcggtgctcaagtcggtgctactgtcctatgcgtacgtgagcgtgtggatcacactcagcttctcggtgatcgtgtacaacaagtacatccttgatcccaagatgtacaactggccattccccatctccctcaccatgatccacatggcgttctgcgcctccctcgccgtggtgctcgtccgcgtcctccgcgtcgtcgccgtgccggcgtcaccgcccatgacgcccagcctctacgccgcctccgtcgtgccgatcggcgcgctctacgcgctgtcgctctggttctccaactccgcgtacatctacctctccgtctccttcatccagatgctcaaggcgctcatgcccgtcgccgtctactccctcgccgtcgccttccgcaccgactccttccgccgtgcctccatgctcaacatgctcggcatctccgcgggcgtcgccgtggctgcctacggcgaggcgcggttcgacgcgttcggcgtcatgctgcagctcgccgccgtcgccgccgaggccacgcggctcgtgctcatccagatactgctcacctccaagggcatgtcgctgaaccccatcacctcgctctactacatcgcgccgtgctgcctcgtgttcttgacgctgccgtggtacttcgtcgagctgccgcggctgcgcgccgccgcgggcgccgccgtccggcccgacgtgttcgtgttcgggacgaactcgctgtgcgcgttcgcgctcaacctggcggtgttcctgctggtggggaagacgtcggcgctgaccatgaacgtggccggcgtcgtcaaggactggctgctcatcgccttctcctggacagtgatcaaggacaccgtcacgccggtcaacctcgtcggctatggcattgccttcctcggcgtcgcctactacaaccatgccaagctgcaggggctcaaggccagggaggcagagaggagggccgcgtcaatggcgacggcgaaggacggcgacgcagaagccggtgcgcggctgctgccggagaaagatgccggtgagcagaagaactgatcaaagtcgaacaccaagcatagtacattaatgaaggttgataaatcaacggcatttttttcatctttagatagcctgaagctgcttagtattatgtttgtaaacattcattattacagaggatacaaatgatcagtgattcgaaatatgcatgcttaaattgcagcattcattttttttctcattttaaagattcagtcatcgtgttaaaactccttgctccctgggcactagtgttcatctaacatcactgtcacatggttgttaatcgtagcatactagcattctgtttgttgattgtgctatatatgaatgatttggtgcacgatgcagtaatgcagagctccaaacctgataatccactggctaccaaatactaccttcagttttactcaaagtgcaacaagaaaggaccaaaagacaaacaaatgcagcaaggaaatgacgcaaagtgtcattacagtgaagatagtatattgagtgactagtaggtcagggtagtagaagagaaagggatttgctagcttcctactcgtacttagggcaagttttataatagggatagttgtcacatctaattttatccatgtaagataagaggtgatatatataatacaccatatctacaccacctctattattataacccaaataattttattttatttgtttgtccaatcccctctttctttcatcttctttttcttggggtttgtgtggaggttgccccttgcatgatagggggctcaccttctctttcctcaattattacttccacctcatcatccaatcatacatgatatttttagaggcaacacattaagcatcatagtacttgcccttactgctgcctacgatataggagtatcctcctaaaccctataaactctaatactaagggcttctttaaaacacaggattaaaaaaagatacatttaaaaaaaaacaaaggattttgatagaaatgcaaataccaaatagagaattataaaacacaggaaaaaaacacgaatgatcgtttgattaggctataagaatcaggataagagatagacttcaaagaaattttcaaagaggttagagctcttgttaactttcctctaaaaattttaaagaaaatgagagaaaaattcacaaaactacaaatattatgactaaagcactaaaaatttaattagtgtatcacaaaacagcagatttaacactaaatttatcacaaaactatacgtttaagatgaagtgtcacaaaactacatatttagtaacaaaattatcacaaaactatgggtttagaaccattttagtcacaaaattacaacacttattgctccaacataacaatggtgttagggatttaaattctaaaatatgtacttttgtgatgaattcaatattaaatatgttgttttattttttaaacacattaaatctgtagttctgtgagaaatttggtgccaaatttgttgttttgtgatagtttggtcaacatacatgtagtttgtgaaatttacacaaaatgatatgattcaatccttgtttcaaatgcttttataggaatttttataggaattttttcgatatgattaaaatctttcaaatttgaaatcaaagggggggggggggtaagtagtactatctttaggttcattaaaagctagcaacaagaataccgaagccatcatttcgcttatttgcgaactaagagaaacgacatatttgcaaataaaaagtaatttgtgaataaaactttttatatatatgttcttaaagatctaaaagcaaaggctaaaaaataaacttcgatgaaaaaaacctcaaaattagctccaaatttacggttgaaaattcaaaatttggctgataagtataagtataaacgaaaagcagctccaaatttaaggttgaaaatttaatttttgactgataagtataagtataagagaaaagatgaggccctacatgaagtcctgtccaatcatatatgcatcattgactctctctctcctttcaattgtattaatcgagtaatatttcgctgagtctgattaacctaggccgcgttttgttcgtgtgccaattttttttaagtatacggacacacatttaaagtattaaacgtagaataataacaaaacaaattacagattccgcctgtaaactgcgagacgaatttattaagcctaattaatccgtcattagcaaatgtttactgtagcatcacattgtcaaattattgtataattaggctcaaaagattcgtgtcgtaatttacatacaaactgtgcaattggttttttatctatatttaatgattcatacatgtgtctaaatatttgttgtgacgggaatttttggaagtttgaaagaaacaaaacactgccgtgcatttcgccgcacattggaggcccatcaagattttatatggccgccatggtccaaggcctcagggacatttcctgtattgggctgagccggactcttcgtcaaggatgaatttgtaatcagtgaaaaaatcgaggggctggatgcaaatctccattcccatcgtattcctctccttccagctcgagactagggctcgcaggtggcttattccccctaatttgctcgggaccagaccacacctccccaaggtgagaaccaaatctctgattccaatcttgttacgttcttggttgttctttgccttgcgatttgggagcggcagcagcagtaaggcgctcgtcaagatctcttcttttcaattgttggggtcgcgctagttcgtcgaaatttatcctttccgattgctggattgcgtcatttcgttaatatttctccttcccaatacctatcttgtgctatttggaaacgagagcactaatctacttcttcgatctaatatgtttgtacaggcccttgtatataaacgaacaaactttactcatatattcagtccattaattttaggtcctaatagttgttttttaacttatgcgaaaattgcaatgtgctgaacagtgcaggtgatatctctttcttaacgaaaaatagagtcagcatgtaattatctatatggtacttaagatcctaaaaattaagcaagggctaggttgattgcttgctgtttgaaaattgttccagttagcattttgctccattctttgttattagtcagactctcaactgctgtcatgttatttactcaggaattagatttttacttcagatatcatattatgcaaattgtattctatttctcatcgtgcttttatctctgtgcctttttcttttcttttcctttcccttccatttcacggaatatattggcatcatcagcttgttgattattcttcgcattgcatcatctttgcttcccctcttttgcatgctcttgctgtccatgctgattggggattgtatcttgagaacctccccgtgtaatcctttgtaaccataccactgtttcctcatttgttccatatacattttctttctatccagttggatacccatggctgcatcctgtttgacattattgcataacaagtactcttgtttatttggttgtttttcttcctatccttgtatcatcactttgctctcccaatattgttggctcctttgctctttccaaagttgccttggaactttgagcttttcaagatgccaaggaggacagataatgctgcttctgccaattcagttgaaccagaaaaatcagaagaatgtttggagtttgatgatgatgaggaggaggaggtagaagaggaggaaattgaatatgaagaaattgaggaggagatagaagaggaggaggtagaggaggatgaagatgtcgtggaggaagttgaggaggtagatgaggaggaagatgaggaggaagaagaggaatctgatgaaactgaaggtgtaagtaaaactaaaggtgttcaccagaaggatgttactgaaaagggaaagcatgctgagcttcttgctcttcctccccatggttctgaagtatatgttggaggcatctccagtgatgtatcttctgaagatctgaagagactatgtgaaccagttggagaagttgtggaagtaagtactgcttacattgttcattttatgtttccatgtggcctgttttgttctgaattacatattctcccgttttatgcaggtgagaatgatgagaggaaaggacgatagcaggggatatgcttttgttaattttagaacaaaaggtttggcattaaaggctgtcaaagaattgaacaatgcaaaactgaaggtttgttttctgttgaacttgagaaatgtctatactgtcactccatcagtgccattgatttttaacctaagattggtaattgatcaagcaagttctggacatttttactacaccttttgcagtttccaaatgtgaactggtagagaacaaaatagtgatttcactcgaatattatcatgcaataagctttccttttttttaattttttttcagtcttattgcacttatatctgcagttgacttctgttgattttgacatagcacagtaatttcacacatcagctgtgctccctgtttccctggatatgtaggaagaaagagggaggggcacacacatatctactatacatgatctctagtaatatcatggttttgtaacgtgtaatatttggttaaaactactgattatgccattaacaggaaacacttgttcatgattgggagtagtggtagcttatgttctcttaccaataattttggaaaacatagctttgctgccttgatcacacacatgtgcagaatatctcctggttccctgttatagctgacaacttatctatcttgatcttttatacctactgaattttttcattatgcttctcgttacagggaaagcggataagggtttcttcctcgcaggctaagaacaagctttttattggaaatgtaccccatagttggacagatgatgatttcagaaaggttgtggaggaagttggtccaggagtattaaaagctgatctcatgaaggtatggatctgggtagttcaacaactttgttatgcaccctcgatcttgtttctcctaaaaatttctttgtacttgtaggtctcaagtgcaaatcgcaatcggggttatggttttgttgaatactacaaccatgcatgtgcagagtatgcaaggcaggagatgtcttccccaacattcaaactagattcaaatgctcctacagtcagctgggcagatcctaagaataacgactcggcctctacttctcaggttcgttcaagcataacatgaacaattttactttgtttgtgtataattcttataccatgatgttttatttgaacttgattattttgcgtgtgttttcaggttaaatctgtatatgtgaaaaatctgcccaagaatgttactcaagcacagctgaaaaggctgtttgagcacgatggtgaaattgaaaaggttgttcttcctccttcaagaggaggtcatgataataggtatggttttgttcactttaaggacagatccatggccatgagggctctgcagaacacagagagatatgagcttgatggtgagctttcctcttgcgctgtaatgtcccactatgcttgcgtattcccccaaaaaatgtcccactatgcttagtctggtttgtctggtgcattcaaggtctcacatatttctcttaacaggtcaggtcctggattgctcacttgcgaaacctcctgctgctgataagaaggatgatagagtaccactacctagttcaaatggagctccattgctcccgagttatcctccacttgatatggtatcatgtcagtaccaggtgcctatggtgctgctcctgctagtactgcacaggtacacgagtacatcatcatcatagacccctttgcccaatcaatgagtaaatacatgtagtaaaggatgattgatgcccttctaaccattgtatgctctgcattttgcagcctatgctgtatgctccaagagctcctccaggtgcagcaatggttccaatgatgttaccggatggtcgtctcgtatatgttgtgtaagcgctaccaaccatcttttcttcagaaaagctaataacatgttatcacctatcagcatgagatgagatgaaatgacttctgttcagttacatgtcattttggcatttccattgctgatgatatcttcattgcttctttgcagacaacagcctggtggacagttgccgctggcttcgccgccgccgcagcaagctggacatcgtagcggcagtggaggacgtcatggcggcagtggcggccgctatggcggtggtggtggcagctccggcagtagcaggccaggtgcaaagcggcagagaggagacgacaacagcagtagccgccacaaaggccggcgccgcccgtactgatctgatcagcatagctgtagctaccacttagaagatgtagtgtcgttgcagaaaattaccagaaaatctggtagaaataatttatactgtttgtactcgtcgatttattagaggaatgcgtttctgaaacaagactgtacatgcgtattttacctgtatcgcagagtgctgaatctgatggtgcactggtacagtataagccagtttcaggtctctttgtaagcctgttttacattatctttcgcttttgcagtaccgtcaattcacccctgtaagccacatggactatgagatttctgggccagaatctgaggtagacagtgaggtgtggcttggctgggtggcgcagcgacgtgtgtgctcaagactggagacacggttgatgctgcccgagctgaacacgtcgtgttgactctctcgagaggcggacgggtacgtgccgcccctccatccattctagccttctaatctaaaagcatccacgggctctctggtgcgctgcttctcgactagacgcctcctccggggaacctcgtacagggcggcgcgggccacagctccatattccggtcgacggcgagtccacgaagcatcggacgccggcgacgacactgcaatccggcggtcctggcagcaggtgaaaggtgcgtgctttctccgcctgagaatgattggttaattccctttgcaattaacttgcaaattctttttctaatttgtgcatcaaaatttccggccatatggtgattgtacatgttgtattggacttctaggcgccggattggccaacttctaaatttatgatgcttttgcgcatgacaaaaatgacagatcatatttatccatttacttcattctaatgaaataactcctagttaattatctttaggttgctcatagagtcatagttactcagggttgggctatccggctatgctgtaccgttctatattcattgatattttgcctgcccaatattgtacgcgaagtgctacagttaacatgatcatcaatgatgctaggtgtctgatttccctgaaacatgttaggttcatgatgctgatctttatttatatacgaactgttatgtatgctctatctggtcaagtcatgcttgatagttgatacatccttttgttctgaagaattctagtacaaatttaggtttttgaacaacagggcaatgtcaaaggttgcaattgttaggttagcttcaaatatacatttgcagcataaactgccatgtctctgtccagtagttatgccaatgtttaacctagattatttcatttacttgaggaaacattttttttgaatttagtttctctactctctgaacaatccaacctggtactgttatctgattctgtgaattttctgaactttatacagggcctatttggtgtaagaatttatatatccgcccactcatttagtcatctgcatcttctaagttgggtgaaaaaatatggatgacggggagatagagctttccagccaaatgatgtttccaaatccagagattccaaccagccttgatgacttcctgccaagcatcaggacaacatgcacacacactcatacttgcaacccgcctggtccatcggcaacagagcacacccatacatgctaccacactcacacccgtgtcttcagctcagatgatgatagttgtggaggtgacaaagccaagccaaagaagagccgcaagccattgggcaaccgcgaggctgtccgcaaataccggcagaagaagaaggctcatacagcacacttggaagaggaagtgaagaggctccgtgtcattaaccagcagctggtgaagaggctgcaagggcaggctgcacttgaggtggaggtggtacggttgaggtcgttactggtggatgtgcgatcgaggatcaatggtgcattgggtagttgcccgatccaagcacaatgtggagttgataatgttttgggttgtgatggaatggctcagtgctttgctggaaagccggagttgggtgtgagacagagttgtgcaccttctacagtgaattgccatatcagctcggattcagggcagaacctggtggtgccccatgctttaagccctagcgatgttattggaagcttcatggtctcatctacctcaaaggatgagtagatattgtaggtattattttgttgagtaaattgcatattggtccatgttttttaaccatggtttcacattggaccaccattaactgaatgctttcactttacaccagattttattaccaaaatgtatcactttggaccagtggtccacttgccagtgtggctgaggggaaaaaaaaaaggaaacttctcggttgggaaggaaccagcgagtccgctgactcatctcctaccacaccgttgatctctttccaacttcacccaaccatctcatggcggtgtgggcagagatcacgctaaagccttgggggcaacatggggagcttgtgactggaaagactcgtgtggaggtcgatgttaggcgacgtgagcaaagaggagctcgtgtacgtccaggtacagcagaagtcgagtcacggaggcgacggcggtggagaggagcttgagctccgggatggcgcgcgggcatcggagtagccgtggagatcgaggttgaaccgggacggcagagaggagcttgagcccaagtacgatgtgctagtgctactgaatatcgaggtcaagcgaggtgcgacgacggcggagaggagctctagctcggggacgacgtgcgggcgtaggtgaagaacgaagtcaagctagcgagggccgacggcggcggagaagagctcgagcttgaggacggcacgctggggcgacggagccacgtaggtcaagctggggtggtggataggagctcgagctcaaggacagcttgtgggtgctgatgcctgctggtgcctggaggtcgacgtcgagcggggggagacacggcagaggtcaaggccgggggtggcgcgtcggcatgggactatgggagagttcgaggtcaagacggggcatcaacgtcgagcggggagagacacggcagaggtcaaggccgggggtggcgcgccgacatgggactatgggagagctcgaggtcaagacggggcatgacgacagcggagattgaaatcgagactgggaaatgcgtgtgtgcgggaacaggcggaagtcgaggtcgagccaccggacgacatcggcggagattgaaatcaagccagggaatggcgtgcgagtgcgggcggaagtcgagatcaagccaccagacatcgagcttgagcctgagaccggccggcacgacgggaacaaaagtcgagctagtgtgacgccgtgttggcggaggttgaccccgtgctggctggactacgagcttgagatgcgcgggcgtcagctctgttatatatgctcgagctctcttaggcgtcgtggtctttgtggtctacagccatcgatgaaaacagttggagatgatcagatagggatgagagattggctctgagagactgactatgggccatacgcccaaagtgaaaggttttggtataaaatctggcctaaggtgaaaacattatattaagggtagcccaaagtgaaaccatggtaaaaaaatatagtccaacatgtaatttactctattttgtttctagcctttttatcagaagataagacagtagtattacagtgccgtggagcctggagggttgatgcctcgtttcctaggtggcattttacccctgaaatctggtgcaagttagtaattagttttcaggttcattatcaaatacaaatttttggtttctacgtagtgtaaaatgtctttggtttctatgcagtgtaaaatacacatttccccctcttttccagagataatgttcagttttaggaatttgtgttttaggagctgttaattctgagcatttccttcttttgcagatactctgtccaattctgtgagtggttgggtgtgatattctgtagttgttaactatgcacttttacttcttttgtagagatgatgttctgtttttggaaagatatttaggagctgcatgactcatgaatccgatggctgtataatattttctgcgtgccaaatctcatgatttttccaactcattaactggattaggacacaaatctgcaacagtcagctggagatccctgatgagcagcacaaaccggtcctgaaactgttcaaatacaacaagaacaaatctattatcttattaaagtaatagaaaaagaagccaccacatttgttctcacggcctagaaattaccacgttaatcgaagaaaataagaaaaataaaaaaggcaagcggagaaggatatgttaatagcatgaaaatatgaaaagaaatagtaaagcaatcaatcggacaaggattcatggaaactgtaaaagtgtcaaacatcaataagaaacagacttagtgtgtggaaacggaaatacaacgatacaagtaaaaatagactccggtcacagtgcattagtatcgtttagagtccaaaagtaaaaaaaaacaaaactatttaaaatacctgaaattcaaaatataactaactattgcaagaagaatctatgtataaatacaatttatactaatatgaaattacaattattttttttaggaaatctaaacattgagaccagagttatatagaatttacttaaaaaagagtccatataaaaatataatttaaaaatatctgaaattcctaattaaaaaaaaagaaatattcaaagagaagactagactccatgtatatacaatgtagaactaattaaaatttggaactaaagttagagtccataaagaaacaaaatttagaaataactaatatttggaattaaaaaataaaaaatattgaaagaatattttagattcattatggaaatacaatttacaaataacagaaattcagaattaaaagaaatatgggaagaggagtctagagttcatatagtaatacaatttaaaaataattggaattcaaaattaaaaataagaaatacttattgaaagaaaggtttagagtccatatggaaataaaatttataaataatagaacatttaaattagaaaataagaaatatttttaaattagaaaataagaaatattggaagaggagtctggaatccatatagaaatccaatttagaaattacaaaaattcaaaatttaaaaatagttagtaactatcacgtatatacaatacaatatgaatattatatgtgatatacaatacaatatgaatattacatattggttggtgctgttaagttagtacaaaatttaaaattatgttgctattttaatatattttaattatattatgtgaaaatatatgctactatgtgaaaaaaaataatgatatacaatacaataaaaatatcacacatttgttagttcaaccaagaatttaaaattatgttgtcattttaatatattttaataataaaatatgaaaatatttaagctaatatatgagaaaaaaatttaacgatactagccgtgcaatctgcgcgggccaccatgctaaatttttttttttttgacaacagaggtacacaagcaactccaacttcatttcagacgtacacagaaaacaggtacaccgtacacgaacacctttactcataggcgtgcaagaccaagtactccattcacatcgcatacacataaaaactcataaatctcacgcaaacaagaacatcataaaaataaatataaaatataagatactaaaataaccagagcaaaggagatcactaagatgattcactcatagttatacgaaaagaaagaagcaacagagagctcaaccacaatgtttcagttccagacaaacgctgcgacggcgagcacagcggcagcaacagcaagtgagcagctcccaccggcggccatggggcccgtcgccgccgcgccgttgttggacgatccgctgtactgggcggtggcatcctcaaaacagctgacgatgcatacgacgaacagcacgagcgcaatgaccggcttgggagaagaacgctccatcttgttctgcttttgcttgcctgttcagagttcagatctcagagctgagacgatacacttgagcatttcgctcaaattgacaggatttatatagaattgcctcaagttgacatggtaaacatagtacacagatgcacaatacaagtttgtccatttctctacatcgtgttctgctcgccaggatgagttgggtttgatctggacggctggtttgttgctgcatattcgtctgaaaaattcaacaagcagatgaggtgctggctttgtttctgatgctagagttccttcctttttgtcacttgtaagttgtaactttcactatccatacaacaaacgtaacaaaatttccttttcagagaacaaaactgatgatctgattgacaacgtcagttcttatgtgtgttggtcgcatcgcatttatcaatgagcttagatgatgcctatgttcagctgatgcctgatgccatcagccacagccatgtcgatacgctggctgattagctgatcgatgactccaatgtaagcatggaaaccacctagtacatcatatggcactccggtgatgagaggagttcgtgttttcttggggcgctgcgttgctggagttcatggggccagccgcgccgccgtccgaagccgccgcggcggccgacgatgtggtgctcccgtacatctcgcgtattctcatggaggaggacatcgacgacgacatgttcttctgcctgtaccccgaccaccccgctctcctcgaggcgcagcagccgttcgcccagatcctctcctcctcctccggcatcgccggtgaggtgaacagtgcacccatggaggattctgctgccttgatgatgcaggggagcggcaatggtaggggacggaagggtagtaagcatggcggggacgagctggaggccgaggtgggcagggcgagcaaactgatggccacgccggaggaggaggacgacgacgacgatggcgtcggcgagatgttggagaagatgatgctcaacggggacgaggagatgaacgcgccacgcgtccccgcggagaaaaacggcgggaaggcggcgcggcggaagaggaggcagggcaagggggaggtggtggacctgcgcgagctgctcatgtcgtgcgcgcaggcggtggcatcgggcaaccgccggagcgccggcgaactcctggagcagatcaagcggcactcgtcgccgacaggggacgccaccgagcggctggcgcattacttcgccgacggcctggaggcgcggctggccggcgcggcgagcctggagcaccggctgctcgcgtccgcggaggagcgcgcgtcggccatggagttgctggaagcgtaccaggtgttcatggcggcgtgctgcttcaagtgggtggcgttcacgttcgccaacatggccatcccccgcgcggcggaagggaggagcaaggtgcacatcgtggactacggcggtcagtaccacggcctccagtggccatccttgctgcagcggctgacggagagggaaggcgggccaccggaggtgaggatgacgctcgtcggccacccgcagccaggtttccggccagcctgacggctcgagaggacggggcgccggctcagcaactgcgcgcgcgcgttcgggctcccattcaagttccgccccgtggcggcggcgaggtgggagacggtcaccgccgaggacgtcgtcggcgtcgaccacgacgaggcggcggtcgtcgtgaacgacgtgctcagcctgggcaccctgatggacgagagcggcgtgttcgacgacccgagccctcgggacacggtcctcggcagcatccgcgacatgcgcccggcggtgttcgtccaggccgtggtgaacggcgcccacggcgcgcccttcttcccgacgaggttccgggaggcgctcttcttcttctcggcgctgttcgacatgctggacgcgacgacgccggaggaggggagccacctgcgggcggtgctggagagggacgtgctgaggcgggcggcggtgggggtgatcgccggggaaggggcggagcgggtggagcggccggagacgtacaggcggtggcaggcgaggaatcggcgcgcggggctgagacaggtggcggtggaggccgacgtggtggaggcggtgaggcgcagggtgaggaggcggcatcacgaggaattcgtgatcgaggaggatgcagggtggttgctgcaggggtggaaggggcgcatcctgtatgctcactcggcgtgggtcgtggcagaggatggtgcgcactagcaactagccgccatgacggtgttcgtgtgtactgggaatgcttgtttgctgttggatcagtggagtttatggtctttggattgtttcatatccctgcagcaactagcgttggagagctcacagtagtaacaacaagcttagtggcaataatcctttcagctgcttcagcacaagacgagcttccattgtccaccaatgaatgactaatgtaatataccaggaaaaccataacggcataaccactagcttcctttcagcacaagacgagcttccattgccatttgtccaccaatgaacgaccaaccaatgtaataataccaggaaaaccacagaccagaccacataaccacagattagagttcagtccttgaagattgctgaagttcgatgctgatcccacgggatctttcaactgttggcgttacagcctttctttctttggtgcttagcttgggcaacgtacaggtacaggcaccgcccatatttctgcagttctgctctttctgaagcttattgggcgaaagatattgccgtgtcaacattagtgaccactgaccagccaacacaacataagatacttctcaccgagatcaccccaacacacacacacacaactcaaaaacttgaagaaaccggtgccccctccacttttatccgggcttgggaccggcactggcagtgttaggcacccccctacccccaaacataacaccccaacacgtcaagtgaaaaaacaattggagcacctctgactgttaaacagtatgaagttagtgagtataaagaatagatcgagttagctacccatagcccatcatagcatctaccaacatcaaggagagcaaaaacgtcgaataaagcaactatcgtcataatcaaatactagtaattcaccacaagcaacctaggcagaaggagctatatataaccataccgacgaaaataaacaaatgcaaatgcagtttgcattagactaacaatgcaaatgcgcatagaaaaacagactaactaccaccactaggttccggtaattatactagtatatgctagtttgccaaacaggcagataacataaactaagttcaacatctaaggataactggaacgctacgctaataaatttagctaaaaccaaattttccgaatgaaatcgtcttatcattgattaaccgattttctgtgataaatttttagcatccgacaagtggaagtccatactcaatattgccttcaaaggatatacatgaaatacaaagtcagcacaagtgcattttcagaacttaggacattcaacatggttaatactcccaacacataatttaggatattcaacatggttaaataccacaacacatatctcaattattagtgtactatgcaaagaaaaaaattagattgagcatggcgacgttacggagtaaaaattatgttcggattatatattccctaaataaatgttagctcatgtaaacaaactgacagaaggtatatgccaatcaatacacacacaaaagggaagatattataagaacaagttatcattttaataatatttaatttaattacatattcatcatcctgttaaagatcatatcaaaccacgtttgaatggataagttgaaaatattttaaataatatagattcaaaactatgtgcactatattaaatttaattccatatccatcaccctattaagtaacttactaaatcagaactgtagtgcatcaaaggaaatagctgaagaaaacacgacataaatcagaagaaacttggcaaatgatcaagtcataataaaattacattaatgtaagcattttaagtgtatcacattgcaaaaaacattttgaagacatcttctgatatgtactttatgcacaataataggaggtaaatcaacgataaccacacagaatgggcaatgacacacgaaatatgattaaacaaacatgagctggtaaaagaaaactaaatacataattactagctcagcaatttccataaaaaaaacatacaaacactatatctatttgacctcaatctcatgaattactagatcttcacaagtattcgcatagtaacacaacatatattgacatcaaataaataaacatcagaaagcaaccatagaacatggatatgatactttctagcctttggaacagaatgcagatggaaaactaattagcaagaatgaaatgttaatcacgcgaacaaaatttagtaaaaaacaatttttgggaatgaaatcatcttatcgtcatgcaaatgatcatttttactaaattccaaacatctgacaactagaagtccatactgtaacatgaaaaagacaatatttggcagaaagctcatgtaaaatatattctcacacaactgaaatcatctggtgccagtggatttcagaatttaggacatttaacatgattaatacttgtacattccaacacatacaactctaaattagcaccttattatgcaaagcaactaaatttggattgagcgtgtatagcaatcactattaacaacattaaaaatgttaggattagattttcctaaaataactgttactaggtcatgtttacaaactgacggagcatatatagcaacattattaacacagtaaagaaaatgttaggattagattttccctaaataaatcttactaggtcatgcacacaaactgatagaacgtacttacgtacatgccgacacacacataagggtaaggcattaagagaacaagttatcaatttttaataatattcaatttaattgcatgttctaaatcctgttaaagatcatatcaattcaggagtcaggtggtggaaaggataggtttaataagtagctatatagattcaggagtcaggactatgtgcattatatttaattaaatccatcatcttgttaaagtaactacgaagactatcagaacagtactgcatcaaagcttggttagggatcaagtcattatcaaaatgatattaatgtaagcattttaggtgtatatcacacttaaaaccattttaaagtcattttctgatatgtactttaagcactttcaatatgtcgtacgtcactgcactctaataggaagtaaatcaaagaataaccaaaaagcattggcacatgcaatataattaaacaaaattcttgcaggagctaaagtaaaagaaaactctaattaaaccaaattagccgccttatcgccttatttataaaaacgcgaaaggtgtgaaggcatcaaagcttttaatagcaatacaaatggcagctactagcttagtaatgcctagaaagaacacacacaaacagtatttatttgaacttgtatctcatgcattactagacatagacacaagtaatggcacagtaattgcattgacgtcaaacaagcaaccatagaacattgatacgatatttctaatatttggttatgcagatggaaaacaaacaatctgggaattaataattagcaagaaaaaaaatgaaatgttaaggcgctagctggatataggatatatttagcacaaagaaagcatcaagttttagaccataaaataaaactatttgcctagaataaattaatgctacaaaaactaaagcacctatacatttagccaaaaagagattactaaaaccaccagataatgtatgaagagatttaaggttggttcaaattaaaaagacaaactgaaaccatgcacacagagttgatgcacaaataaaacaactggtggacaatcaaggttctcaaaaccactatactagtctaattagacaaataaaatggagaacttgtatgcagtttcaatcacagatttattgacaagagaaataaccagttagtgaattctgtagcttgtatgcaatttcaatcacacaagaaaaatgatgcaacaaaacaagtcttaaggacaaaattgaaactaaggaagaatgctagccatctagcaaaaacatgcaagggccaccctagaatgaaatggaagttccacacatgcaggtatataaaaaaaatgaaatggaagttccacacgtgcaggtatataaaaaaaggaagaagggattctacacaaaacaagaaaatgaaatggaagttccacacatgcaggtatatataaaaaaaaaaggaagaagggattctacacaaaacaaggtcccagttgagctaagtttatcttcacaacgtataataaaattgataactatataaagcattacactggacaaaaatactaataagcatgcacatttaagtgaattaatacatgcaaaaggatgctatatattagttgttctgttagtatggcactacctcacaaggcaaaaaattctcattggcaagcaacaatgtgctcttgtttaaggtcctttcttggcaaatcttaattggggatactatgttgaatgagatataataattataaagaaagaaatataccagacaaactgtaagaagaaacaagttagtgataatgtgttgttgtgattagcaactaagttcaagggattcacctcaattcaaaagccctggacataagatatataatttaggacaattcctatcaagcataatatttaaaaaacatccacatttccatcttttatgagcctaagcaaaaattgcctcgacactgtaaacttcagttatctaccaagttagtatagaagatgaataactttcaaaactgtggaagctgcaagacgatccaaaatattcctggaaatatcctagttcctgaatgaagtgctacaatgctacattcaacactcacaaaatgaaagcaagagagaacaatgccacaagagccatagagtttcattctatacagactaaatcagtatatggacaaaattaccatgttacaactcaggattatcaaaacaaattaccatgttacaactattatacagactaaatcagtatatggacgtctatatcatttgataattacaatttccaacatcagagggaagcttaatgaacacacaaattacaagatgacaccaaaccaacatacaagagggccaatcatatgttgaaatgaacccatatcctagctagttatggaacagtacaagcccatatgtaaaggatactactggagatgcaagctggaccaagtagaaatcaaatactgctactgagaactcctccatggttcataaagcaattgtttctactcagaagaaacttcaaacagatggctttataatgttgaggtccataaatgttcttgaaataaatcttcaaattaatttcacccaaagtagtcaaaagatttcagaatcaccttcacaaccttgtaatattgttcgaaagaactgccaaatgaatcgtctaccacagaaactttaggatgtgtcttcttagttactacataaccaccctcacagcaagttaataactgactgatatagcttttccggaagtaaacaagttaacgtcaaattctcggagaactatggccatgtctatgttctgacaagacaaccataaaagcgcagcaggatggacttaaataaccagagttttccaagcagacaaatggcctccaaataatatcaatctcacttgttattttgacccaaaagcgtagcagcagtcttgaatggaatggagaaaacatcttatacaccaaagactattcctaacaatgaccaatcccatacaacaagcttcaatttctctggtttataaatgttcgtattacaaataaaatgttcttggacagttgcttgtaatggaagcaaaccaactgcacaatattgacatattgaaatttcaataaattgcaattaaccatagccctaaaccaaagcatcaaggttcctaaaactaacaccagtaaacagggaaatcacgagatctgtacctcaaactgagcaggtcaagcagcaagtaatctgtagttcctgtactaggataaattaatccacagggaaggcggtcaaaaagagctccttaaatcctcgcgagaaatcctgatgttaaactttaactaagaactgacacagaagaatcattccaacgccctagcacatagtgacgatttttatcaaagccaaaaagcaatacatggtccggttaagatgacacacaaccatattcaagataatctgaagagtatgtcttgccgaaattgaacaagttaaagccggtgatttgaaagctctgaacagaccttaaattttctgatatgacttgaccttatcataaaaattactagatccgaaggaaaaactgcatagctgcaagcagacgaacggtctcaaacaaaaccaagcatcacgaacttgaaaggaaccgaacaataatctgaggccagtgagcaatcctaaccatgaccaattcagagcgaaaacttcagttcatctagcctttgatcaagcccaaaatatccatgacaaatccatcgcaccaaacatgaattgacacaaaccaaccgatcgcgcatattgtacccaacacagcaaaccacaattagccataaaccaatcgaaagagatactgtgttcagaaaactaacacaacagcagaagcaaatcgccgaaactagaccccccccaaaccgaacggatcaagcaccagaaaaggacgagcaagcgggcaatctatccggctagttggtgcgcctgatcatcaatcaacaaacggcagcgaacgaggtgagatcgaaaccgattgatcccttacctaccgacttaccagcccacccgcggcggaggggaaaaggggaagaatgaccgcgcgagaagaggaaggaagccatgggaccatcctcaacgaagaaaaagcagcgaggatcgggctgcatttatagaggagcggagaggagaaccaccgaggaggaaaccgagtcggtgggctggagccgggttgcgagcggaatcggtggtcgcccgcctattcttgtcgcggtcggagtcggagacgagactaggcgatgttatctggcgctttttccggtgtcatggtggggacgttcttatcgctttttcttttttttttagaggacgttcttatcgctttttctttttttttagaggacgttcttatcgctagccgaagcagacacgcttcaccgtcctaatcggctaatcctcgatgattcgtcgttagcagcaaccagttgtgcagctgtgattttacgtcatgttccatcttccatgcttccatggagcacagtaaaaataaattatttgtcatttttgtttttcaaccgaaacaaaccgtgttcacacttgatcaaccatcgatatttggatggttgctggttcacgaaggttccaagttccaaccatagctggaaatttaaaaaaaattagattcgaccaaactatggtgatttcgtggtcaattccacggaactaaattaagcacgacaattgcattccacaaagctagctgatctatgcatttccacaacaaaaagtgtgcgtatttgacggggaacatttcaatggtcttcagtgctggaaatatttttgtcaatgactgctgaacatgtcttccaaagttttcagccagttcatatattgccaccgctccttctcaaccaaatggtggtgaagtgagcttgccagtttggaattaacgcctcttgccaccagatatcctttcagtgcaacctgtaaccgaggatccaaatctctgcaaaaacaatggggaacactgtcattgattgcaaataggtacaaggaaaccaaccttgtaatgatcttaatcgaaacaacaggaatagagacccctctaacctcttatgttgccaaaaaaaagggaaacaaaggctatttgatgtttaagggaacagaaataggccccttcagtggagcaatgtgatacagtcaactttcaatttcataagtaccatttcatgaatgagcagtaaaaagaactatagaaacattatagctcaacaaacataaaacatgtttgccattgaaccagatagtaaggatacaagtaatggctaaggttactttaactgctggtgacaatgaaatcctaccaccaagcctcattacctagaaattatagaccattgagtccctaaacaatcacatcacgatgctatctatttgagatgacatgtcctgaggtcattttgctaacaaaaaaaatacaaatgtagtgatgagccatctaagcatagtctagtcccaagttaacacatgtagcgtgtaccaagtggctgatgagatgcttacagcccactgattctataaatttgtactgactcgcttaaatccagtcaaaacaataaaatccaaaaaaaattgggatgaggaattgattaaatagaataaaaaggtccaatattcctccttgtttattttagaatatctattttaatccgaaaccaaggatcgattttcagactttcatagttatatgctgcttagttggttcttactacacttgtacctccaaaaagatcagcatcgcccttatgctacaaaacactttcaaccaacaagcttttcttgttcattttgcactttaaattaataaatggaggcgaacatgtgaaggttccaaattttagcatgagcatactcacagtatggccaagtaatcaatatgtttgaacaaattcatgtgaatccagccacattcatgttgaacatatttggacatggcgttgcaagccaatataaaaaaaatctctaacagaagacatcgtataaatttactctataaaaaaattaactgagaattgcaggtgcaagcaagagtaatggagaacaggaattcgtgagacctctccaccaagtttaccaaagttccttttaaaaaccatccatcaagatagaacgcaagaaaaattctacattgaattttgacaatagggtataactagatattctagcaaatgaagaccctgcggcttaacatggagttaataacaaggacagatacttggttcactgtcatgacaagactgtaggaaaataatacatagtaatagattttcagtctaccaagatactatgttgtaagacaatgtaatcaacaatcagcgcgttagaacagtaaaccacaaaaaaatatacgcatgttcctctacttttgtagaaagaaaagataggtggtactgaatttcctggaaggcataggctctcctgaaattgatcatgtgctaattttttttctaccggtcactagaattacagagctccaccaaaatgccatgaaagtgcttgtttttccagatttcttggaggaactccaagtttatgagcccactgcgcgcatcacaatatccacaaacattgtgtttggttcattgcttcaacttgccacaccgtactttaggctgccacacctccttagccttggcaatgttagttaagaaccaaacagcccctaaaatcacatgaatgaagaaacatcacctgaactcaggcccttcatacttgtcttccccagcgtcgccagcaaacgggtgataacaagcattagtaacatcatagtcagcagagccgccatcaccttcatctgcaaacgcgcggcagtcgaaccgcatcaccggcttcacatcaggcttactgacgaacaccttcatgagcgcgtccctgggcaggggctcctccccttcgaaccgcagcggctcgagcaccgccgacacgaggacctcctcggaagcatcccggcggcgcaggagcacttcctgcccgcgcggcgggtccgacacggtggcgaagtcgggaatgtcctgcgagaaccagggggaagtgagtggcgctggattgggggcgggaggatgcggtggtgggtacctgggattggagcgacgggggagaggagggggtggaggaggagagctcatgcgcgatctcggcgcggacggcggccaggacgccgccgttggcgccgccacggcggagggcggacgcggccaggcggcgcagcaacatcacgccggaatcattagcgagctgtcggtcggtccgcgaaccaaatacagtggaaggcccataaattaaattggccaatcctgcaaggcccaatccgttaagagtccatgaaaactgaaaagggcctggtacgtcaacgacccagctatgaaaacatttgccttaaaatgtcgtcggctatgaaaacattttagtttcactttacccccaaaatatcgtgggaaatcacgttcacaatttcgcctaggttcttctccttcacaagtttaacggcgaaatgaagaatgacttctgcggacagcaaaagtaagtataagagagaaagaaaaatagtgactttgtgctgtgcttaaccaacactttttttttgaacattcaatatattaaacattaaaagcacaaaacgtgcactggagatacatgattgtctttccaaagagcagcttgtaagagttgctttgtaggacaagtattgttattacaagtatgactaatattttgacaatttagcacttcagattcagaagatgttctagcttttttagataggtagtctgtcattttgtttatgtctctgggaatccatttgatgttggaggggccatcacctgcaaaaatttttaaaagtgcaagaagaggtaaaaggctccagtggcaattctgattgatgtaatcagtattttgaagtaacagtgttagctcttgattgtctgaaagaaaaagaggatttgcaattttaaggaaatcacagatgaagagagcaagtttgaaggctgcaagttctgcttgcattggtgatttgtagagacttgatttcccctgcacaaagatagcttgatgattaattggattatgaagaaagaggccaaaacctgttagattgtccttccaagaagcatcaaagaagcatctgtttcctggtaaaaagtttagacaaacagtaggattttcatttatgataggagtgtcattattatcatcatcatttgataaagcagtaatgtagctcttagacatggcattggaggcattacaaatttgtaaaggttcccaatctttttttctgaagaagtgatcatttttagctttccaaatataccaaagaagaatagagataatttgaaagttattatcaaaactattagaagcaaggagatagtgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaaaacgaaagacaacaagagctaagccttgactagaactgcagcgggaacaccactccacaggcatcctcgacggcacggacgaagcctactcctcggagaaacctccatctgacacatactcatactctggggttgggaaaaaaaatagagcaagactgagtactacccactgtactcagcaagtcataccggaataggggtatgatgcagggaattatcaaaggagagctagagtggttcgtttgcataaaacgagcatttataaacagaagttgaaagaattaaacagttgcaataattaattaatattgatcatccgctgtccaacgctatcccacgttgcaacagggccaaccatccacctatactatccaatttcattagactaaactagggtaagactaatcacggtgaatctggttgaccgcccataaccgcgggcacggctattcgaatagttttactctgatcagaggtgtacaactgtacccacaagacatagccccacgacacgtttccgtgcgccgacatgccaccacgacataccggaaagaggccgtgacaggacccttcgcataaccccatctaaccaagcacaccacacctcaggtttcaccccccactcctcgcaaggcagcgggcagtcccctctcgtgcctaggtgaatccggaagcgacagaggccgtcgcagggcccgccccgctccatcacgcccacccttgcctggatgcgtcagctagaggaaagctacactataagcccagccgttgcccacgctggcttgtggtaagtacgataagttcttccagggcatcccgtgaaccggtccttaactgtcatgggtgtgactagcaaaaccatgcacccacagcccaccatgtgattcattttaattaaccaacaccaaaatggtggtactaaaccaaccttaccaattgaacctaaagtctatattttagtgagctttccccattgtgtgctagtggaactaagcatggctaagcaattcctagtccaaaatctattcaagttataacccaagctaacaaaggagcatgatatcaaaatagcatggctgtaacaataggtaaacaccccatagtaacattataaaacaatgcaatatttgaagaaaaacaatagagcatttgcaatataggatcaacatgttcaagtgacaagcatgacttgccttgctctgctgctggaggaacctcggcgactattttgaagtacaccggagcgtcggaagaaccggaatctagcgacatacaaggcaaatattgcaaacaggctataagactactgaaacagggaacaaaaccatttttaatggattctacacatttttcttgatttactgagacttgaatgggcttaaacggagctcggatgaattagttatgaattttagaagattcactgtgtttattactataaaagaaaaaccttaaatcatttattgcgcaataaatcccagggctgacgtcatcaagggggacgcggcgccgacatgcgggccccactggccagcggctcgggagagggaggaaaaggggcgccggcacgcgggcccactcggcagtggctcagggggggcggttcaccgtggaccgggaccacgcgggtggtccaccgccggtccacgggaccgacggcccagatcgccctcggggccgatcggacgggcggtggcgacccggctcggctcaagaccggccaagcggccacggcgacggcgacggcgcgcgcacacgcgttgccggcgactgcaaccggcggcggaggcggcggcgcaaaggcggcgccgacgggcggtggtgctaaagcgacggctaacgggcggcggcgctaaagcggcggctaggagggagagggaggggaatagaggggagagggcgcctcaccgagggtggccggcgcggaggaagacgacggcgaacggcgacaacgagccacgggaggacgacgcaaccggcggacgggattcggggtgccctaaggaaggagaagagagagattagagggagggagatgaaccacggcgaccggcattcatggccgaaggcggcggtagaggttgaactcaccggagcgcgaggggatgcgaattccggcgatgaatcccgacggggaaggggcagacgagatggagttcggcctcgcaaaccttacggcgacggcggcgcggcgcggcggcgaccctagcggcggctagcggcgtccggagtagcgggggcggcggcggcaagtggatgcacggtgcggggacgatggagagctcgggagagagaggcggcaaaaggaaaaacgaggaggagagctcggggatggattttataggggcgggaaggtcaggaatgacccgagcgcgtccgatttcgccggcgacgtggggaag

SEQ ID NO: 6291 - DNA, 24749 bp, Oryza sativa
  unsure (1)..(24749): unsure at all n locations
ggcggtttcgggggtggtgaccagcccgggcggcagaaggttgggggaggacccgacaggtgggccccacctgtcggcgaccccgggagaggagggaggcggggcggcctggctgggcctcggcctgcggccggcccagcggggaggagggggagaaaaaggagagaatgggctggcggcccattcggaaagggaagggaaaaagaaaaagaaaaaggagaaaaggattttccctagaattaaaatattgcttgctcaattttaattggttaaaattatttctagggctctgaaaattccactaaaaatcctgttagtgaatttcgacatgtagaactcaagaaaaattccacatgccagattcgattactatttgtattacttccttagggttttctcttgatttgcaccggcattttcttagggtcatttataaattaaattttcggcttgggaggagaacttcggggtgtgacagataggcaatgatttcagaaacattatgcctagagtcaatgatagaatgattgaaatatagctcagaaattttccaagtgagtctagcaaaggtgcagtggaaaaagagatgagtatcagtttctgggctgttgcagcgagagcaagaatctgaaatgtttgaaactttagagtgaaggttagcagcagttggaagagcatgtcttagggcagtagcagtgcggtagcgcacttgaggagcccaaggcctccagctagactagaaaccggttagagaaccacacctcacaatgcatgtgtcttagacagtatctatgttagtgggtcccacccatattagtaggacccacccatccctcttttcacttccatctctccctcccatgcatgcaagcatgtgaggggaccactcacagtttcccttttggcatgaggaaaccgcaccctggctaggggatgcaatccttagcaaagatatgggtcccgccaccttttttcattcacatcagattttgaactagctggcaaacgaggtaaccctccagctaggagtactgtgaagagccttataagtctccaaatgaaagttttgaccttaggaggaatgcattttgtagaccaagtttttagaaggatactgcgatgtacagagttaaagttggaagaatttgagtgagaattgctagaaacctgtttgtaggcacttttggaagtgcaaattcatgtggttgttggagtccagcaaagtctgtcttcattatcttgtgggacaatctatacctgtgttataatttgtgccatttcctgataaaaatttgattcagcttgtttaggtcccaatcttttctgtcattccaaagacgaggcttactgacgaacaccaagctaaccaacagtagcttaaagcattgtgacagtgtgagtggtacccgtcaaatgtcatccatgtcgcttcactttgcaactactcctgcggcgatatatatggtgctttctcagcattatcgctcagtacctaaacattcattcatcatcgggcgaacacagcaaagcgccgagttactgtgctcttccatcagaggacggaaacagcaaggcaagcaaaatcagttgtgtgcccttagccgtcagagtccaccggattcgtcggatccatccatccataaattcgagttaacggaaagtcctagccatcgcctagtcaatatcttttttttttaatggaatcgcctggtcaatatcaatctctcgtcaaaaacaaacgaatttgaatctaattcagtacaattcacacaggaaagaaagattcaattagaaaatggcgatccgatcgcctgccattttccatattctttatcccaaacatacagggcatatgcagttgtcttcttttattagaccaagaagttgtaagctttggagaaaaaaataactcctttccctctctccccttcctctccggccgggcagagcagagtagtagtggaaagtggagtggtagactgcgctgcgtgtgcgtgctcaccggccgcggccggagatggagaagctggacaggtacctgcaggagaacttcgatgtgccggccaagaacccgtccgaggaggcgcagcggcgatggcggcaagccgtcggcaccatcgtcaagaatcgccgccgccgcttccgctgggtgcccgacctcgagcgccgctccttggacaaggccaaggtccgctccacccaggtactaactaaccacgaactagccgctctaatccattcccctcacatcgttctccatttcaagatatcacggtttttctgtttgatcccctctctctttctaccgcatctcatcgtgctcgtgggtcgatttgcctagcaagaacaacatttagctaacaaaaaagaactgcttttggtttgtgtgttcattgttcagtattcagtaaccgttgtatgtcctgtcttttgccatcagatcgtgacacataatacagttctcctcttgtttagatcgctctacatgtttcgtcccgttcatttgctcatcggtgccaaacaattaagacaaaaaatcaggttatttatgctattgctccatcgtactgggcacagacgcacagtaggtccgtatcatgttgacatgtataaaagatcaattactttcaaggaaacttccgcgaagcaaccttacaaaaaagtacgaaataaatggtgttagaaaaggacaaatatatcaccctatcacatcgattctgttatgtaggagtatgtatagttatctccacctgtcagtctttgcaaatatgagatcattgtttaaagtccctaatttggagtactattgatttcaacttttcttgtcttcatgggaaaagaataaagaactctatgtttgtttggctgggagaatccaattatggccttgtttggatcctccgggctattaaatagccctccggatccaaacagggcctatgtcttcagagttgatactcttaattcagggattaattctacattactatgtgctgtatattttagtgatgtatacgctatgtgctctaggtttggtggatagggtgggcagattcctatttctgacttctgagccaccctatcagatactccctcggtcccattttgagtgtaaccattagtttctgtgcccaactttgatcgtccgtcttatttgaaattttttataattagtatttttgttgttatgagatgataaaacatgaatagtattttatgcgtgacttatgtttttaaattttttttaaaattttttcaaataagacggacgatcaaagttgagcacggaaaagcatggttgcatttaaaatgggacagagggagtattatttttatcacacaaattcacaaaagtccccctattttacggtttattcatatgaaccatctaactccagtttcactagggaccttcttgttttataaattcttctagatgattgagtgcttaacattttgttctctcatatgccgatagttttgattggaatgtcattactttatgcttaacaagtcaactaatttaattttaacaatcatgctgggaaaattcgcaaacatcagcttcggtatactggttggtctgccttttcagcctagaaaagtagtgatggtatttatatattaaaataaaatgacccagtatgatgcaggtatagtggcaatgtgacttcacatgtaataggagaaaaagaaactgcaataaagtagccgactatcatgtttgcaacacaagcataaaaccatatttcttgtaagaacaatcaaatgtggagatcttgcactactatattttgaatattgtgcacgactgaagttatttatattgttgccatccgaagtgttggattaattaaattcattttcatggactaaacaacagtattgctattccttatcagttacctttttgtaattttgtttctgttaatggaaacaagagaaggctggctctctttctcaaaaaggaaaaaaaatctctaccagtttccacattatacagtatgtgattttatcacacagctacaggaaaataattataacatatatataaccagtaaaagcgtttccattttttgtgtttgttgtcccaggaaaagattcgggttgccctctatgtgcaacaggctgcactcatttttagtgatggtatgggataccttttttacgttattgttcattttgttgcattatcaactctctgtaacttgatttaatcttaatgttttaaacaaaaggtgccaaaaagaaagaatacaaactaacaggggatattattaaagctggatatgccatcaatccagatgagctagcattgatcacaagcaagcatgattcaaaagctttaaagatgcatggtggggtagatgggatatctataaaagttcgttcatcatttgatcatggcatatatgctagtgagttagatacaagacaaaacatatatggcgtcaaccgttatgcagaaaagccttcaagaagtttctggatgtttgtttgggatgcattgcaggacatgacccttataattcttatggtatgtgcattgctatctgttgcagttggtttggcaacagaaggttggccaaagggcatgtatgatggcttgggtataatactcagcattttcttagttgttatggttactgctgttagtgattataagcagtcacttcagtttaaggagctagacaatgaaaagaaaaagatatttatccatgtaaccagagatgggcgtcgacaaaagatctctatatatgacttggtagttggtgatatagttcatctgtcaattggagatcaagtacctgctgatggactgtatatacatgggtactcccttttgattgatgagtccagcttatctggtgagagtgacccagtgtatgtttctcaagacaaaccattcatcttggcaggaactaaagtgcaagatggatctgctaagatgatagtaactgctgtcggtatgcgcactgaatggggaaaattgatgagcacattgagtgagggaggagaggatgagacaccactgcaggttaagctaaatggagttgcgaccattataggaaagattggactggtatttgccatattaacatttttagttctgctggttagatttctcattgacaaaggcatgacggttggtttgctcaaatggtattctactgatgcattgactatagtaaactactttgcaacagcagtaaccattatagttgttgctgtacctgaaggattgcccttggctgttactttgagtcttgcatttgcaatgaaaaagttaatgaatgataaagcacttgttagacatctttcagcgtgtgaaacaatgggatctgctggtaccatctgcacggacaaaacaggaactttgactactaaccatatggttgttgacaaaatatggatatctgaggtttcaaagtcagttaccagtaacaccatttcaggagaacttaattctgtggtttcttctagcacattgagtctgcttttgcagggaatttttgagaatactagcgctgaggtggtcaaggaaaaggatggcaagcaaactgtcttaggaactccaacagaaagagcaatattagaatttggcttgggcttgaaaggagatcatgatgctgagtatagggcctgcaccaaggttaaggttgagcctttcaattcagtcaagaagaagatggcagtgctgatttcattacccaatggcacgtccagatggttttgcaaaggtgcatcagaaattattttgcagatgtgcgacatgatggttgatggcgatggaaatgctattcccttatcggaagctcagagaaagaacatcttagatactatcaactcatttgcttcagacgctttaaggacgctgtgcctggcatataaggaagtggatgatgatattgatgacaatgcagatagtccaacaagtggttttactctaatagccattttcggtatcaaggatcctgtgcgccctggagttaaggatgctgttaagacctgtatgtctgctggtatcacagtaagaatggtaactggtgataatataaatacagctaaagctatagctaaagagtgtggaatattgactgaagatggtgtagcaatagaaggaccagaattccatagcaagagcacagaagagatgagggacctgatactaaatattcaggttcataatgttttcctcagtctatgcgtttactaaaatcttgaccaaactttatatctggaaatattttgcaggtcatggcccgttctttaccattggataagcatacactcgtgacaaacttgcgaggtatgtttgatgaggtggtttctgtgacaggtgatggtacaaatgatgctcctgcattacacgaagcagatattgggcttgctatgggcattgcaggaacagaggtactgtttcctatgcagttcaaaacttatgaacgtagcatcaatagacattaaaaaagtcagatatttaggacgaatatgtcagtattcactcttactgaattaagttgatcctgataatccatttttcatcttctgaaatggagtaattttgtcttgtatttgtgcaggttgccaaggagagtgcagatgtcatagtacttgacgataatttcacaactataataaatgttgcaagatggggtcgtgcagtttatattaacatccaaaagtttgtgcagtttcagttgactgtcaatattgttgctttagtcatcaattttgtctcagcatgcatcataggtgagggcaacattatagtattcatctgatgctatgtatttccattaagtggttctccatgatctccaagacagtactaatgttttgctcttccgtcacagggagcgctcctctcactgctgtgcagctgttgtgggttaatatgatcatggatacattgggagctttagcactagcaacagagcctccaaatgatgaaatgatgaagaggccacctgtccgaaaaggggaaagtttcattacccagttcatgtggagaaatatcatggggcaaagtttatatcagctatttgtacttggagctctcatgtttggtggggaaaggcttctgaacatcaagggtgcagattccaaatccatcataaatacactgatattcaactccttcgtgttttgtcaggttagtgcattatggaacactgtaaccgtgctagtatttccacaaaccactcacataaaatgatgtttcttttttggccttaagacctatggtgaaactgaggtctttccgaagtctgccacaatatgtgtttggttggtcacagcttatatttccaatatcatgcttaagaatcctgaactgatagagttatcttttttttttaaaaaaaatcatgatttggcaaagggaatttcttgttctaatgatgatgttctggcaaatgttgtaccaggtattcaatgaaataaacagcagagaaatgcagaagatcaatgttttccgtggcatcatcagcaattggatcttcattgcagtcatagcagcaaccgtagcatttcaagtggtgatcatagagtttcttggcactttcgccagtactgttccactcaactggcaacattggctgctcagcgtcggccttggctccatcagtctgattgttggtgtcatcttgaagtgtataccagttggttcaggtgaaacctctgcaactccaaatggatacaggccacttgccaatggccctgatgacatatagctgaagagtaatcactaataagggaaagtagaatccagggtgcaatacagcatccagctgcccagctcagttcagttgttttggaatacactaaccaaccactgattttgttcaaattttgccaaactcctgtcatgtaattgttactacatcacacgttactgatgtgcacccttaccactctgctttcaacttcagacttcattgtatcagtgaattcatattatcattatgacggttggtggtttggattcactctgaaataatcttttgatgccatatatgccatttgaaacagatatatattagcacccttaaggtcctgaacaggagttaaattcataaaacagagtaaataaagaactagaagtatcattcatgaacagaacagaacaatctcctaagatctgtctacaaatcagtaactacattgacaaagaatcatcagatatatgttcagttcttccatcgtctcaaagaaaaaataaataaatgaataatcatcgactactctaccccagcgattcaattcattcacatagtatgtggccgtggctgtctccaccctcgttgggattgggattgggatcaccggcgccgtcgaagtcgacgaacaaatcgttgaagaaatcattcatctccacctcacctcctacttgtggttcttgtctcacctcctcattgaagccaacaccatagccgttcatcggtgagaacaaggtcatctccccgttggtgttctgcattgccaatggcatctgtccctgcgtcccgatgccaccgtggccgttgccgcagagaaccagctccccgtctgcgttgatgccgatgccgtagtcgccgccgtcgtaagcatctggcttgatggcatcaacgtcgccgtagtagtaggcggcggcattggccgtgtcgtccgccgtgtgtgtcgtcgtcgagcagcagtagtccatcgaggcggtcgcttgagacgtctcgccgccgccggagtacgagcatccgacgtcgggctgtggcgtctccggcgccggcgcgtcgtagccggtggcttccgcctctcggagcctcttgggcccgggaaccacgttggtttcttggcgttcctcctcgtcggccgtcgcctccttggccctcggcgagaggtagaccttgcagatgaccatgatgccctcgtcggtgatcgccgccggcaggttgctggcgatctcctccatgagccagttcgtcttcttgttcccgggggcgcggtactcgaaagcctggcggtcgccgtagccctcgatgacgcggcggcgctgcgagttgtgccacgtgccgccgccctcgacgcagcggttgagccggccggcggtgccggcgccgcccctgccgcccttccacttggcgacggtgaggaagtaccacgacttgccgtcgtggccgtacgccctatgcgcctccgtcagcgtcgccgggtcggagccgtagacgtcggcttcccggacgatgtcccggagctcctcgatcggccggccggtgatccagtggttgaggtagtcgcggatgagctgctccggcttcggcacgaagaagtatcccgagggcaccgtcacgtcggggcccttctgcttcttgtcatcttcttccgccattgatggtgatcctcgtcgtgcgtttcaaaactaggttttcgcgcgcgcgctcgatcgatccgtgtcgctgtgaaaggaaagcacaggttggtgttgaatttatttggcatgatctcgttggttcgagttcgaatcggtgaagaatctcgagtccgagaaggcaagaaccctttcccgtctcctctcgcgttcgctaggggtggagcggcatctagggtttgtgcgccggccgccgccctccccgctcggcgccggcgccgccccttctcctccccgcccgacgccgccccttctcctccccgtccgacgccggcgccgctctgcttgtccccggccggcgccgagcgtgctcctccccgcccgacaccggcgccgctctgctcctccccgaccggcgccgacttgctcctcccagcccggagcccgacgccggcaccactcatccaggtacatgtttgttgtgttcgttggttgcagaaaagtaatcagattaggaccttgaacacagcagcaaaaacccagctaatgctttagggtgacaccttggttgctgtcagttgttagcatcataatctttttttcttgcaaggtttggggtttggttggttgtccccatcagaaaaatttccatactgtcagccaatgggcacccaacacattccccaaatggagttggtttgtcttcttaaatgtaaaagtggggtaattatgtatttattcatgatctactagtaatgcaaaatggaatataattctgtagttgtgtccttcaaaagaagcaatcttgtaaaaaagttctgtacataatggttgacagattagaaatggggacctcactgaccatactagtatcagtacactggtaatagacagtttctgcttaattagatatgcagatgcagatgattcaacagaatgatacactcatctgcattcagcaagacaataatcaattacatgatcttgtttatcaggacaagaattttgcacatcttcagtgtacaacattatattcagttaatgtacatatactattattctcatcatcgcatttcattttaaattctaattgaccgcccttgccgcccgacgccgccccggctccgacgacggcgtccgcagcccgcccgacgatggcttgacaggtgctccgacgacggacgatgagagtgaagatgcagagaatgatgataccatgaatactatttgtactaggatagctgatgcattgagtagtgcatgaggaggatagttattttgagatatggcatcattgtatgaaccatttatcttttgctctgtttatgtggaccatatcactttgatatatgaaaaactaatatattttgatgaaaaactttgatggatgaaaaagttataaatttttttctttccaattagccttttaaatacgaaatattgaacggattaggtttttacgagtaattagcatataaacagtctcataggcctttaggggcattacaggtatttcttctacaacctacagttttgcaactgctctaaccaaacgggtttctacttttcccacaactgatttcccacagctgcttttccacagcccacagtagcttttccaaaagccacagctcaaccaaacacaccctaagctgtgttcttcgttccatttcgtttagtactgcactgtttagtgacatggagaatggcgggcacaaatacactgctgcatccatggattctcgctaggccaggtagtgctagcgtcgtaacccaagttttcgggggcaaggtggtgtgtgggtgttaacgaccaaatttgataaggccatgggccggattcaaaaccagagtcaaagcaaatttggaggaattctatttagggaaatctatacggagctaccccggaggtcgccttcactcctagaccgagtgactgctccagcacaccaccacctttttttttttacaaatttagaaaatgcagttatttgaccacatcttcatatatctaccgggtaaaaatgagcttaacattaatatattcatatattggcagtttatttggccacatcttcagacatctattggacaaaaaatacagtttttgcagtttatggcacattaacgcgccccaccccaaaaccctagtagaaaaaaccggaccgggtcaacggttcaaccggaaaaaaccagaaccagaggtctccacacggttcggttgcgcgttcaaagaccggacatgcattcgacccggattgaaccggctgaaccggccggttttgcactaaaccggatgttaaaccggcccggtctggccacacgcctgtttttttcctcaaaattcgcagaaaaggctggcgcggcatgggattcgaacgtgggtctgtgcgatgagagcacttggctctagccatccggtcattcgccactttgttatacaggaaatatacaacttttatatatctattgaaccgtggttcaaccggcggttttccggtcggaccatcggaccggcgaaccgagaggttgttcggtcctctccggtccggttttttacactatgccccaaaccaacatatgccgggtaaaaatgagctcaagatagacatgtcctaactagcactttatttgtcggaacttcttcccaagagagtaccaattctttgcgtggctactcggaaaagatgaattgaaatcaagtgcagtcctaactttgctgcaagtaatttcaaccatccattttttttcagcaaatagttgagatctgatactacagtctacaattctattattgttacagtacctctatagttttctccgcgtgtgaatagtactacatataatttggacccttggatttacatcaaacagtccatcagatccaaatccacaaaggaaaggctaccaacaacgcaaaatctattcaaaaagaacatttgccaactctccaatatgtgagatatgcaaccaagacctggaagacgctactcatttttgtttccgttgccctgttgcgatggaattctgcactgcaattaaagttaaccccaaaatcacccggactgaaagactacacatcagctacaactgataattcaagcgatatcaaagcacttcgaaactttcatttcactcggcttcgtcctctctctgagtcatttcacaaatgcattgaatttgtcggctgatcgatatgtgatgtctatcggaagagtcatgacatcattttcggagctatatatcctcacatacatgagcgttgtaacttgtaacatgcccgatcagggaagcacttgtatcatttcaaatccaaacaataaactcagttaaaaacaagtcgatgaacacacgttacagaaccgtttcaacacaatgggcatggtctcctgaaaggtcgactgtgcagcacactgccattttatgcaatgagaaaagggagtacagtcagcatgaaagcctcgtaagtaaaagtcgcagagcccgagaaggctgtgtctttttccttgaacttctcagtcagaccctgtaaaattgttacaaatgaatgttaaaagagtgaaaacagaacattgtgctaggacttaacagcgcctgtgaaggcattagtgtattaccttaactgtgaggcagcatctgcaaaggcaaacaaaatagtgttaggactgttatataggccgaattggaatgatagaagatatcaagattttaaactatatccaatatttaactttgaggttaggacttgcttggctgtggcttataataagccatgacacgtgaccaaagcaacaaaagacttttatatttctacacttaagtggtttaaaatccaaggctgaaaaatagaacgatgaaaaaacaactagatcaattcaaagttttgcatcagaaaacagaagtagaaagactagttgatgcatacattatctttttagttattgcctcaaaatgtgcaagaaacaatttaacaattatatttgataggaaatatcatctttaaccagacatttgatcccaaagactacttttgtgtcaacaaatgtccaaacagaaaatgttaaaaataaggctgaaacgaatttgaaccaatcctattattagctgaccatataaacatatgctaaccaagttttggattttttttagataatgattggatgattggataagctaatagcttgaacaattactaagaaagcaatctgcaaaacataattggagtcatcttactcaatgaagttatcatattcaatggctttgttcttgcccccagtcttgtcaaactttgacacaagcaagtctagcacagttggagaaactgaatatcccagactgagaagagcatcacgcaattctgttgcatcaattttaccacttcggtcacgatcaaacctctcgaaaatggactgcacagtacaagcagaaaatgcacgtattcagtttcaacagtaacttcattagttccaccgcacagaagaaaaggaaagctgaagctgtagcatctcaccctccaattctgaagactgtaaaacacagaggtaaattccttgggacctgaaaggatcaaagacacatattcaatgtggtttacataaaaacgaataatataagaaatgcttaagttcaaagtacagtatctagcaatccagtatttgttaaatcaggtgcatttcacaggttagaactaaaagtccaaaattccatatacaagctcactagctgatagcctgaaacatagcactggtttcagagtatacactgctcaagcaattcaaagctcatgattcaatctctagttctctacacagaaaacagatgccaaaagaataggacaaatggcattgattaaagttgcaaatatctagttttcagtttagcagtaatttgaaattgtaaatagaactgacaaacaaaagttagtatacaaggtaacatgtataaactgccaaagtagcatgcccttttactggagtaaacccaaaattctttctacatcacaagccgggagaacttacaagttcattgtgcaaataaaccagtatatgtgtctatgctgtaccaaagtagaccacaacaaaatgagctaggattttccacaattctattgaatcctatcccacaaagaaattgatgcaatttaagaaacttaattaaaagaacccgcatcccaacacctaaaagtaaactccagcttttaacaagttgccactatatcgttgcccccaccacgttcccccgtcttcctcccaaacgacaagtcctggccgtatgatgcaaacactgactacagccctggctggaagactccatctccgcatcggaagccaaaagtcgcatactggcatcgcaaataccgtgggaagcttgataatcccgcggagagccacgtgccaatcgcgtgccactcgtttgactacacatcgcccaaagcacaaccaccattacgtatgccgctgaccaggacaacgcgcacgatagcaaccatggagcgatcagactaacgcacaccatccccaaggccagaactattcaattcgcgggtgagaggatgaaacgatgaacttaccaatcttgcggacgttggtgttggtgaagaggtacatgaggaggtggacggtgcggaggctgaagctctggctgtacccggacagcgcggactgcagctccttgtcgtcgatcatcccgctgccgtcgcggtccgccgcctggaagcacgccaccacgttgggatccgtcccgggcgggaacgccgacggcaccagcgacgcgaacgggctgccgtacccgccgggcgccccgtagggcgccgacgagggcggcggggccccgtacggcgcgccgtacggctggctggagggcggggcgccgtagccgcctccgctgccgtagggctgggtggatggcggggcaccgtagccgcctccgccgccgtagtaaggggcggaagaggaggaggtcttaccttccttgggaggcttcgcgccgtacggcggggcggagggggcgggggaggagccgtacggcggtggcggggcgccgtagccgccggcgccgccgtaggggtagccggagccgggatttggcgggtagccggccattggagagagggggtttaggagagagcggaggttgcgatgcgcagctgcagcttggggaaatttggggattgtcaaagtcaagctgtctgcgtcctctgatattttgtgtgtttcgaaattcaaaatggaagaaagcagtggagtacggtacgggttcatatattgaagaggatgatgacgtgggaagtagatgcggtagttgcaggcttgaagaggtgaggacacacggtgtacgcgtgagttgtgaaacgtcgatcgataccttgtatttgaggacaccgggacatatgtcacgtaccgttgggtcgaaggtggtagaagaaagggcgtaatgcgcgtgggcagcgacggcacggccgcgcggccgccggcgaattgagtgtgtggcttaccgttgcgctgcatgtttcattgttcgttcttcaaccaaaggataagcacgaagcatcggggacgcgtttggtcgactggcacacgggaatacgggatgatccaatgaacgcatgcttcatgcttggaagtggtccatccctcagttagaccgtcggcccaaagaaattcgaggacatgccacttgatttgtctgcctctaaattttcgtcacccaatccacgtgcttttgaaatgtgaatattttgatttcgtactactttcaccggaggagggcaagaggcggcggcgacaacaacggcaatgtgcggagcttgggacctgggagggagggggaggggggtcaagcctgtatcagaggttgaggtgatcggcgagcttgttcaagctcaagctcactcggcatctatgcaaaggaggtggccaacgaccttcatcaaagggtaggcctagctttgccgctggcacaccgagctcgcccnngcccnganncncccctccctccccttcttcgggcttcgcgtgggtctccagcacgcacgcacggacctaggaccattgctatcgtcagtgtcctccaccggcttcttccccgttgccagattccacagccgctacctagggacctcctccacctcgtcttccttcgcttcaccaagcttcgcacaatgaggcgttgccgccttcgcttcactcggtagctgactgtcgcgttatcgttgatgttgctgtgagggatactgtcacgcccagaaatttagcctaaatttctagactattttgtgtattaaatctctgtccaggcatcagccagggtacacaaaacgacaaattaatatacagatccaaacgtaaataaagcgtaaatacttacagaagaggcacttagtcctcgcaccgaaacaaaagcagcagtagcggaaaaaaggcgatcctagcgaggcttcagctccactccacaggcaaaactcaactggggtctgagccttggtcctctaactccatcttcagctcagaagtagtacacttctgaaaatggggaaacaatagcaaggctgagtacaaccaccatactcagcaagccacaccaatgatgcagacgtgcaaggagaacataaggacggtttgtggctatttgcataaaggcagttgtaaagcattttattgagcaaaacagtaaaactattgagtaattaaggtaatattaaatctccattgatcaacgctacaccacgttgaacaagcccaaccaacccacctgaactacagtgcattgagtcgatttattaagtgtgagactaatcacggtaaatctggtcgatcgcccataaccgcgggcacggctattcgaatagttttactctggccagaggtgcacaactgtacccacaagacacaatccaccggcatgtcaccgtgtcattatgtgcccatgatgaacacgtcaccacgtcgagtgattgtgacaagaccattcatataactctcccctaaccatccacaccacgttaaggtttcacccacactcctcgcaaggcagcgggcagtcccctcgtgcgccgcggtgaatccgacagctggacaaccggacaccccggccgacccaactccatcacgcccacccttgccactggtgcctaggaaagggtcgagctatacttcagatcaagcagttacccactcccgcttgtggtaagcactgtaagtcttccagggtttcccgtgaaccagtccttaattgccatgggtgcgactcgcaaaaccatgcacccacagcccaccattcagtcgcattttagttggataattacgaccatgaaacatggccagatgtcttgagcacgcagctcgtcatgatactaaaaggtctaatactataattatcccatcaactgagctagtggtaattaagcatggctaagcatatagttctagctaggtcaacataagtaataccagctagtcggtttatcactcaaggtcgacaaaggacagatatcaagtaaacatggcacaagtgagcagataggtaatacccggatcccatgtaattagcaagacatgcatgtttatttgtaaacggtaaaacatttataaattgggatcaacatgctcaagaggaatgtgtgacttgccttgcttcttcaaaacaatctttcgaactcttttcctcgcgaccgcgatcttccgaaacgacggattctacacgctggcaagcaaaacgaggaaaaacactaataaaaaccaagaaaacagtacatgaaaagtaaacaaacatgtagagctcaattttagatgaattttgcaagttgaatggcccaatttggagttcgaatgaattatatatgaattttagaagttgttgagtcattaaatgaatttctataactatatccgaattattgcgcaattattaattatttcccagaggaaaggcctgctgctgacgtcatcaaaggggccggcgccgacaggcgggtcccacgagtcagcgacacacaaggggttggcgcacagtggtcacggtccaccgcggccggggcggcaccgtggaccaggaccaccacgggtccacgggcggcggcccagatcggcaaaaagggagggggctggctcgccggccaacccgacaaggcggcggcggcacaaggctggacagctgagaggcggtggcgcacgagagggagcggtggcgcggtgcggcaaggggaggcggcagccggctgcccagcattgccggtagcgacgctggcgcggagcgcagcggcgatgaaccggccggacggccaccggcggcggcggcgcgtcacgagcaggcccgggaagcggtcggcgaaagggaggaagagggagagggaggggagtgctcaccgagaggccaaatggcggaaggaggcggttggcggcgagcaaggtgacggcgggcgccttgggatgacggtgggacggcgctccggcgatggattggggaagaggagtggtagacggggtgcggtagggcgtggcggcgnctgtgggtagcggcggcatggccgggcaagacgacgctcgccggcgggaggcggaagtggctcgggtcggcggtggaagcagcgctacggcgaggcttcagggaggacgaatggatgtcggggtgcagcgcggcgtgacgaagctagtggtggcggcggcgcagtgcggcgacagcgggaagcggcggctggaggcacggcgacgagcggcggagcgcgggctcgcgcggggagcacgggagagggtgcgaggagctcggggaggagggggaaacggaagaggagagcacgagggtgctttatatagggctcggggatggagatcgtggccaggagaggtgggatcggccggcaatgtggggcgccgacgtggggaggttggcggcggttcggcgctgattttgcggggcggagtgggggaaataggggaggaggaggtggggatcgagtccacgcgttcgcgaggtgaggtggagcgcgggaagcgcggcgtcgtggggtgaaaccggcggccatggcggttgcagccggccggatggagggaggttggggatgacaggtggggcccaccggtcccacctgtcggagagggaaaggcgaggccggctgggggaggcaatgtggacttgagaaggaaagggggccgagcgggccgagagagagagggaaggggagggcggccaggccgggaaggaagagggggaggacttgggccgagcccgaaagggaggaaggggaaattatttgttttctttttatataattggataaatgatgtttgtgactttaaaattacttcttgagctccgaaaattcgcgggaaaatctggagagtatattagggcacagagaatattataaaatatttccggccaatgatttttaaaggaaaattttaatttcccctataattcacttaattaaattgctttaacttttatttaatttctagaaaatgtattatttaatgatttttaaccccgaacaaaaatcggggcattacagataccgcccgccgccaccaaggaccaccgcctcctaccctccttcgacgaaaatggcacgaaatcaaaagattagcacctccagtggcacttttgcaagggcacacagattaggtggcgaaaattcaaaggcatgcgaatgaggtggcataccctcaaatttctcctctggccacggtccctatatacatatggccttgatatgttcagtggcggagccatcggtcttgcaatatggcaatacctaaatacttgacctttagttcatttcctatccctaatctagagattgtagttagactgagtactcagtttgtgattttccatcttttcaaaataaaatagaagatggttatttgtgatattattggtagtttaccttgagaggatttagcaataaggactagttttaaactgccaatgatattattaaaaagctaaaatttagttcttttgaagaggactagtttacacattgattattatcgaccgtgaatattttatctcctttcctattgacactggttaggtcttacacacccaacctgaaatcccgctttgtcattgggtacgttgtgtcatctcacctccggatagttcatactgaggcccaagatttctgggtatgtttggattgatgccctaccaaaattttggtagtgccaaatcttggacaagttttggtactacgaaaattttggtagggtagagttgaaaatgtttatttggattgaagccaaaatttgcccataagagataagttcataggcaaagccaaatttatggcataggtagagttttagtagaaatgtttagtttgcaaccctactaaaattttggtagggcaaattttagtagggtaacaatccaaattggcccagagttaagtcagcccatcttaagcgatctacagggagggaggaaacagcagttagatggatggataatccgataggcgaccgaaccaacggcccaccggcttccacgtacccaaccaaacaagcaccgccttgcgccagccatccctgagagcacagagcactctaacaccactcggctatcttcgccggaggcccggagcggagcgagccaaagagcgaatggccaccgtggtgagggcatgcatgccgctgccacctgccgccgtcgcctcctcatccgccgctccctccacggacgcgcaggcgcagaggagtccctcctcctccagcgcgcgcgtgctcgtgctcggcggcaccggccgcgtcggcgggtccaccgccaccgcgctctccaagctccgccccgacctcaacatcctcatcgccggcaggaaccggttggtgccccctatatgctatgcctcctccgcaccgcactagtctgttacatactttcctcgcctgttttcatctgcagaatgaatttgcttcacttgtgttgcaatttcttacgtttgaacgaatgcaaacctcatctagccatttcgtagttcacttcaatagtgggaacagtttctttcttctgtcaatagcatcttggctggatgcctgcaatcttgtgcagttccatctgtacaatgagacgattatagtagtatgaccatttgtcgagtatcttttttttttttttggccagagagaaaggtgaatctttggcatctaaactcggggaggaatcggagtttgtccaagtagatattcgcgacaggaacatgttggaggaagtgctacagggttagtaatggagctacctgcttatgttgtacttttaagttgaaacaccgtatgatttcaaaaaattgttgcaaatattttgaaaagtcatccacaaatttcttctgatgtttgaccattctagtttttctttttttttcccagatgtggatttagttgttcatgctgctggacctttccaaagggagaatgagtgcactgtcctacaggcagcaatagcgaccaaggttagaaatgtgcaacgcctgatcatcaaatgcataagtttaataacacgttgaaatcagtgacatccttaacctttttttttttttacagacggcatatattgatgtttgtgatgatacagactattcgtggagagcaaagggtttccatgaacaagcaaaagattgcggtatcccagctattacaactgccggcatctatcctggagtgagcaatggtcttacttcgcatttctatcaaacatatcagtttactttgaaatttttcaagttacactgtccagatatcatcatgtgctctttcacaatgtccatcagtactcatggatagtatccattgctctttgaggcagtttacatatgtgtaaaatcaccaacttgattaatgccatgtattagtacataatagagagttagagacatgatctagcagtaaactatgaagacaatgttttgatctagctaggtaagcttcatatcttaattttttgagtgcttagaaatacactgttttcttcttttggaacagtgatggctgctgagcttgttcatgctgctagaagtgaaaatgctggtgaacctgaaagattaaggttaggagttatttatttcctgtaaaaattaaaggtcaaactagtcatgaagtatggaaagcgttgtcgtattcatcagaatctatgctagtatgttgctaaatcctttttctagattcttttattatactgcaggcactggtggtgctgggccaacaatattaacaactagttttctgcttcttgcggaggatgtaatcgcatataacaaaggtacttttcgataatttattagtgcacttataggatttctctatgaggaaaatctaagttttgttctcattacaaattcaggagaagaaataaagttgaagccctacagtggagctctcagcattgattttggcaaaggggttaggaagaaagatgtttacttactgtaggcactgaacattaattactttttgagatcttaccacaataaggaaaaaccactttggttagaattcaaaatggaagctaataaattttatattatgccactaatccaggaatttgcctgaggtgaagagtgcttataaggttttaggtgtgcctactgttagtgctcgcttcggtactgctccttttttctggaattggggaatgcaggccttcgcaaactttttacctgttgtatgtcttacttctcaaattatgcactatcaatttacttctttcagacacaaccggtgctattagtattctagtactagtaaactctactaaaaaaaatagaagttttaacttttaagcaaccaattgcttacattttattttattatttaattatgtagttggtgaaatcaactaatactattattactgttaaaccaacatggtttgcttgttttctgctgaaatcttaaaaatgggataatattaaactggtgatttggtgctaatgcggattacacctgactgcaacttgttcgtgttcaggaattcttgagggatagaaataaggttctaaaattggttggatttgttgatccttttgtccgagctatcgatggtattgctggagagcgtgtttccatgagagtaagtacctaaagctgtgttctggaggtgaggttgggaactcacttcatgcacccgcaaaattaattatttacttttttttttgaaaaaatgtattaatatgattttttaaagcaacttttgtatagaaattttttgcctgtgtgttttagaagtactagtttcttccaaggctccaagctatttccagagttaactgcatactctttcaagctgtggccagaataggtatttgaatgccagttttaaaatatttgttcagccaatttttcttcagttttttaaaataatttactttctaaactttgatttgatcaattataagattgattttatcacttcttcaaaaagggagcgaagtatggaccatgtaactctcaatagccatcgatttccacaaaatattggtacactgagactattgtttttactagttactggccaagatttgtttccttggtccaggttagcagcctagaagcatactacttctagtatttcctcaagccatacctggagtaagagtaaattaattatactcaaactttgtccaaagttgtatatgtagctactgatcactaccttttgatcaaatttatttcatttatatgcaggtagacttagattgttcaaatggaaagaatactattggattattttctcatagaaagctatctgtgtaagtacgcacttctgcacaagcagttgagcattctcaaggtccattacctaattgatatttaccatattagtcatcaaatatcaagacttttttaaaaaaataactatcacattttttgccctagatcgcaggaagcttcacataagtgctctctaaatgagaccccagtttcaaaaacttacatcctatgtataagagtttccttttattcaaaaagggattcctgagaaaaccatgtaaatctgtcctcatttaaaagctaacagggtatctacttcccagagtgattattccttagcatttgaatgatccagcatttttgtaatgctaacaccctaaatcctaggaattcatactcaaaacttggagcgatcttactacatggttgttttgagaagttccgatttactttgcagttttaaattttaagaacaaacaaaatcatttggtacaactatctgcattgcatcttagcattaatttttattggattttcagatcggtgggctatgcaacagcagcatttgttttagcagttcttgagggcagcacacagcctggcgtatggtttccagaggaggttagtggtgcactaatgggaggacaaaataacacactagtcgacacaatatactcactctgtccctaaatataagggat

SEQ ID NO: 6292 - DNA, 16898 bp, Oryza sativa
  unsure (1)..(16898): unsure at all n locations
tgaatgtggctgtaaataataaaacgaatttgtaatgctctaagagtatggggtggatgaatgaaatgaattggagcacaatacaaccaaacgagggttacagttttgatgaagtatcctagtgcctgttattgtcttacagaaatgtgtggtgagtttatgaggtctctaaagaattcgttacattccaagagcattaatgcatccaccgaaatgaattatccgtagcaattttggtcatcgtgtttagcatcgacttgtgcagcctgtgaattgaagtagaagggcatatatatatatatatatatatttctctgttctgctcttgcctctgtctacaaaattccacgtattctttaaaagcaacggaagctaaataacatttgtgggtgggtgtggggggtaaaacttatctcgttctatacagattgctgagactaagatatcatatatacctatgtaagctacgaagagctgatgatagttcgttagcattttatcattacctactttacatttcaactctgacataattcgcatgttcaacaatggcgatcctcgtactgcagctcttgttcgactatgatatgcattctacatcaccattgatgttgcaggaaacagcctgtccagtagggtataaacccctccacccagtagaaatgcaccactaccaagcaaatggcaaatgttagcgcaaggcgttaatccaaaaaaaataaagtataaaaggcagattttttaaagaaggaatggcttatatttttttagagatccttcctttttttaaaaaagaaagaacacgaatgtttctgaggaattggaactgtgcaaagcacatgacagaattgtggcaagaagtttagaacaatatcttacaaaagaatattaaatggatgataaggtaaatttgatgtgctatattctctgaaagaagcatgcccaacaaatgtgatttcaagctctttgaaccaagacagtgaaattgtagcgaatgctatcaattaacaaatatggattttcagtgtttcctttgtaaaaggtagtaaaaaaattattactattcatacagataattaattgcaacgtgcaggtcttttgcaatcaaattacaaaccaggaacctctcaagatccagaaagagctaaggcacatacctgattgggtttatccatgcagaatacctcctgaaggaaagcaaactctacagaaagcaaataatttatcaggcactaaacttaaaatgaacaggtgttgttgttctaggatttgtgctgttaaactgttagtcaagtctaagtgagatttaaagttccatatttgatggaactatcttatctatacttaaccagatgtgtatatcagaaggcatttatacctgcagtgctccagcaaaagaagctgcaatgagaagaggtgcaacatagccagttgtataagtcaataacaaacttcccccaacaatcggatcctgacagaaaatgtattgtaatcagcatgtcagaaaattaataaattaggcgaacataaacttcttgccaacaattatgacagattgctaagtcaagtgtaacatatattagaaacaaagaaatcaaaattactgcatatcgtacggtatgtgatttactaactttagtaattaaagacactatggtaaaatttatgacagttttactgttttgaaatttaagaaaaagtaataaaatattaatgtaacttatgaatgttcctgttatgcatactcttgaagtggcaacatatcccagaagggtagcaagaacaggtgtactgcaaggtgatgctgctaatgcaaacgtaagtccggcaaggtatgcttgtacacctatagggaaacagcaagatatcatttaccgtaactgaaataaacataatgaggcatatggtactttgatacaaaatagaaaattatgtcaaagcattactggaagggaggttagctgcagcagctcgagggtcataatcgctgaaaaatgagggaagttgtagctcaattacctgtaaatacaagataaccagcatagagaacagtttaaggcagtgagctaatatctactataacaggagtgatacacatttcattgaaataaattaccatcgcggcaaaggatttacaattatttataaaaggaaaaccatcaaatcaactgatacttgatttgaattgtggcaacaagttagcttgaaaaattaattggcatgctccgctttatgagttttcacattggatcatgaatttacctcaagaaggttcaatcccatgataactgctaaccctgaagcagccactggaagtccttgtcctacctgtccataggcctttccagcaaaagaagcagcaacaccaaggatggctaaggttgttgccagtcctaatgaaaaagcaactgaatttccaacaacctaatagatagaatggaaacatatcaatttacatcaagaataacatggatgaagtttttttcttctacatggtgaatggatgttatggcatacgaggttttgggtatacatgctctatttaatttctataagttattttataaataatagaatatacctcagatcgatctttgcccgagccaaaagcacctgaaagattttaaagaatatgtcatcagatcagtgccatcaattgtaactgatcctgggcaacaaaaaaaaagcatctcaaaaggcaatcgctatacttgcctatatatcctagagtcaatggtagaacactgagtgtacaaggagacaaactagttacaagtccagcaccgaaaattacagccaagctggagaatagagaaacatgtcagaaaaaaatatggacatgaaacataaaatataatctgagaaagtaagtaaacagattctgtccataggcaattgaccgcaggggaaaaaaatgcttacctagtgaaactaagagcagagagctgatcctgaacagcctcgttggcttgctgacccgctgaataaagcaaatttccaaaccaatctccaatgctaaggtcagccaaagcaagtccagatgaccctaactgatcataataaaattttatgcacgcattagctatatgccatcacaatgtaataaaaaggaatatatgatattctctttcctatgacagataactacactgttgactacaattcattattgtttctacgcagtagtacaatttgacatgttaaaatcacaacttgatacaggcatcacgaactcttttgtgatcagcaagaaggggacagaaaattcgaaggcacatagtgctccctcaccagagaatcaccaatttctgtnnnnnnnnnnnnnnnnnnnnnnnnnnnnnnnnnnnctgcgaccaagaaacaccactcactaacgtcagagacatttcatcaaacagattgccagcgatagaacacatgaagggagcagtcaacagctaacactctacccgccacggtcgccagcagcatggggcgctggcggacgagagagcacctcgccgcggcctccaatctcgctccacgaatcgctgccttgaaaccgagctcccgcgctcgcggggcacacccacgagcacacccgtaccaggggacgaggaggtggagggcttggaagcagcggcctgcgccgggcggcaggggcggcaggtggaggtggtgctactaacggggcgcgcggccatggcgacgcagagcacggaggagtggatggagcgaaggataccggagaagagggagaagagacgcttctgcttgggtcaaagggagaagaaggccacacgcccgcggggagacgtgtagccttcgatgggccggggcccacgagtcagtgtgaagctatagcagcttcctctttgggcttcatttaaagctatagctttctccggcaagccgtcgcctcagctcatctccctgtttgcgaaattgcggcggcggcgcccaatctcgcggtgcaggggcggcgcctagttcttccatggcgagatagcattccggtttgccggaggagattgccgtcgagagcgagagagagcatcggcgaatcattttgaagttgggtgttcctcctcttcctcccggcgatggggaactggaatcaccatcggcggccatggcacaggaggagccgccacgaacgccctccgcctccgccttcacctcctccgcatcccggtatggatgactgatttgcttgttctgttccctttgtttctatggattggattgcgtttttgtatgattcgatttaagttcaggtggtgatttgttaggcaagaatagggttagaaatttttaaatctaggtatctagtcagtaggtctggtaatgtcggttaatgctttttctgtgaattggaattttaggaatcgacatgaatatcattctacttcttgccatcctaagaatgcacaaccgtcatagatagtggactgtctgcttagaaccagagttgctactgcaactttctttaccaataatcttattgtttgtctaattgtcttaatatttcaaaatgtggtgcttaaatgtcagaaagttctagttttattcaactaccaagtatcaatttgtcgtttgagctgtaatggtattgcagtttgccatctactaatgtgcaaactttgtatatacgagttggtcatttgatccaaccacacagtaagcacagtgtgtcatctgttccgacaagaatatgtaacggaaatagtggtgatgcatttctagattaggatattctccgcttcccgccaaagtaatatacaacggcctaatggaaatagtaataatttaggatggtcttttcttcccaccaaaatttaaaacaccgcctctccttatccactagaagaaatttttttttgaacgaatcactagaagaaatataaatgttgaaacataaccatggtgcaccacttctgtacttgaatcttgctagacaccaacctgccacctagcacggttgccattcaggccaactattgctaactaggaactagacaccaccatgttaccccgtcactcgcctagcatcattttgaacactactaaattgccctagctcatttcgttattacatggggggttccaactcacctggaccttaatgtggcatgactaggagcctagcctaggaattttttttagagcaagggccattcccagttcccacatttccattaacagaaatgtagctacagatttcaggaaaacataaaaggaaaccaccaactatcctgatagagttttcattggtcaatttgggttgggtgtcaacacacaacctcctaattgccagcagccagcacaaagtaaagacacagggagccactctagggactcagccaaacagaacccagcagcccaacctgatcaaaagcccaccctactgagagacttccagttttttgtcaacagtgagaagaaccgggtcagtgcttcaggtgaaatcaaactccagagtgaagccttctagctggtagccgcttcatccccaccctccacccgaaccttgtgttgaagatgtcatttacaaattgctttaggagctggaccccccacagcagccctcttcgctcttcctcctgcatctgcaaaccagctcaacatgtaatccaatgacaagcataataaatcaaatctgtgggatctccaggaagttgtttcttaaaacaagcagaattttttgttttccaaatgacccataaaatagcagccacaccaacccaaatgggatgtttcatgtttttctgaaagctctccatccaactaccaaaaagatgatttatatctctaaaaggtttcaagttgctacaaacaacattccagatcacttttgcaattcggcattcgataaaaaggtgttgcattgattctgctgtatcacagaattgacaaaatttatcccccttctgccaacctcttataattaaattatcttttgttagtatactgtttctcaaaagaagccgcaggaacactttgatttttcaaggggatcttgaatttccatatttcctatgtgaaaaataaatgcgtattttcatatctttgtaaaaagatttaacagtgaattactctatctgcttttgacccatcaagagtaagctgatctgagtaagcttaccctaggagatggaaggcagagttatgttattatgatcatacaagttatttctctaaaattaggataattctagaagcttcaaaagagcgttgctttgcattagccatatcacagtcatctggttgaggttgtacttaatggagaaaggaaacgaagcgctgtacttactgcacatttctttagaaaaatgaggagccacaaaatgttaagttggctattgataacttcttatgtgggcgtaacatttttttcctcaagcggcagtatgcttaatctatgatatacttgaagaaacattgttagtacttgctattaaaataaactattaggtaactgacatagccatgaaaggtgcagttgtgtggcgacaaaggagcatccattagaaggaatgctagtattttaggattgaacccttttatctagtactttgaataattcttctgtttagtctgttatgaaagtaactgttgggtgtcttttttttccatacttttagaagagatgctgctatttcaggcgatttctaaatctgtacagtggtgttcagatggtaatttgttagggaagactcgggttggaaaattttcgatctagatatctaggtctagtactttcttgttggctgacgattttcctgtggattggaggtctcggaatgggcatgaatatcattttgcttcctgccaccctaacaatgacacaactgttgtagatggtggactgtcctgtactgtgtgatgcggtcaatttaagcttagaaccagagttgctactgcgacttcctttacaattaggcttattatttttggtctaatttgtcttactatttgaaaaggtacccaaatgtcagaaaatgctagttttatttgactaccaagtatcagttcatagtttgaactgtaatggtattgcaataagcaaactaatccctctgtttttttatttgactttggttaattcaacgtcaaataaaaaaaatagagggagcacttgtgtgcacatatcttcagaaaaaatgaggggacacaaaatgttaaattggctattgataacttcttacgtggccattacattttttcctcaagcagccggatcctaaatccatgatatgcgtaaggagacgttattaattgctattaaaaataaactattagataactgacatagtcatgagaggcgcagttgtgtggcgacaaaggagcatcccttagaaggaatgctagtgttttagtactgaacccatttatccagtagcctgaatggttcttctgtttagcctgttaggaagtaaccgttgggtgctttggtgtctttgtttcccatacttttagaagggatgctaatattttggatttgacccgtccaaaatctgcaggcgatttctaatctgtacagtagtcttaagcaatctaaccagaatttttttgtatatgttatttgtttgtataaacattttagaattcatcatctccttgcatttttatgctgctacaatgaatctgatattgcttttgtatttacaggacacaattgccacccagtcccattatgggaaagggaattttgcatttatgttggcggcatttcttggcacaggttctgtgacaacaagagatatgtctgcatgtataagaacattgagcaatgggatgactcagaagcctttgataattttaagaatgcaaaggctagattctgggctaattaccatggccaaccttcagacatatctttgccagaccctgatatgtatattgacaagattgaccacaatagcaagatcgaccctgagttgatagctgacctgaagatggtacgcttaccattcgagagggatgatgagttactcccagctgatggattgggcagcactgatacagataacaagtgccagcagaagcagaaccaatctggaaactgggacatctatgtagaaaagcccactgaagttaacaagtgggagcaagattcaagatccaacatggactggggaacaaagcatgaatcttggaatgaatggagtaaaaattgctctggttggggtagtgccttggcggattctagtgccttggcggattctagttggggcaattggaataatagtaacaatcatcattcatcaaataacagggatagcttcaatggggtcaacaggaatagataccaggacccaaacagcatatctggaaggaaaaggaatagtggtgggcacattcagcaaagaaacagtagacagagaaaccagactgagggctaccaaggaagtactcctagatggtgagaccatataagacaagagaatggtctccatttgataatagtgtaaagggggtaaatgaccacacaatagaatgtggcctcttagtagtgcgaaagattggatcagaatgaacttttgtctggagactacagggatagcttcaatggggtcaacaggaatagataccaggacccaaacagcatatctggaaggaaaaggaatagtggtgggcacattcagcaaagaaacagtagacagagaaaccagactgagggctaccaaggaagtactcctagatggtgagaccatataagacaagagaatggtctccatttgataatagtgtaaagggggtaaatgaccacacaatagaatgtggcctcttagtagtgcgaaagattggatcagaatgaacttttgtctggagactagagcagttagcaatagttggcagttagaacaaatgatctatgtaaagagatgctcgagttttttccttctctagaaagaaagtttcttcatgtcgcttgagacatgatgtttttgggtaatggaagcagaatgctgccatttcgttgtaaaggtgatcgccataagttagttgttttttttctctttctttctttcaagctccatgaatatgtagtttgttcaagtgaaacatagaattcatgtactggtagcatgttagtactaacatatactgatatattgataattcgtgtctagtgctaataaagatactcataagtcataaccagatgaaagagtctggtacagtatgtgttactaacataaattttgcaactaccaaacataaatttgtgtgcaagtgtactcaaccataagggcatttccaacccaagacactagacataatttccataaactccacatcatcaagaaactagtactagacactactctttcaatgcaaacactactattccatacttaaatttaatgctacttatctcacatgatatcttggacgttgtgtagaaaccatatctcatgcaatatatggtttccttctcttttctcatttattcacttgccatttcattttttatcctaggtggcagcttatttaatgctatggacatcatcctagtcattgggttgggaatgccctaagtcttctttcatctgattaatttgttaaccataagcgtactcgcaactgtcaagggttaatactagattcatcacaaagtgtttttcacactttccttaaataaaagtgtttttcacacacatacacacaaacttccacacataaattcgcttgcaaaaaaataggatctttttttaatgttcgatgctgaaacaggggctttaacaaaaataatacttaaaaaccattttatattatacaagtcgctttgacttttcacttagtcaaacttctaaaagtttgatcatgtttataaaaaaaatctagcaacatttctaacacaaaacaaataaaatatatttaatatcatatttaaagaaactaatttggtattatagatattgctaagtttttatataaatttagttttatactaggaaaagtatcaaaaagatttataatattaaatggagttaggagtgttgtgttaccttagggtgaaaacaaaccgtaaggggtgttatgcaaaaactaggatcaccttcatgacaaaaatagcccgaaacaagggcctttttgtaaacattactgccagtccgtcagcgcgcggaacacagcgatctctgccgttggatcgatcatcaacgctccatcggagcaacgccgccccgtcaacaaatgcggcgcctcccccctcccccctcccgacgtttcccgtttcccttccttcgcgcggcgctgctccggtagggtttttagccggcgatctctcccctctcgcgcgctcggcgactgagaatggtcgaggtggaggaagtcagcaacaagatgcaggcgcagatgcgcctccaccccgcggcggcggcggaggaggaggacgccgacctcccgctccctgccctcttcgacaaggcgtcccacctccactccctcgcctccagctcctccctcgatcaggttttccctcgattcacccccccttctcctcatccccatcaaccctctcatggcggtttcatgcgagcgcttactgtggctgcttggtttggtttgggatatttgcaggaagggatccgcaagggggtcgacctgctgcggcggtgcgacgagatggtcagtaagctcggcctcttctcctccaacgagaccaaggatgacgtctccactgccaacctcaaatacctactcgtatgcttgtttcccccactacatctgcgtttagttccgtttctcttatcatatcatgtttgtgcatctgcgacatgtggttatatctgtgatttcgattgattttcttcaggtgccgtactaccttggggaaatgactgaaagggtagcgcaggaagatcggatcccagtccttaaggcgtcgcaggatcatttgaaggttatatcagtttgtcctgtcacatttagttgatttggtgcatatttgtcatgtctttcttatgcccttttcaattgggagcactctgtcatcacaacactcatgttttaatcactacggttacgcaggaattcatttctatctgtgaagcactggagcttatatcagaggatgagcttgaattgtctaggcagaagcaacctgataccatggcaaatcgaagagcacagaaggtgagccttggcaaaatattttttctcgaatatgttaaagccttaaaggggtcatcaatcattctgcaatttacaaacacaataagctgggatccaaatctcttattgagactgcaaaatctgggactcataatctgcttgaccttttccaaagtcggttaatttccactctaattttcttgtttgaccaaacctaggttgcacggttcaagcgccaaaaggctgcagaaacaaagctcctagaaatcaaggagaggaaagaaaggcgtaggcggtcattgagagcagctgctttatcagctcctattgaagctggggaggaagatgcttttgaggatgatggagaggaagaaagagaggttagcagttagcaccagacatttagaacccatttacgtagcaaatctgatcttgtttaccaaatggaaacatcatgatatattcttaaattaccacatagcatatttgaaaatactccaaactaaaattagctacaatgtactagaagtggaagaaaaatatttacttttccagaaaagaaaaggaaaggaaaggctttgttctgttcaatagaagatggaatttgacaaatttgatgattcaagataggttttaaaaatctcatagggaactgatcgcatttcctgaattagcccatttttgtggccatgaaacacacaacagatttgttctgtagtgccagattgtcaccaccaatcttttttcctgtaacaatatgatgcttaatgtctttcctatgctttttatatacaatctcttacttttgtgggcaatcaaccttttgggatctgtcgatgtgtgcttccaaagtttgggctccatgcctgtcataactttactttgatgtacaaatgacaaacggttatgctgtggttttgattcttttttttggttctatgttgcaggcatggttagctactatctcattggctctatgcaaggtttgtgttttgtgggcaagaatgattctcttatactgcttggaatgtttatttgcattcttttaagctactgtgctcgctttgttatcctgatcatcagacgtactcatttctacttcattttataggcttttgaccttcttgacatgttaaagaaggaagaagaaatgcttctggcagtaaaagaaaggcaagcgaaggtaaaacaaatgaataaactttgccaatgtcttgtcaatagtatctttggttgatcctttccagtatcatattgaccttttaacctttcttctgtaaccgttctgtaaccttatacaattattgaacttcgctttggataagccttgagcttatgttgtagtagggcttaccttcaccaagtagatagctggatagttgtatacagtaattccgtttgaaaaaaaatatacaccggattctgagtttggacatacaattaaattaattgtcataatatgataataacttgccattgcaagtatttcatcacacttctctctctctgtgtgtgtgtgtgtgtgtgtgtgcagagtgctgagtgttttgttgttactacatgcaagtaatattagatatttgattttgttttcatgatccttttgtagcactcgatggtagatattctaccgtaagaaaaaaaagaagattttttttatctttgctcccattgtgttgcatatctgtttcaataaactctgcacttacatggaggtttcctttagtaatgaaataattgcctgcttatgatgttttaggatggtaatgcatttgctcgtgaaatgcttgatgaacgtacaaaaaaggctgaagcatggcaccataatgctgccaaccgtgcaccatattccaagccagctgatccaatcacttgtgcaacatttgctcaagatgtcattgaaggtagagcaagtgtttcacaagcacatgagcacaaacaccagccgctgatatttggccctgcaagtcttgttggtggaggactaaccagtgaaagagagagaatggcagcacaagtttttcagccaagttacaggtatgctttaaaatactgctacgtacctggctgaaaactgcactgcttcttttaatatttgtggagggggcattatttgtggcaacttttaatgcatcatattagtcatactttgatatatttgtaggaactttgacctcctattccattgagcattactcgatgagcaaattatttcttggtaaatttgtaaagtggttctttacattgtatttgcttcaccacattagtatgtgactgtgtttattcaatcgtaggtgtttccttgttctattgttgtatgttctgccataagtctgtgacaaatttgtggtttacattgttgatatcattctttttttttcatgctggaaaggcaccatgttaaatttgctactcagtgcaatactagattcactgacaataaactgttgtcttgtactctgttgtgactacgaacgcttggtgcaatcgtatagatgctgagatagtgatttgtaggtgcgaccttatgtttagtcataatccatgaaaaattccaagaaatggtactattctgcaattgctcataaaaaacattagatttcccctgcagcaactaagtgttgagctgtagatcatctctattaaagtgatattgcattgttcagtaaaagttagtgaaaatatgcatatgagactatcctttgatccaattattctgtttccatttttcctgtatttggactattaggttgccaacgatgagcatagaagaagctggcttacgtgagatgaaaatgatggagaaatggcaagaaagaactgctaagatgattcaagaatcaaactccgcatggcacaaggatggcagtcggtcagcccaagaggatgaggacgctgaagaggagaaagcaagagcatgggatgactggaaggacgataaccctcgtggtgcaggcaacaagaagctcactccctgtggctagattatatgctatggcaattctattgaacttagatctgaaactgtagctcttgtaaaaatatgtggttttttactttccttactgcggcatttgttgactgttgagtaataatgtgttccatatgcctattgtaatggtgcatggttttcttctgccaatatattgggaagtaatgccaaaaaaaagctggtttgagaagcaagcttacctgctcggtacaaagatcttatctgctcggtacaagtatgttacactcgtcagccatgcccaaagggtagatcaccctattgggcatgtttggcttagagcaagtttaatagtatagtcaactactagcttcaaaatatctccagccaattcggacaatagttacttaaaaatatatactacatcattaatatctggtcttatatctcatacatacacatcgtcttggagtttatgctacagttgactacacagtttatgctacagttggctacaaatatgtagctcgctttttctctcatatcttatcttctctatatgtgcttgtagctgacttaatagtctgttattgtacttgttcttagctccatggaagatatttttctcgagattaaggtgtcccattgccccatatttggtaatattcatcgatgattaaaacgtttcgaaatgcttgcggaacttaaagtagtcttacactttggtgggtttgcagggggcacgaagaagacaattatgtgacacaaaagccaaacaaatgacaaacccaacttactgctaatcgacctgttattactcgaagcagcttgcaataatttgattcatagaattacagtacacatatccttcacatatttcatgaatactacacatgtccagctgttcgcttcaaacatgaatacatgatagttacttctattctcctttttgtcgtaaaagctgtggatgaaacaacaagccagttccttcaaacttgatctcgatgatctcatcaattttcattgccatctccggtgtcagatagttcctccaatctccgactactccacgccggaagaatatgttgttcggtacgtctttctcgataaagtcagttgtccccgacagattcacctctaacctcgacaagctctccatggcacagatctccacaatcttcctatccactccagcctcttgctcctcaaccgtgaacgggtgcccaacgaactcggccaaacgtctcaataggccaagcgtgtcagcggcaagctcctcgtaggtcaagaagaacacctggcttggcatctcgacgtgccaccgccagtagccgaggacgtgctcccaaaacggcccgaaatgcgagatgccatcgcagaattgccggacagccacatcaatgttccatgacatgaatctattccagaagtgccagagagagacaaaacaatccttgggatcccggcacaggtacaccaccttgctgccggaggcggcaatggagtccggcagcgattgggccgggatgtgcgtcgtcaagagccttggttccgggagcgagctcagatcggggatgcggtcgttgacgaacaactgggactccagaaaagggacgctagctcgtgggcgtcgtggtggagagcagagtacataagcgccttgagccatgtggtgccggacttggggaaggtggcgatgaagacgtccgtggtgcgcgccatcagatgcctcttgatggccatggcgctcacaaccccccgcctggacatgtaccatccgtcagggtggcgacagttgttggaattaatgaatgggccttagcccactcgaagattaattctttggaaaatcacaaaagcccacctcatggaatggcatgcatgtggagtttagtaccaccttgcttattctaggagagggggacctccttaaaagggaggatgccctcctagccacttgaagcatgtgtggtggagagaagaggggaaacacacgcgcgcgctcggctcgcctggcagggcagggcaggcggcgcgcgtgcacgacgtacgcgtcgaatggtccgaaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgtgactgctccctgttcgttcacgacggctcgccttcctcttcgctcgcatgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcctataatctcaacaatccaaaaaccttattataggcactgtgattttactatggctggttttgccgatgcactgaggccggataaattcaccggtgtgcattt

SEQ ID NO: 6293 - DNA, 3767 bp, Oryza sativa
gcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatataaaccatggctaaggaactcgaactccttaagtgtgtcttacccgacaaatttgtggccgggtgcattattgcaaaacttcctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcactactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatctgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctaacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggtttaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctgactagtgcaactaggcctgatatctcctttgctgtgagcaagttgagccgatttacttctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagaactaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctatcaggaaattaagaaactccggagttataacgttggattacatccaaacagcgagaaacctggcagatccctttacgaagggactatcacgaaatgtgatagacaatgcatcgaaggagatgggtttgagacccatgtgagttatactatggtggtaacccagtctatgtgatcggagatcccgtgaa

SEQ ID NO: 6294 - DNA, 5034 bp, Oryza sativa
aaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcacgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaacagtatggttggccgatgccgctgactgccgccgggaaggtctccacgacttgccggagttggtcatagatttccatgtgagacgttccgtcggccgcttcggcagttgaggaggaagccatgaagtgtgtagtcctacgaaaacaataatgagtcttagtcccgtgaacctgacaatatatgattgagatgtaacttgcaaacatgcatctaagagaagagacaaatcccagcagagttctcaagctagctggcactgataatccaccattaattgattgttagagtctgtacatccgtacttatgtgacctatttttcattccttaattccctcctctcaaattatggtgttaggttgagaaatttcatgaacatgggggttaaactttaccttgcaaaaaaatgctgttttttctgagggacaaatttatcatggtgtctagtagtaagatcagctttaattaactatgcgcaccgaaacaagggtttggtagtgatgtaattgtgaattacagtctttcttttcagagatgaaatcatgcaaactactttctagactagaaggtaatggacaatcatctcaataaagtatatatacgacatactcctagttgctaagtgtaagatcagttcagctaactatagatgtgactcgaaaaaataatttggaggaaaacaaatggaagagcagattagcaggtccgtagcatatcatccttatagccttggacagttggactagaatcgcagtttctctttgctcgtgcctccctatgccaattgaggtagctcgttttactgctctaaaataaattgttttggacattgaatggtccttcggttcaagtaataatcaatggtttaatgttttttgcttttttccctcagtatttttatttttatttctaatttattagagtgtcacttggtggtatagaaatgtttcggaggatgtttaataatctttagcatatcaagaaacagtgtggatcatttgaacgttattagtgaattttgatgaatgatctgaaaactgtatgacgatagttacgtacaccaaactaatccacaaagccaaacaacctaacaacccaactcacggctaaccggcaacattttattatattacttgcaatgatttgatttacaaatttccagtacatatatgtatttcttcactcgtgaatacgcaagagattgtatctctattaaacaccgaaaacggcacacaaactattttttgaaagaaaaaacatatactcctagtttgttttaatttattctctttttacttgtaaaaactgcggatgtaacaacaagccagaccctttaaacttgctctttgtaatctcatcaatcctccttgccatctctggcgtcaggtggtttctccaatctccgaccacgccacgccggaagaacgtgttgtttgggacagtgctatcgactatggtgatcgttcccgaccgattcacctctaatccggacatgttctccaatgcgcaggcctccacgatattcctatccaccccgtgcttctgctcctccgtcgtgaatggacatccgacaaactcggcaaggcgtctcaactggccgagtgtgtcggcggcgagctcctcgtaggtcaagaagagtacctggttcggcttctcgacgtgccacctccagtagccgaggatatgctcccagaacggcccaaactgcgagacgccatcgcagaattgccggtgcgcctcgtcgatgtcccacggcatgaacctgttccaaaagtgccagagcgagacgaagcagtccttggggtcccgacaaaggtacaccaccttacaaccggatgtagcgacggagtttggcagtgactgggacgggatgtgcgtcataaacaaccgcggcgaagataaggagctcaggtcagggatccggtcattgacgaacacctgggactcgaggaaagggacgagctggtgcgggctgtgcgccaccagctcgtcagttccgcggtggagagtcgagtacagaagcaccttgagccaagtggtgccggacttggggaaggtggtgaggaagatgtcggtggcgcgcgccgtcaggtgctccttgatcaccatggagctcacaaccccattcgtgaacgtgtaccacccgtccgggtggcggctgcacgggaggccgatgaggctgggagccgacggaaaggtctctgcgactcgtcggagttggtcgtatatctccttatgagctgttgcttcgtcggccgactcgggtgcagaagagagccggaaggagggcgccatgaagaatgaatccagcagaacaccagttaatgagcaatgtattttttctttgatccaatcatactctctgggagtatgaagtgcaaatatatagtactatctcggagaggagagtagtccggaagtaataataaagtattcaagttgacattaattagtattaacttgttattatgtctaggtgttagcatcttttttagatcatcaaagatttcgttgaacaatagcatctctagttatgtagattaattttatctctttttctttctttaatgcacgtgatgctcaacttgagcttgaaaaaagttgttaatgcttcggagggttaaatttaccgtgacatatggatttagcttttaggggagggcattattttgtccattgtatagttttttctttacaaagttcggggggggggggggggggagtttccccacctgaattttatgaaaggaatgaagacttgcagttacatcttagattacagagtttcgaaaagcagacgatagtgtttccttccacgaggaaacaatgcccctatcatccgaattgaaacgctttgcccaaagagttgcatcatctatacatttagttactagtctacgcaaggatgtttgcagccccttgaaaacaacatcatgcctgtggttccacaggccccaaaagcagagaaagaagaagactctgaagtgcttgatgggaatgccatctaggcggcctaaacttgcgagattggctgagcttgtcagtcctgggacaatctaaatggtcgaccagaacgtctgagaaaaagagcaatcaacacagaaatgaaaagcattttcttctaaaacaccacaaagatcgcagttcacggacgaaacaattttctttttgtacaggttctgctttgtggggaggcgttctttagataataaccaaatgaagaactgaatcttcggaggagatttacttttccaaattattttccaattttggtcgtcttggcggtcttcatgcaagtactcgtagatttgcttggacttcaagatggtggcgtgtggagcattgagggctcccctttcgttcagttgatcaacttagtacgaaatcactcaaagcgagaaggagatgttgtagctgagaaggagatcttgtccattgtatagtgatagcagatggtggtattatcttgctcattgtattatgattgatgacaatcgtgagaacgatgtatatcaaaatacattcaatgttatatttaatgaaactaatttagtattattgctaattatttttatagatagatttgataaaatgtcaaaacgattgataagatgaaacgaatggagtagttgctaagttagtgaaacctatataatcttggacatagtaaactatgacaaaatatgactggcaacctaacgcgtcgtattttactatgacattgatgagtggattagctcttagcaagatgcattatcttgcccattttatagtatatatacactacactgatcagaagatatcattaggatcttacgatgaaaattattgatcgaacatgataagacaagcgttattaattatcaacctaaagcaccaaagtgtactgatcatttatagtttagcagtaagcttgtagacttctagtttggttagttacacccaccgatatgacaacgatataataactaggaattgcatagtgttgtatttcagatatacatcatgcaaaactagtactccataagatatgcgaacgtggttgcgaagcgtaacagtaggtcagatcgatccattattaattacacagaaagaaatatctagtatactttataaaccaaacttgaagaatagccgagtgtatctgcacgcttctaaacatgacatccatcagcaaaattgcaaaggacggctgcaaattaaaggtgagatcaccaggctacattcattaattacctatcagtccagcacgacattttagagcatcatatcgatcatatcttgctataaaattataacccactaatcttaaagatcaatatataaacatgtcacatcattatccact

SEQ ID NO: 6295 - DNA, 1772 bp, Oryza sativa
acatcattatccactagcaataattacatataaaacttatgtaagcatgcaatatcatctataattcattgaattttacaaatcatcatccaatcatcttccttcacattatttttaacaatatgcatttttaacaatatgcatatatgtatccatcatttttataatacttaatatatattcatccatataatcaagtgcgggatatcatatttcatctataatttcatacatagtctgctaaatgtatctctctgaatatagtttgacaaaccagttttatttattgttaataactaatataatttttacttttatctcgattattaaaaaatatttaaagttacatagaaatttccacagcaaagcgcggggaatcacctagtatctttaaggcatacacccttcgttcaaaaagaatcatttctatggatgaatctaaataaatgcatatccagattcctaataagaagtaccgccgaacaccaccaaacacgactttgcaaacacatagaaacaatggagtatgtggaccttgccgacacaatgagcaatgcatcatctgagagagacaaccgccgcaacgggtgaccagattctcggtgtagatgacccaaggttcctcgtcgtgcattgcgtcaagcagatctagggccgaagggcgtgttctaaaaaaaaagaaaggcaatggctcaagaacttcactgcaaatatgcggatcttacactttggaaccaaaatgggatagcggcaaacgtgtgcttggaccattataagttgggccggaatggtactgggacctcggtgagggccctttttttcctcaatgtgactgaagccaacatgagacccatgataggttgatcggcttccgatcggctccttttttttaaaggaacacaacaggggaggcacctgttgtttgggaaaactttattaataaagtaaaaggggtctgaaaagaaaattgcaacaaactaatccagctcatggctacatttttgtctctcttattcaatctcaacaacaaaaggagaagattaccctgaaggagctgcctccaagaagttgtgccggaatgggtttaccacttacatgcaggctgggccggaaccatcggtacgccagaacgactatacacgtaggtgaatccaaatcgcaagacataaccgacgtttcattttttgtattttctagttaatctatgcttttctagttaatgaggccgaggatgtagtcgttgatgaacagctgcgactcgaggaaagggacgagctggtggaaggactgtgcgccaccagctcgatcgtgagtgccacagtggagagcggagttcagaagcaccttgagccaatgagccatgtgctgccgagtgaagaagctagcgccctgatccaatgaaccatgtggtgccggacttagagaaggtagcgatgaagacgttggtggcacgcgcagtcagatgcctcttgttgagcatggcgctcacaactccctgcctggacatttaccagccatcgggacggcggcagcatcagcatgacttgctctgacttgttgatccgtcggccacttgggccgttgaggaatgaggaggcgaccatcactagtacaaatccttctatctgtgacgggctctaatatgcttagaaatagcgggccgtcacaaggaagtcatcttaatcgagccgaaaagtgcccgattaagatatggtcgtacagacatgttagatgggtataaaacttaaacccgtcacgaataacacctatca

SEQ ID NO: 6296 - DNA, 14399 bp, Oryza sativa
  unsure (1)..(14399): unsure at all n locations
agcccgtcacaaatgaccatcatctgtgacatgcaccatcttgaggcccgtttaagataacaactaggcccgttacagatgactcatcagtgacgggctatatacttaatctctatcgggcatgaactaaaacccgtcaccgatgactatttttccatttttcatatgaaatgtttatatttgtaagttaactatagcaaaataattttacgggtagtaaatgatttcaaatggaaaaaatgtcaacaataaagttgtataacttatcaatatttacaacttttagtttggtcatttttcaatataacatttttttgaacaatttgaatttgaatttaaaaatatgacaacttcaaacaacattttcaaatactaatgatttcaattgaaaaagtcatcaacaacaaagttgaataactcatcaagatctaaaacttttatttttgttatttcttcatctgacgaaatgttagtaatattattcacaaattttacatatatgtgttatagtttataaaaccagataagagatatgtcaattttgtgaacaatgttactatcactttgtcgtatgaagaaatgaccaaaataaaagttttagatcttgatgagttattcaactttgttgttgatgactttttcagttgatatcatttagtatttaacaatgttgcttnnagttgtcatatttttaaattcaaattcaaacggtccaaaaaatgttatatagaaaaaatgaccaaaataaaagttatagattttgatgagttatacaactttgttattgatgactttttcagttgaagtcattcactgatctaaaattctatttgaacttttcaaactttgaatttcaaatttcaaattgtttaaatagagtcagatggagaaatgaccaaaataaaaaatttgcatctcgatgagttctacaactttggttttggtgacttttccatttgaaatcatttaataaccccaatttgacatcctggcctagggcataataagattaatagaatactcataccaacatattacaattacttttccggaagccaatctctaaagaactttgacattaagtgtgcttggtctggagcaccgattgagatagctcttcacatcagtgacttctagcctgtgacggacgccatgcccgattgagatggggcttaccgcccgattaagttgagggtatccgttctagtgcatgaagagtattctatgcagaatatatgagcattacagcatatgagtgtaagttgcaagtatctaagagaggagacaaatcccagcagagtttttaagctagctgacactgataaatcaccattaattgattgttaggttgttagcgtctgtacatctgtatgtgacctccctccattcaagaaaaactcaattctgaatatgaacctgaacacattagatttttttctttggatggagagagtatttttcattccttattctctcctctaaaattatggtgttaggttgagaaatttcatgcacatggaattaaattttaccttggaaaaaaaatgttgtttctaagggtcaaattttatcatggttccaataggtggattcagcactatcgtaggatcccattttggtgacaacagagagtttagaatatcgagatgatatcattaggcttttgctccaaatttactgataagaatgttgttgttaacgcaaatcactcaacttaacttcagataaaaacacaaatcacccaactgtaataatatttactactccctctgatttttaacgtttgacgctcttatccaacaatcttaaagttctgtaaattttgctggaccatatctgcaagttgtacgaagaagataatcgtgacacaaaaccaatccacaaagccaaacaaccaaaacaaacacaacttactactaatagtagtagagtattattcgaggcagctttcaataatttcatttatagacatacagtacacacgatgttttcactttttgttttcataaataggcaagaggtttgcatgttttttattaagcagagaaataagtacaataatgagaagatgttcctccacttcacacgtgatcatactcctatagttcgtttaattctctttttacttgtaaaaacggtggatgcaacagcaagccagatcctttaaacttgacctctgtaatctcatcaatcctcctcgccatctccggcgtcaggtgattcctccaatctccaaccacgccacgccggaaggatatgttgtttggcacgtctttcttggtgaagttggtcatccccgatcgattcacctctaaccccgataaactttccatggcacaaatctccacgatctttctgtccactctggcatcctgctcctccgttgtgaatgggcgcccgacgaactcggcgaggcgtctcagatggccgagagtgtcagcggcgagctcctcgtaggtcaagaagagtacctcgcttggcctctcgacgtgccaattccagtagctgaggacgtgctcccagtaaagcccaaacaacgagacaccattacagaattgtcgatgtgcgtcatcaatgttccatggcatgaacctgttccaaaagtgccagagcgagacgaagcaatctttgggatcccggcacaggtacaccaccttgcagcctgaggctgcgacggagtctggcaacgattgagacgggatatgcgtcatcaacagccatggctccggcagggagctcaagtcaggtatccgatctttgacgaacacctgagactcgaggaaagagatgagctggtgggggctatgcgccaggagctcgtcagccctgcggtggagagccgagtacggaagcgctttgatccaagtggtgccggacttggggaatgtgacgaggaagatgtcggtggcgcgtgccgtcaggtggctcttgacgaccatggcactcacgacccccgccgtggtcatgtaccagccgtcggggtggcggctgtatggacgtcgatgccgctcggcgccgtcggaaaggtctccgcgacttgccggagttgatcgtagattttcttgtgggcttttgcttcgtccgccgcttcggttacagaggagagccggaaggaggaagccatgaagagtccacactaaacagcaatgaacaaaattatgtgatcttgtgactctgcagtgtgtagagtagtgcaaatcaatatacatataggtgaagagacacaaattttacgcgttcgcgaaaaaagaagagacacaaatcgggaagtcatgatcagtgttcaaaaactgataatgacattctaacttcctggcattaattgagttgttctcacacctctctctctctctatatatatatgacctttttttagtgcacatcgtgctcagcgttagcttgcacaaaagtattcatgcttaccatgacgtcgtcacacgtagtatactgatcagaagataacattatggagtactcttactccgaaaaatatggatcaagcatgataatagtgtacgttactgtcaacttgtttattagtaatatcggcttctagtttgatatactacacataccgacacatgggatttggcactgatataattattgcaaattgcattccaaaaatgcatcgtgccatcgtgcaacctacttccataaaaaactcaattgttgatttggatctggatgtagtgtatgtccagatttaaactcaagattaaaatttttatgggacagagagagtgtaggatcataaaaggccttttccaccccaaaaggtagccattgagatgaggggctcctccacttatatcttaggtgctttgcccttccacaatcaatgtgggactattcaacggggagtactagtaaacatctattaatttatcaaagaaatagaaaaagaagcctccacgttcgctctcatgggaggaatcttcccatcgtgcgcccgatgcccggaaaaaatcagccggtcaaatgtttctattaactaacgagtaaaacatgttatatatggtgaaaaaaaagcaactaaaacatttaaaaattttacaaaacatggtgaagatacacgttgaaacatatcgctattgcatataattaaaatagctaatcttaatggattgaaacatatgtttttctttaatcaaaatataatcatgcgatatctcgatgtaaagatttaattgtaacaaatacacggtgtgatcggatcatagattggataaatagtttagaagaaaaatcgttttgaaactcgctaaaatgcatgcatgcatgaggtggagagagaggagtgagagtagtggcagcaggtagtttcaagaattttgtgaaacatactaacgacacctattgaaacatttcactatcacgtatgaaacaatgagtgttaatggattgaaacatatatttttttcgccataatataatattgtgatatcttattgtaaagatttaattacaaagaatacaaggtgtgatcagatcgtagattggataattagttgagaaaattcattttaaaactcactaaaaagcatgcatgcatgaatgaggtggagagagaggagagggagaagtggtagatagtttcaggaattttgtagaacacactgaagacacatattgaaacatatcactattacgtctgaaacaaagagtgttaacggattgaaacatatattttccttttgtcatattataatcatgtgatatatctattatattattaaaacagccttgaaagaagacatcacgttcactgtgggggctagaaattcccacattaatcggagaaaaagaaaagaagagtctaactaggaatacaatttaaaaaaagtgaaattcgaaattataaataagcactattgaaagaaaagtcctcataggaacacaatacgagattaattaatattcagcataaaaaataaaataaaatccgaaattagcaaaataaaaaaagaaaaagaagagttcgagtagaaatacaattttaaaataactaaaattcgaaattaaaattaagcaaatttgaaaggagagtccatataaaaacccaatacgagattattaaaatttggaataaaaataaaataaattagaaattagaaaaaagaaaagaaaataagagctaaagtagtaatacaatttaaaattaactaaaattcggaattaaatataagcaatattgaaataagagtacatataagaacccaatagtagatgaattaaaattcggaataaaaaataaaataaaatccgaaattagacaaattaaaaatagagttcaagtaggaatataattttgaaatgacttaaacttaaaatagaaaataaaaatattaaaagaacacattacaatattagttaaagtttgaaaaaaaataaaataaattctaaaattagaaaaagaaaaaatatttcaactagaaatataatttataaataactaaaattggtgataaaaaaataaagactattgaaagaaaaaagatcatctataacacatcacgagattaattaagtaatatgcctataaaagagtagagttgtgacggttgatgggacatctaaaaactattaataaaacaccaaatagaattctaatgacgattaaaaggaaggacgacgggaaggtcgtgaagcaatcggtcaaggcggttggcgggacttatagaaagtaaaaaaaaataaatccaatgataatcatatttgattttgaaaatttcgacgataataaaaatgagaggtagtgagcgggttgtataagattacaatggcagagccgccgatggctggtgggacttctagaaagtaaaaaaaataaattccaacgatagttatgttcaatttttagaatcccaatgataataaagagtaggcggtggatgagtcgtagaggagtacagtggtagagtttgacgggatttctaaaaattatatataaaaaaagaaacccaacgaaacaataaactctgaaacctataagatccaatttttaaaggttcgtgcttctaaagtaaaaaagtaaaccccaatgataatcttgtttgatttaaaaatctcaataacaataaaaagggcaacagcgggtgaaccgtagaagagtacagtgacaaagtcgctgactttttggcggaacttctagaaagtaaaaaataaacctaaataataattatattcgatttttaaaataccaatgacaataaaaagaaaaggcagtggatggttgtagaggagtataatggcagcgtttgatgagacttctataaattataaaagcgaaacccaacagtaatttgaggagcttgcaataatttcatttatagacatacagtacattctatgttttcactttttattttcataaatagacacgaggtttgctttttttttttcattaagcaaagaaataagtacaatagtgagatgttcctccacttcacttgccaatagttcattttattctctttttgcttgtaaaaattgtggatgcaacagcaagccggatcctttaaacttgatctccgtaatctcatcaatcctcctcgccatctccggtgtcaggtgattcctctaatcaccgaccacgccacgccggaagaatatgttgttcacgtaggttttatcaaccatgtcagttgtccccgactggttcacttccaacctcgacaagctctccatggcgcaggcctccacgatcttcctgtccactccgagctcctgctcctccaccatgaacgggcatccgacgaactcggctaggtgtctcagttggccgagtgtatcggtagtgagctcctcataggtcaagaagagtacctggcttggtctcttggtgtgccacctccaatagccaaggacatgctcccagtacgggccaaacagtgagacaccatcgcagaagtgtcgatgtgcctcgttgatgtcccacggcctgaacctgttcaagaaatgccagagcgagatgaagcagtccttggaatcctggacaacacctatcatttacatacgatttaaatagttataaaaaaattaaaaaaaaattagtaacatcaattgtgatgatataagtctacacacaaacatgtaggactaaatttgatttacaactagagaaacaaaaataataaaatcagacagtgaatagtacccgtacagtgcagataaaatttgttatttttgtttcatcatatatcgatcgaatatagacttgcatgtttgtatagtgtcttatattatcatagtctatcttaccaaattttataatttttttatataaatgtttaaattacatacatacacctaggtgccaggtgccatggcatctaggtgtagaaaatactttctgttgggatcccggcatagatacaccactttgcagccggagtcggcaacagagtccggcaacgactgggacgggatgtgcgtcatcaagagccgcggcgccgggagggagctcaggtcagggatccggtctttgatgaacacctgggtctcaaggaaaggaacgagctggtggggactgtgcgccgctagatcgttggccccgcggtggagagccgagtgcaagagcgtcttgagccaggtggtgccggacttagggaaggtgaccatgaagatgtcggtggtgcgcgccgtaaggtgactcttgatgaccatggcactcacaaccccctccgggaacgtgtaccatccgtcggggtggcgactgtacgtgaagctgttgctgctgttgggtgccgtcgggaaggtctccacggtttgtcggagttggtcatagatttccttgtgtgcggctgcttcatcagctgattggggtgcaaaggagagcgggaaggagggcgccatgaaaagtgaatgcagaacaccaaggactaatggttgttagctggtgttgtgatgctgtgattctgtgaatatgtgggagcgtaaagtgcaaatatataggcgaggagagacagattcggaagtcaatagaacatgaatagtgttcaaactggcagtgacattttgacattaactatcttgttagcatctcttaagtgttttcatatgagtctccctttcttttgtcaatgcacgtgatgatcaacttgagcttacaagaatttattaattcttctgaggatcaaattgtatcatgtcgtcaatcagtgagtttagctcttaatagggagtattaccgccccttttcttagcgaggatgacacatgtgagaacgtactatactgattagaagatacctttagaatcttgtcctgagaaatatggataaaaaatgataaagacagcgtgttatatattgtcaacataaaacaccaaactgggtgattgttagtttagcagtaatatcagtttctagtttgattacatagaccgattcatggatttgagagtgagaaaataactgcagattgcatagtgttgcattcaagagatgcatggttgctaagcgcaagaatagcttataataactgattttgcacagaaaaagatctggtatactctgtaacaagacttgagcgattttgggccagagattgagacctcagtgctggaaaggagctccggcctacgtacggcctgtacaaattggcccagacgggactgcggcctcggtgctgcccataaggattggcccagactccagaacagggttacggcactggaaataagtctatttatatccctcaactcatttatgtggttgaatcgcattcctcaaccgcaacaccgagtataacccgtccaccaaatcccaaaaccgttgcaaattgactcctaggatggtttcaaaggcagttttgtcccacatggcatatttggccccgttgatttgctgagtcagcttgtgaaacccatatgtcaaagacaagaataaaaatgaaaatggtggggcccactgttgcccaccgccgtcacaagcgttccccacacattgccttcgccgcctctaccacatcgcatttgccgcatttccccctccaatcccgcaatacgccaccgccgtcgctggtcgatgccccctcctcccccgtcgctgccgtagcagcaatcggggatgacgtcggcggtagcagtaggcagtgccaatcctccaccccacgtgccaaaaccctagtagcaccccacgcggcggccacctcctcctcccactcatgccagccgtcaccgacgtctcttgctgcggcttcgtggaatcagtttggtcattgccgtagcacgcgtcgatgccaccaatgctgtgggccaccatcggccatccatatgtgttgcgtgcagacggaggtgcaggaggaagagggtgacgggagcatgatccggtccaactcccccatctcccgttacatcgtcctctccttcctcaactccggtcactactcactagtcactactccatcctcttttcttctcgacggctggcagcagggtggggtggtgaccaacgagatggtcggctagaggagcgagagaagggcctagagaagaaaaggaggaggcgaggccaagccccaggatagggttgcccatggtggcgacggaggcggctgctgcggcgggagggaaggggaaaggggaggggggaatgcggcgacggcaatgccggagaggcagggaagacgatgtgcgcaacggcggtgggcattgacagtggaccctactgttttcacttttatccttgtctatgacatgtgggtcccacaagctgactcagcaagtcaacgggtcaaagatatcacgtaggacaaaactgcctccaaaaccatgtggggagttaatttgcagtggttttgggagttggaggatgagttatatccggttttgcggttaagggatacgattttcaaccagggacatgacttaagggaggtataatagacttatttcaaacggactacgtgcggcccatatatgttggtcgggaacgtgattatagactacgtgaggcccatataatctgggccggaacagaaagctagcccagatatgacggtgagcgagcggcgagagcgagaagacgccgccgctgtgaacgagagaggatgaggttggcgcgcggtacgcacttcgccatggaggagcatgagtttccaaaccacctctcatcatctcatgccaacacgtcagtcagtcatcagactgagcgtttttttttttttggcagccgtacgtcgatcgagcgatgcatgcgaagtttcttggtgccttcccgatcaaccaactccatctcgttcacgtatgcattccggtcgtcggcacgttaagtttgataataatgttcacattgtacatacgacttacccaatcacgtaccttagtaattacgccctccgtacaaaataagtacagttttgcactattcacgtttaacgtttgaccgttcgtcttatttgaaaattttttatgattagtatttttattgctattagatgataaaacatgaatagtactttatgtatgactaaatatttttaaattttttataaattttttaaataagacgaacggtcaaacgttgggcacggatatctacggctgtacttattttggggacgaaggaggtagtaacacgtattgtacgtgtggtgtgtgcccccgtggtaatgttgatgttgattgctgttgctgctgacatgccatgcatgcgtacgtgttgaagtcgtgaacacagccgaaaatccaagctgcgagatcgacaaattaaactctctcaagttgcatgcagatcaatttgttacttacctgttgcaatcgaaagtgtttattttttcgagagtgaatatttcctcgttttatttatataatctaaataattataaataaaattaaatgaattggcaagatgtgttatatcactccacaggtttaaacttttgacttacacaaattcaaaaaataacaaatatgatatattagattatacatacatgtataagtcgcattatagttgaatgatatattatatattaatctattttactatatatattttcaatatttctactgacatttttagtgacaagaaaaaacgatggaacattcctccattcctcccatagacaaaagacactcccagtgcaatcctcttccttattttagattgatcatcgttctattgtatttgtgacattatataagatgttatatgatataatgatacaatttcattttcatacatacttcctctatctcaaaatattataacttctaatctaaagtttaatttttatcacaaatataacaatctagtacggtgtaaaagaatatttttactactaaaactacccattctattcattttgtttactataaccctaactagtcttgactagtaatatgcccgtgctaaacgctactgtgcaattcgatttatctttaagaacttttaagatttcacgttagcaaagaaatccgtggattgcaacacaaatatatattaatgagctcaaatatattagtatatattatatcacacggcacacacatgtacacatagttgaaatgataatttcctaaaaacaaaattccaccatgtaatttctctagttcctctaaaaattcggccatttactctaatctccttacaacatagacgctaaaacgacaaggctaatagttaggattgacttcttagttcaataaccatacaacggacaatgtgacatcacacaagcatatgtatgtacaatcataattttacaatctcaaacaatcattcgtgtctatatgcacgttgataattcattgaacatgatatgtctacacaaatatgttgccggattcaacaaaattccttgcacgccataattgacaaagggacagagccgtcaacttgaactacagcagttaggaaatttctctgatccaatgtatataatataaaccagcacatttacaaattatcttggtagggttactatgcgagccgagccggctcggtatccaaccctagttaccattgttagcttaaactattatttatcaaatagatctatcatcgatagttttttttttctagcgaactgaatgcgattgattctcgttgcagtacctctcaaacaattttgtttgacaataatggagagaaattggtgcaactacaactcctttaactccctgctattgtatatgaaggccgaaggccatccaagttatgttatcaggcttatcagactcccgatgaatataaagaagttaaaatcacagcgaattttcagacacaaaaccacctcagaaacgaccataaaataatatggtcaacaacaaccttgctccaattcagaactcgccaaaatcaaaagccttcaaatgatcttcaacaatacatttaatgaacacaagggataaaataacagatattagtataacttgtgccaatggataaaatctgcgcatgataaataatgagtgcctacatatacaacaaactaatgatgtcactataacagtatctgttagcatttccatcacagcccattaattcgcaagaactctccatgctttacaccaacacaaacatcactaaataaagctttcgaagagaacaggtgtgcgctaactgaaccctagcatcaaacacaaaaccctaaaagaaaaaaggaaaaagaatcacccagtttggcaacttcattgctgcagagaaaattattattttcaggtgccgttacttgacacatttgcttctttttcttgcagatcaacaattaattcaaaagagtcttgtgtttcggctgggcatttcgagtcttcttttaatctcacgatgaagtacagtgagtaaattgatacacactttgtaaagatcattatcagatttgtgcaacctataataaaaaaaaagctttatttaccattatgttactgcaatatcaaactctcaacctcttatgccatactgaattggcatcaataaattgacccagcagtggacattctcaaattctcacattgacattcaattatcacattcaatattgattcacaatctgaattcacgtcaatttacaatctcaatctcaatcttagctaactatagcttttcttttctagagcaccatatttcatccatctaatataatacataccatatttacaattacaattcacaattatatcaatacaggacaaaaatatattacacaatgaagggtaagggagaagatatcgaaccaaaggcaagacaatatggcagaggaagatatcactattattattctgcttataatcacgcttcttttgattgattgttgatcagtgaccagttgtgttaaaaatcaacctggaatagtttatcaccgtagaaatgtacaattattatttgtctatcacagtataaatgtacaattgttgtcacactgccttcaaaacaaatcaatcattacactacggtaatataataatggcaatgcccactttttaaccatgtgctgcaatgggaatgaaatatgtaccttgcacgggtggctgatgcaatttcaatacatcgcgcgtgtatccagcattttagcctccacttgcatgcacgctacgatcgccttccctcacgctatccagtaaacaacaatttttccaccaaacatgtttaaatttatatgggacaacatatctgtagcatgtagcgtccaaattgatcaaacgcagtggtatagctatattggatcctggaactgcaacgaagaacagaattgcacttaccatggcttagggcgcgttccttgaagaacagaaaattaaacttaccatggcttaggccgcatttggatagggatttttttccagcactcaacacaagataagccattaatatacaattaattaagtattaattatttgaaacttgaaatagtttgtttgattattcaaaaaatttctgtatgagatatttttataaaaaaatacattttttagtagtttaaaaagtatgctcacgataaatgagggagttgcaaaagccaaatgcactccccatctcagtcttattccaagaatcctagctagtatataatggtacattaatttctaaattctaaagtattacctaaccagagttttttgagagagattattttgatgtaaacaaacataacatcctgtaaacctgaataatcaaggctctacaaactacaaattgaaaaagaaaaaggaaaaaaaagttgaaccgaatcctgaaattaaaatcacctgccatcatatatttcattcaacacagctgaacttttacattaatcactttcgactatacgtattttctccatcctttctatttctgctgaaaataaatgcccctttcctttctatttgtgctaccaggctgatagattcataaatctgggaactcacctgcagatgtgaaatggcttccagatgagcagtaaatccaagccaacact

SEQ ID NO: 6297 - DNA, 605 bp, Oryza sativa
attaggagctgtaaacttcaatatagacatatagtgagggaaacatactattcccctacacatatattcccaggccaacttcctttggatcagtctctatcatccaggaaggcctgtcaatcaaaatttacggtattgtgtcagctagcatactcattattgattattagcttactaatgggtgttgaaattgagcagagaggacatcacttgttcatcacgaagatcgttgttccttgagacgcccgctcaagaagcaccttccttgattcaattgctactccctctggctgcattatgaataaaagtggtgattttagaaaattaaaacaatactcccactgttatgggttaggattcatagggggtaaacaccgccgagaggatagccgggcggcgacggctgctagggatgagagggggacttaggttgggagagactaatcttgattcattgcttaattagaatgatgatacaaaccatccttatatagatggagggaggacccagtctaatcctatccaaccaactctatccttatccctagggcctcgacccctcggcccactacctatgacacccaccgtccctaaatataagggat

SEQ ID NO: 6298 - DNA, 2623 bp, Oryza sativa
  unsure (1)..(2623): unsure at all n locations
nnnnnnnnnnnnnnnnnnnnnnnnnnnnnnnnnnnnnnnnnnnnnnnnnnnnnnnnatcttttgcaacggaatcatatgtccactactaccaagaagggtttcctaggcggctagaatttcttttcacgcacaactacgaaaaacatattttgtagcaaccaaaataggttattgttggcagtcataagctccgccacataccaagggtccatacgggtggtagagcatccgtgcgcgaatttcttttcataaatggttagggcatccacccgaaactagatgttggtaaaaattagtaggatttatatatacggctccacaaccatatgtaaaaacttgattttcttcatccagagagagatatggtttgtttgttatggaaggatagtggtttcccaccaatttagctttgatggtttacttgactccaaatttccataccgtgtgtcaagccatcaaacaatcatatatagcacaaatcacatggactgtttggtcatcttgcacaaaatgaggcaagcatcctacctgcacctctagaaagtagtaccagtagaaaacggatacatgcccaaaacggcatccattattccattaagttccccggaaaacacgaagaaagagagggtaagcatatcttttgcaacggaatcgatcgaggtcgaggtgtcttaattattggaaaccatatgccaatatcttgccatcatgtatgtatttatgtgtagtggtgtgatgatatatatatatcgattgatctacttaaaagaaaacgagaaatgtgaaaattataaaccacaagcaacctagtgctttactggttgcacctacctacccttcgataaaaaatggaaaactattaattggtatagctaggttgtacattgcacgaaggaaaattttggtttgtgctaagagtcggaaaactgtctaagtctatactttgatctatgtaggctaggagaaattgttaggtctaaatgttagtacgtactgcttttctatgttccggctatcaatgcgtcaggcgcggcagtggcgacggcgatgacgggagctcgggcggcagtggggctagggtttttcttttggaattttatatttttgtgatttttttctttttacatgcggtcggcttaagcgcccgctggttgtgctagctgcatgcaaaaataccgattttcacataccttttcacgcatgtggctgcagcaaccgcatgcaaaaatcagtttcacccgtatgcaaaaacgtgttatgtagtagtgatggtttacctagtggaacatacaaaataaaaacacacccccacaatatttcgcaaatggtggtataaaatagggagagaaaaatacatatttttagcaaagtcaatttagccttatggttatcaactactacctccatcccaaaatatttgacgccgttgacttttttaaaaatgtttgaccgttcgtcttattcaaaaaatttaagtaattgttaattctttttctatcatttgatttattgttaaatatacttttatgtatacatataattttacacatatcgcaaaagtttttgaataaaacgaacggtcaaacatattttaaaaagtcaacggtgtcaaacatttaaggaatgagggagtatatcataaatatactgataattttactagagttaccaactatatcataaatataaagataacaaattcagtaagacatcaccctgcaaaattctaagcaatagatactgaccataacatgctcatgaagaaactggctatcagtatcatcggctcctgcctcctgggtgcactgcaactatgcagcacgcagatccgtggtgaactgggtcaagcaagcaaggcaggattctaatgctcaagtgaagatagaaatatgtacaacgccgcagaagtagatctagcactgagagagtaacaatgatcaatcaaaattggagcaataatcaaaacacatctggaaggatttgtggtgttgcatccaaagccaagcagccagctgaaacaccatggccaaagacgactggccatgcatatgctaatgtttggtattggagctgatctaatacactgtataatttaaataattatgtgattagtgggttggtataaaacataagctagtttgttgggcgaggcattggctccgcctctggggtttagctagcaagatagtaacacagaatgtcctttttattactatacggaagaaaatagtggtactggttctgtttggtaatgctgcattacagatgtagccggctgcgctgcacagccggagctacacattttttaccgtgtaatgtagctgctgcagtctaaacaagtactctactatattttgcaatgtaaattcactactacaaaacatcaaatagatatcggtactataggtgccggaagtgctaaaaccggtacctataggtctttttccactttcgcaggttgaaatcgcaaaaaaaaacgatacctttaagcaattataggtaccggttctaaataagaaccgacacctattctataggtgcccccttttttttaaaaaaaatggtacctttaatatattatagatatcggttaattaaaagctgacacccacagaaatcgag

SEQ ID NO: 6299 - DNA, 2951 bp, Oryza sativa
gaggggataagaggttcgctcgcttctcgatctctctcttgcccctctctctctcactctctcgctcgctcgctctcgccccctcctccttctccccacatacggtgtcggcggtggtggcttctctcccacgacagatgcggcggtgggcgaggcggcctcgacggcggccggggtggcaacggcgggtggagccgcagtcgaggtcggcgtcggcggcagaggcttctcccaaggacggagtggtggcggcggtggcggctcccacgacggatctagcctcaacggtagccggggccgcatccggggtcggcgtcggcggcggaggtttctcccgcgggtggagcggtggcggcggcggctcccgcgacgaatccggcgacgtatcggcaacggtgatttgtactataaatttgattttgtttctatgaaattgttgagggatctgtgatttgagcttctttcacatgtgatttgtgtgaaacttttatgatttgtgctttgagggatctatcattggatggatcaaagatggtgctttgagggatatgtcttggatggatcgatggtgacagtgtgtgaaacttctgtgatttgctttggatcgatggggtctcgaggtgatggggaacggctcgatgcatcgagacccccccccccttttttttggattcttgggaccaaaaaggtgccggttcctaaaccggcacatttgaatattgttggatagtagaagagagagatatactgtgaatattagacacgttgtattgagcctcagggggccggtatatataggagtacaaggggaggagataaggaaggaatccacacatatcaatcctatcctaatatgactctaactaccatatactctaacatccccccgtagtccatgcgtgagcaaagcggacacttggattggagaagaaaccagcaagagtgctcaagacgaatgattgccctttgtgccatgtcgatgtagccaaagcgaaggatgcgaaggacccgtgggcgacgaagccgtgcgtaaagtagccatggtcgatgtagccgaagtcgggaagctgatgtcgaggtacccaagccgcagagcgcgcatggggcgccgtagagtggtcgtggacgcacaggagggcgtcatggaccaaggtgcgtgaggatgcactggagacgatgacggtgacccgatcgcggcagtcattgaggaagatgatgccaaagagccgatgtagtcgaactgtaaagaagagatgtcacgccgggtttgccagactcgggaacaactcgggacaaacacgcgcaacagtgttgccaatatcgtgccggcaaggcaagggaccaccgtgaatcatacgcaaatgtcggaggagactagcaaataatgcctccgggacagtcgtggcgtgagaatgacgtagagggagaattccggagcagcgcgcagttgctgaagaagagcgaagtgtagtcaagaaagatacgacgacgctggcgatgaaacatgctggacgaagaagaaggcaaagtaggaccaacggcctggacagcgacatcggtagctatgtagaggtagctagaccactggcctagaacggcgacagtggcagcttggagacacggcggcgatgctcgaagtagacaaagaagactcgagtggctgacgatgaccagtgcggatgacgaggttgtcgatgcacgaacgacgatgaagacgacgagacgggcgacactatgacccgaaggggtgatacaggtgtagctccatgttgatgcagcgacgtgaaatccagcggcggtgaggccacagtgaggaggacgtctctccgtggaccacaggcggcaacactgcggcccgagagggcgacgcagcggcaacccaaagcttgatggcgtagtagatatgctcgcagacgatcagttgcagaagtcatcatgtatgtgtgcttgatcaggtgatcagaccgaagttgcacacaacggaacaatgaagtcgaagccgaagttgatgccgatgtcggagacacgtagatgttaacgaggcggtaggcgacacaaacctgatctctggtcgggagaaagaagaaagatacaagcaacaacacagtagcagcagtccacaccacaccacagccctccaacgcaactcatgcaggtctggtcaccatgacgtcaacgaagtcaacaagcctagatatctccacaccaatcagtctctctcctctcacttggcagcaacgcacgagatcacagcagagacgatggctagtcaacagggtcaaaaggaggcactgcagaaagtggtcacagggcgctcggccaacgactgtccagccagagatgctgacggagggcgtcggcgcagcaagacggaggcggtgcggaaggagtccggcggccgggtggagaggtcgacggggtggtgccggcagagcgcgccaggccgggggcggtcggggctcggcgacgccggccgtgcacctcgacgcggtgaggaagaagcgaccgtccacccggcggcggcggggatggctcgatgacgagaactcgcgacgcgacgaccggtagatccatgcgttactgcggctgatgcttgactcaaaccaccatgacgccgacgagggtcactggagaagatcgagatcgatccctcacgggcaaccaccatgacgacgaacccaaaaaaaaaaggaaaacaaaaaatggtgcccgcccccgtgagatcgaaatgctccccggggcgacgagcagaagcgcgagcggcggcgaccctacatcacccgcttggataccatattgatagtagacgagagatatactgcgaatattagacacgttaccatctttcgtcggtcgtccaaaaacataatagtcctagtttgaataggaatcgggactaaaaattattaaagattatttttagtcttagttcaaagaagttggcgggtctg

SEQ ID NO: 6300 - DNA, 5474 bp, Oryza sativa
gttaggagcgagttcagatcttggctcctgacactaaggagcttttttttttattttgtgaattgatgtgtagatttgtttgttgatttggggatgattggtggattgcggaagggcatgtatagtggatgattgtgtatgatttgtgaatggttttcttggatgatttatgtgtgtgatttttgtgtgattgtgctcgagatataaacaacaaaacaacaatgaaaaaaaaaagagaaaaaaagtaacaccaaccgagactaaagatccggttatttcaactggtccggattcatagtcccagttataaaaccgggactacagggggttaccaatcgggactacaaaaggtttcttcggtagtgtaaggaaggattacaaataggaaggaattcacacatatcaattatattctaatatgactctaactaccatatactctaaccaatattcatatatgtgccgcttctatggtgctggttgagaaaatcggtaactatgtggggttcctaaccggcactgatgtggtgtagtgattttctatatcttatggtttgatatctccctgcagtgatcaagctaggcatcaaatattgaaaccaccgtcgatatgttggtggagacgcagagtggagttataggtgcataagcataactacttatcaaatgtagttcggttgtgcctaaggctgtgcatgttcgatacattgagttgggaactaatctcttgcgcatgcaaaacacagagcgacttattagcacataattaattaagtattagctatattttttaaaaaatagattaatatgtttttaaagcaactttgctatagaaaatttttacaaaaaataaactatttagcattttgggaaacctgcgtgcggaaaacgagaaagaatagttgatattagatgacaagttttatagtcacatctaatattatccatatcatcaactaatttactaggggacattgtgaaaaggttgctttttacatgaggggtcgttcatcctctctctcctcttttctcttctctaccttatcatttaagcttatgtgttatctaggagctcgtgggctcgtgcttagatgcttatagtacttgccgatactgatagataaaaataatctcgttaatcttattttataggaaggatgtagagtattacggttggaataagatcactttgacttcctcaactgaccaccaaatctaaatcatatccctcaaccgcaatactagaaattttgaacccccaacttacaaaaccggtacaatttgactcttttggtggttttggagagtggttttgctgatgtagcgcacacgtggcagtgttgacttggtcttcgtcccacgtggcgttgacgtgacacttatgctgcattaaaattaaaaaatatatgcgaagcccaattgtcattcacacaaaaataattgtgggccccactgacatgtggttcctacatgtcatcctctctctcaccacccttctttttcctcctctctcccttatttctctctctccccttgacatgagccggcggcaggtgggggctcgagcggcggtgcggtcggagagctcggcgaggagcgcgttgacagagagcagcgcggcggtggagcccgcgatgacaccgagcacgacgcctgtggtgcccaccaccttcccgggcaccggccactcgatcttcgacatctcctgcgcgacgccgacccaccacccgctgctgatggccgcggtctcggcctccttcagctccgccgccaccgtctcggggctcttctcccctcctcctccttcccggcctcctctgcgccgtccaccaccgtcatggacgcctcctgctgctcctgctcttgccccttcttgttctcctccgctcttgcgcccttggacttggagccgcgagggcgaggcggccgggcagctggcggcggcggagcgggagagggatagggagatcgcgggagggtagaaggtggagaaggaagcgcgcgaggcagcggcggcggcggctgggacgaggcgggcggcgtggtcgccatggcttcccggtttgatgggtccagcggcccgtccgccaccgccattcggagctctggatctaggccgtcgccaccgccgattcggacgccgctccccacgcacaaagagaaagagggagagatagagaagggaggagagggaggaggaagaagggataaagagaggatgacacgtgggacccacatgtcagcggggcctacaattatttttgtgtgaatgacaaatggacccacatatattttaaattttaatgccatgtaagcgccacgtcaatgccacgtgggacaaagaccaaatcaacgctgccacgtatatgccacatcagcaaaaccactctccaaaaccaccaagggagtcaaatcgtaccgattttgtaagttgggggttcaagatttctggtattgcggttgagggatacgatttagattcggtggtcagttgagggagtcaaagtgatcttccattacggttacggtaaatagtttatccgatccgtttgccttggtggacggcccaatacatcatcacggcctatcgaagttcggcagcccgtacgggcccatgactagcgaccacagtccgggcccacacccacaccgcccaaccaccccactcccctccccgccacgtcgccattcttcccgctcctgacctttctctacccttctcctcttctcttctcctctcctcccccaaataaccaaaccaaaccctgtataggctcgtataggccaaggcagaagcttcccaaaccctcgctctgcccgtcgatctccgtcgccttctgatccccgcgcgcgcggctgcctatatataagttgcggtgatcggcgggcggctgcaccggcatggggctggagatcatgacggacgaggctgctgctgcgccttcgcccgctgcggcggcggcgcgtgtcgagatttacccgctctgccgctactacttcggcgccagggatgttgccgctggtggcgcgggtgcggggttggagaccgccgccgaccgcgccctccgcctcaaggccaagtacgcacgcgcgcgcgcactacccgccacctgctcgatcaaatgcgtgacgatcatgtaattttgtgtgtgtggtttgattgatctgtgcagcttcgcggcgcacgggctccggaccagcgtccatggcgtcctgctggttgagctctttgatcatccgcacgtgctgctcctgcaagtcaggaactcctccttcctcctccccggtggccgcttgagaccaggggaacaaggtgctcatcaatcatcattgctgcaatttcccaagttttcccgtaaaaattttaggaatggattgaattgaacctactattgaattcttgccatgtgcaagtgtctactgccgagtaggatgtgattttctcctcgtgggagataatgctagtgcaccggtacacttgcaatttggatgacacgtgtgttgcctggtatctctgcttcagatgtccaagggctcaagcgcaaactttcaaccaagttatcggtagctggacatcaggatgacgaagacggcgacggggacgacgaatggcaggtaactggagtgaacagagatgttcagtaatgttgggagtgagaccaccagtatgatccagcaaattattcatccttttcacgttgattatcggctatagattggagagtgcattgggatgtggtggagatctgagtttgatgctgctccatttccatatctacttccaaatgcccgtgcaccaaaggtaaagagcttgacatacactccggttcatccatgaaccatgtggtttcctcaaataatattaatgtgcttataacctgagtgaatcattttattgttgcctgtcatgaaggaatgcataaaactgttcttgattaaactgccggtgtctcgccaatttgtcgtgccaaggaacatgaagctgctagctgtgcctctatcccagattcatgacaatgctcaggtcagtttggttatcaccatccaacacaagggattttaccatctttttttaagctcagctgcttcagctgactctttttttttttgcaggtatatggctcaatcatagctggaattccaaactgttatcgaagttctccatgaacatcatcagtgactgagatgcatgccacatgccgttaagagctgtcacggctttacatgagactagcatattcgatctagtagtagaacatgttgtgtataaactgtacctggtagaaatataaactttggaattcacgagctggtgctgtcctgtatgttgtgcaatcttttttttttcttttactgtatagaggtaatgtattgtatttgtatatgttatcaacaccaggtgtggtgttatttttgtaacccttctgatatggctgtagaaatgaaacagttctgtacaagatttgtgattttcattgccagtcctgacaaaagctgaaccaagcacacctcgctgcgaggaccaaacatgtcttttcgattgcccaagcaaaagatagagatagaactaaacaaactttaaaatatgatcgttagaacagccacacccggcacaacctttcgaagaacatttgtgttgtacgatcctccatgagcgtacaaatagctttagcccaaaaggaaggctacatgtcgtgctgcagcagctcgttcactgtctgagcaaggttaggctcgctcctgatgctctcgatccatctcgcgctgatacggaccctctcgaggctctgcttcagtgcacgctcgaacgatggtttggttttaccggcgaagaactcggaaacttcagcagccttctcctctgtggtgaactgatcatgcagagaaaacggcgaatttagcagcagagcaaggagaacaatgaagcaaaaagtggtcggtgacttcgcgtacccgtgaaacagtagatttgacgaagtccgatatgagtgaacttgatggccaggtcttcaagacatgatcccagttttcctgcatcatgcacagatgggctcatggtcataaaagtacaacttactctgaactcctaatcagacttgctaaaaataacagaacttattaatgtaacttcttcgtttagctcattattactgcctctgtcccataataattgtatttataggatttgaatttgtccaaaaatagttatcacaacagaatactaatggtctcattaatcatttcttattcaaatttctctctattttaccttcaactaccctcccactcttacctatataccatttaataaggggtatcatagtctttcttcttaaaccttaatatatgctaaacaacctagaattacaattattttgggggcggaggtagtatcaaatagtgtgttatgcaggcagcatctcttctataaagtggaaaaatgtgttctattgttattcatacgctacaagctt

SEQ ID NO: 6301 - DNA, 6459 bp, Oryza sativa
aaagctcattagcagcatactcctatttggtgcaactgcataaacggcttcagttcatctgtcagaacagctttcctatgatgtactgtgtatctcagtaaaaccttttgcttttttgttttctggttggctaaaagagcaggaccaatgatatttggtaaaatagattgattgcgccagttttgggtgaagagacctaatcgtgcaaagtgtgaacagggagggaacatcattcaattgcagtaacttggatattggcacggtcggtgcaaaggaagttttgataatttcatcttccctatttcatctgttttagttccatcgttaacttttaacaaattatttgttcttgtattgagatagacacctagcatgcattggcatttggcagaacaattgaactttgaacccctcacaacagtaaaaatatatatatattgagcaccacatacagtgcttatgttttttctttcaaaaatatcagaaatgtgtgcgttgtttatcagataactataataatccactttaggtaccctgcaactataataacataccttcaaccaggcccatgcaacttctcgtccttctaagctgataccaccaaggacataaaatgcatcttgattccgtacctaacaagcaagagagagattagattggcttctgtaccaatggtgtataatggttctcattctaccatttactatctggaatcatttgttcagaataagtaaaatataaatgattcagagggttaacctcatcggtaagcatgaagtttagtgcctcaagaacaatatccttatccaggcatgaagacaatgaacctaaaacagaagaaacgttactttccaggacaactcatcagaaaattcctgctgtcgcttaagctagacggttggaatgcacaaacctaagatgcgtgacttctcctgagcttcagctgtttctctgtagattttcaggagggcatcataaccagctctgctggaggtagtaacagtccgcatcacagcaagatatgaagcctgcagaccaatgcatatcagtatgctagatatcatagaggtaacactgcagtagtatgttaagcaaaagcctgaacctttctagtgtctgggggaagaatgttagttttgcggtcttttatgaagatatggaaccgcctaactccctcatttatagtctcatcatgtccaagtttgacaagggcaatcaagagcaatgatctaagcattacatcaagatggctctcgccctccttgggatcccagcctagtgttctgatatttagaagtacaagaaggatttcaatatgatcatagaaagaaaacagcaggaatatagtagacagaagtttattaacagaaacaaattcaccagtggcatgcgccaactcagaagtaaatatacaaatgcacataaatgataatatccagattcgtgaaatccagataaacatgatgatgaaaatggtaaaacattaagtttgttagcatacttggcagctgatagaagaagattgatcaaaagctgtttgatatctctggacaattcaggagtagcatcaactgatattttatcaatgcctaagcatacctgtcaaaaaggatgcatgtatttaatattgagaacaatagttgataccatagaatcaatcaaagatacaaggtatatgatttcattggaggtggcgaaaggtttacttacagaggttacatgtgaaagcacagtgtaatcagactcattgcgataagcattcagcaggcgaagcaaggatgtcagtgtttgcttgcgagccacagaaagggagtatgaatcttccacaatacctgcagcaaaatattgtgtttctgttgtcaaaatcttgacaaggatatattatacgagtagtattgaaaattcatcttgtcattaccaatcttatccattaaagagagcttattggctttgattgccttttcaagtccagctgcaagttcatcatcatacttcactctataaaatccagtttggtcaacgttcaatttgatccaacagttttcacccttctctcctccggcattttgggaggcagtgaggtctatatggaccttatcagtcttgcccttcaagagaaactttttctgtgcatcatatgagccacaacatgatgttataggaacaatccacaagcctggaccagaggatccgtccgatagaaactgtgcctgtaatagaacagacttcagtaagctcctctttttgcaatatgaaagcactgatatgggccagaagaacgaaattttctagttccaatacttcgaaatctataattttgccagttattggatgcatttgagaaaaaaaatacaaccatacacttgtgaataaagacatcagcagaccatacatgaataacgaaagataacatgaaacacaaagcacactatgatattctcatctccagttattatggttctgagtttctgatcaaggtgacatgcatgttgtcctaaaagtgtgtatgaggaaaggtgaggtcctctagacaactatgagaagttaaaaacaaaagaaacaaactaatataagattagatgtatgaataaaagtagaggttctggaaagaagcgatcctgaacaagtgactagtacagctaaaacttagacatataccacctcaaatccaaataaaagtcattttagtcttttactcttttcaatctctctaagtgcaagttactgtagaatttttgaggcagttttctcttttttccctccattctctttctacttgaaagctactactattatgaataaatggatcgtgtttttaatggaataaatgaagggaacaacaccattttgctacttccttagttcttgggaataaggccaaaaagacttagatttcagattggacgaagcataaggcaatggaataaggcaaggccgatggatacatatattcagttcttcatgtatgttggtataacatgagaatgagaaatctgccagaaaacctgttcaaggtgcaaatcatgtccatctagttttgcataaataacagggtatccttgttgcttagtccatgtagtcatcaaatccttaacaggttccccagattcctcctcaagaacagcccatagatcttctgttttggcattcgagtaagcatacttctttatatatgatgccaaagctttctgaaagagtaaaaaattcacaaaatcagcacctgccgaagactaataaattgtgataataaatacaaagtcaataacatgacacaatctcatagaaagacaacaatatgctaatatgggtactaaaattctaaacgttgttaccgagtattcaaaagaaatgatgtaattgtaaaattatgaatatcttttctttatttatttttcctgtaaagagactcttatcttgggtatagtaaagctggatcaatcttcatactttggtctaaaaacttatgagtatctttcatgaaaaaatcactcacaccattgtttatatatctcaactatatattctacagcctttggtaaaagttgatatgacttgttgaccgcatgcattctatgatatcaccttctttactggaaagaataaacaaaaactaaaaaagaaaaatccaaactcaagatattcttcagcagattcaccacagatttgcaaaatgaccagaaacaaagtcaaagcaaacaattacgatgccctttattatttttggtcaacaaaattttcttaatcaatctgagttaaatgcaatctggacttctgtagagccatctagcgctgagttgtttatgaagaatataaatataacatgcgtggataagagtgtcaattcaagagcgctgatatactagcagcaggagatgctggaggctggaccattgcagaaaacaagattttggtaaattcattcaaggagaaagaagaacaggatttaacctgaaaacgctctgcaccaaggtaactttgcagcatgcgaatgacggaagcgcccttatcatagcttatggaatcaaaaattgcatcaatttcagaggcatggtttatgtcaacctgaacgaacataccaaatagccagattaacaactgggacaaaggtgctaactctgtgaagacagaaatagtaaaaaatgcatggcagcatattgacatatttgagtttctacccaaaaaaaaatctaatttctaagcatcaacacctgaataaattaagcaaagatttataaaaatatcaaaaattggttgtattgtatgactagtcagtattagggatgaaaacagagcagatagttcccgtccgctccggagaaaaacgaatacggatacctttcggatcggataattcttggatagttcggatacagatacgaatacgaatatggtatcggagtttctatcggatacggataataattcagatatccgcagaagccatgaggcataccccgtttctttatctttttagattttaagagtagttcatctcttaacactagtccacactattaatattatttaaatttttaaaaatatttataaattatactacattttatataaaatgagctaattatatatgttgatatttgtttctattagaagttgagttggcttacgtgttccgagaaaaaatttgtttccgtatttgtgtccgatcatgttcgattcttattcgtattcgagataatccgtatttgtttctgtattcgagctatccgtattcgtttccgtatccagcaaaaaaatatgaaaacgaatatggtatgagcattatctgtccatatccgctctgttttcatccctagtcagtatgcatgcacaatttgtatccttgttaattcacttatcttactgctttcatgtacttccatatctgtaatgcatatttgtgcagcatcaaaatattatgtttcttatccatcagtgacttcgccaaagcatactgaagaagattacctcaataggatgagactctgcaagtgcatccagtctgagaccagaggtcgtctcatcaagaaattgtgtccagttattccattctggaaataatgcttccacagccaaataactcacctgttgaaacatatggaataattagccggtaagatacacaacaattggacaatatttctaatttctcaaacaatagttttcagattgaatacccaggaagcaaaaccctcatttagccacaagtgagtccaccactccatggttacaagattgccaaaccattgatgagccaattcatgtgcaacagtgattgcaacctaaagagaacagatgttaatttttctttctttctttcttttttaaaaatagcagtttacctggccaaaactacacatgaggattcaagtgcgagactaactctccaatagtaaatgaaacaaatgaaattgataaagataaatataggcataacctgttgtttattggatgctgaggataacagctcatcataaagtaaagctgtttctcggtaagtgaccaacccatagttctccatagctccagcagcaaaatcaggaatagcaaccatatccaacttcggtagcgggtaaggagtggcaaaataactgataaaagaacattattagttattgtagtgaaataggcaccatccatggtattctgcctcatctttagaaataaagcttagaagcaagactatgttggaagcttactctttgaataaatccagtgacttcactgcaacatctagtgcaaactttccttggttactcttgccaacttgagtatacacacgaactttggtgcctacattaaattaacaaaagccaatgaaaaaatgtgtaaagaccaggcaaagaagggacatatcatatagtttgaatgaaagagagcaaacaatggagacagaaactgaaattctaccttctaatgttgagccctctatgtaatcaaataaaccaacaactatagccactagataagttgacataagtggcgattcctcataatagacggtcttgagaggtccatgaactgtctccttaattactggcatgttggacagtgctaccaactctgatggaacttccagtgttagcttgaacttagcctaaaccagaaataaccagacaagaggtaatgttattttagataattgatccaaccttccaaattctacagagcaaggagccaaggaccatgaaaatattagttaagacctgtgtaaaaactagaagtgcaaactgaatttttctttcattacaatattttcctgtctgaattacatcaaaacactcctagggaaacaacattgtagcatgttaaacaccttaaatgcaggttcatcccagcatggaaaacatcgtcttgcatcagcagcttcgaactgtgtaactgccatatttcttgactcccccttgtactcatacttgctgcaatcaaacacggaaacaccacccacaatgcattaaaaac

SEQ ID NO: 6302 - DNA, 5852 bp, Oryza sativa
cagacaggagtaaactaagacttacaaatggtatatagcacaggaaggtactagttacatcaaattgtggcaatttcaaataaaaatggaaataaatatcccaaaaactatgtttgctatccaagccctataatattacaacatgccaaaaaaatcataatcaaaactacattattaagatggatatacatatgctaatgctctatagggcctggtgaacagtgggtgctaggctgcgagttatggatggtgttatggtagtatggagagcagcatactctaccaatagcgtatagtgtgtgttttgaagacaagatcaggatcctaggcagacacaaatggttcaataagtttaatgaagagtgtttcaggattaacaaagagtggatggtcgatcattataagataagattgtagattcaagctcacatcctaaagatcctgagatcttagtcactttctaggacattaccaaataagatatagatactatccattgtcttagcacatcaagcatggcaacaatttttgaaccggtacacctagcccttgttgttaaagttcatgtgccaatgctattgattgcttccaaacacacacttgcagtttccatcaagtcactgctcgaagcctagttactcataacaacgaatagcagcttcggacctcatctagtaggtgtgaaccccccatggttcataggtattcaagtggatacccaagatatttgaaaacaatgcgttatatcataaagcttatcttattgtactggtttaaagctttcttattatatatcatgtcgagggttcgattcctgcatcctcaattcttttttctcctctctttattaggtgttcaatttttttgtcttctgtttgttaggatttcaatagcttgtagtaattgtttgttagaatttcaatagcttgtagtaatactagtgttaggtgtcttggactcttccatacatcctatgtagtatgtaatatttttcttatttcctcaagtttcaattggtcgtctccagcacgaagaatagatattcttaagtcttcttttttaactaatattggagtaagaatttgaaccaattatacattttcagaaaagtagcctccaaaccaaaaaaattctccaaattcatgtaaatcatccaaactatggaaaactatttactcatttttaatggcatatcaaaaatgatttttcatagatatcgtgacattgttctctaaaactcgattctctatctagaaatcccacgtccgcgactaccatctaataaaccagaactgcaagctgttgctgctggaatgcctgttcgcacctcatgtgaacgagagactagcaacaatcaccagttatctgtaactgaaagaggtggcaacgatacctcctgtagaagcctctcatctgatcgttgagcgtcccggtgaagtccatcttgagcacgccctcgccgatcggcagatcctggccgaacccgatgaccacgatctcgtcctcctcgaactgcaccacctcggaaggcaccaaatcctacaaaaccccatcatacaacgattgagcgaccctgaaacgaacacacggcaacaacgcaaacagacacggatggttaacgggggaggcggtgcgcgcgtgcctggaagcggacggaggatccgtcgacggcgagctcggcggcgttgaggacgaggaatcgggtcggggcggagacggcgacggcgacggcggcggagccggagaaggcgcaggcggcgaggtcggggcggaggcggaggtcgtagctgagcggggaggcgcaccgcgggagccgcgcctggccccggaactgctccggcgaggccgccatttgcggcgggggcggtgtggcggtgcggcggtgcggcggcgggagttgcgacggcgagtgggggagtagagtagtggggaagggagggagggaagaagacgattatgcccctcgccgccggctaaaaaggaagggaactcttgttcggttgcttccgggccaggataagcaccttggggccgccacgtgtacagagcctgaataggtttagggccttttggcccggacccagagggaaccttgggcactgttttaaaagcctgagatccttaatactccgaccccgtttgatagggttttaaactctaactccagcaagagctaactcctatagaaactgaagtgggtacgagagtgtttggctagattagtcagctccactccaccacgttccttgtaggcattttgtcgaacacatggttggcatcgccttgctactgtcgtcgccgccgccacccacgcgtcgccctacacggccgcggccgctgtcgctcgcccgctgccaccactgtcaccactgcccgtgcaccaccttggccaccacaacccatgcgccaccgtggctcgcgcgcctcccgtgcaccaccatcgcccacgtgcccgctgacgccgccgccgcccgtggctctcacgcgccgcgccgtgccaccaccgcctgcggccgccgacgttgacgccgtcgtccgtcgctggctcgttgttgactgctgtagggagggaggaagatggggagagagaatgggaggagaggagatgtgaaggggtagttcagtggtatttttgtgtaaatacataaaaattttaaaggtaatggttccttttggttgagtggacctgtgaccagccaaaatccagctccacccccatagttgattttttaggagtagctctaccagctccacttccaaaaatggaggatctgggactgtttggcgcaactccggctctaggtaagttggagttgggagctggaactatgccaaacggggcctccctctgtccatattataagtcgtttgacttttttttagttagatttatttttttagttagacttatttaagtttgcaagtttaaaaataaagtaacattttcaatacaaaacaaacattatatcaaaatatattcagtgttaaatttaatgaaactaattttatattgaagatgttgaaaatgctactttatttttctattaacttggtcgtacttaaaaaagtttgattaagaaaaataaataaatgacatataatatgaaacaaagggaatagtttattttctaatttttgagctattaaatcagaatgtggataagagtttagacggtttggggaaaacgaaaactattattgatcataaaattacatggactttttctataaaattgaaaaatagtttccgattcaccaaactaattcttatctatttctgaaggaataaaaaaaatactagaattcttaatttttcaaaaattttctcattgaaacaatcaaaaattaagaataggttttgttggttaaagtcaaaaatttttcatataattttttattgcatatgctactacattttttttcatgtaagtttgagtactttttcgtattattttgtaaatataaatcaagtataaatttataaaattatttcatgtttaggatagaaaaatcaattttaagatggaactttgtttaaatatggaaattaaatgatgatagcgatgagagctgttatatttttcatcaacgaatgagaaaggtaactgaaattttacaaatgacctgaaatctaaaccctccctgcttaaatgacaatattatatcaagacaagatttttaatggtgtgtttcggtttgccgcttatcaaattattttgacagggtaataaatgaaacttgccatatagtattatccaactaggctccaaagcattgcaactgaggatccctcgagtgtgttgcatgttttctttgtagcatgagaattatgcacaaataaatatcaggacggttcacattgaccctacaagataggtttgatttagttcctaaaattcttttacccaaaaacgtcacatctaatctttgaacacatgcatggagcataaaatatagataaaaacaaaaactaattgcacaatttgcatggaaatagcgagacgaatcttttgagtctaattagtccatgattagccataagtgctacagtaatccacatgtgctaatgacggcttaattagactcaagattcgtctcgcggtttccaggcgagttatgaaattagttttttcattcgtctccgaaaacccctttcaacatctggtcaaacatccgatgtaacacccaaaaattttcttttcgcgaactaaacagggccatagctcagttcatcactcgtgaaaaaaaacatatatttatttttagtgttaaaaatgagggatgtaattaaaggagctctttcttctcaaatacgcaagagagttggcatattattgcatcggaaaaggagaaaacataatacacgacagactcaacgcatcacgaacgcaccacaaacaaaaagaaaaaagattacaccctaaactaacaataggatctttgacaccaaagatcaaagatggcttcttcttgatccaccagttaccaagcacaacatcaattatttttttatgggaattactgttatgtatttgtccaacagtatggcatttattaaaaaaatatttacatcatacaaaaggacatgaaaaccgtagaaaaaaattacaaagattgtaatcaatcaagaacattgaatcaccaaccaaagaaagaaatcaaagcattgactgagcccttgactacaatgtagtaacttctacatttgttagagttgattcttttaactctctcgttttaattcaacctgtaacagtctctcactcatgtactcttaatttggatgtaaaggaggtacacaacttaattctttaaaaattaatattgattaccaccaagtttaaccccctatagcatcaatgcagtagctttgttagagttaattcttgtaactctcttgttttaattcaccctgtaaatagtctctcatgtatggctatatatattttaaagtttgcatgcaattgacagtaagaattatctcattccatctctcgctctcccagttctttatactttttcatgcctggtatcttatgaatcatatataggttgttatcattataagacaattttcattaatggaatagatagccaggtaggttttcttgctagctagtagtactacagaaggaaaaataaaatgatgctattcttagctgaatgagactttcactcttatcctcacaacagcatgcccaaatccatacactatcctaattatagagctcaattttagtttgtatatatccatagaactcaattttagtttgtatatatccgtactacttgaaattggttttgttgtccacaagagtcaaggctcacagaaatctcaccacagataatcttgttagtttcttgagaaaggcaagctagctaagctcccattccctctgcatttgaatctttgatttgagaagcttcatatctccatttcatgaaaacatgactggtgtgttaattccaagctaatattgtgaacattgcatcatgttctctgtcaatgcagatggaagctgcagatgtagccaaggaacatcacaaggaggagaaaaaggacaaggtaaacattcttctggttttttgaaaaaaaaatttgttgacaggataagacttattctcactcatgattgtgtgagaatcataagaaatgacagtcgaactaggagagttctcacaataatacaagataataaatactagtcttcaaaaccaaaaagaaaggtgatactatatttgatgcttacaacaagaaattctcaaacaatcacactttagtcacacaaccatgtaacattgctcaccaaactctgacgaacatctgcactcctttttgcatggcaattata

SEQ ID NO: 6303 - DNA, 2929 bp, Oryza sativa
gctgaggaggaggtgatctgggattcttaggcagttcttgcaattggacaagaggagaaattacaaacattttcagacatttgcaggatttgcagctagtgacgatctgtttctgaatggaagctttggtacagaaatttttgccttcttacgatgatgatggtctcaagtcgtctttgctgaagaccatggcgccattgagtgttgcttgtatgatatgatcaggaagtgaaatttatagcgcaaatgagtttcatttgcaagatggtgttggagattatgtatgtgtcacgataattttacgacaagatcgattcaaattttctaaaagaatcaattactacagaaatgtgctcctatacctaatttctctcgaaatttatatcattgtttctgcatgtcctgtaaacaattactagcagagtaccagtagagctgaagaagtgaagaaatgcttttttttccctcttgagttcgtgccatccgttgaaaaacaaacaggaaaaggcgaataatcttaagcacagtttcacgattttcaatgcagaaatcccagattcccatctccaaacctccgagcattactaacaatccaccaataatctatcccttaaactgaaaatagaaggtgaaaaaaccgcttcctccaagagatacctaaattgaatctcaaaaactaaaagtgggctcttctgttaaactaccaacataaattgttaaccttagttttttttagaaattgttaaactaccaatagaaatcgtttttttagaaattcgagtggaaggaggggattgggagtcgttctctcgccctcaaatacacgtaccgagaaaattggagatgggaactccaaaacgtccagagctcttttgggaatctgttggaccagttttttttaaccaaaatcccaaaaaattaggattgaggatggaatagatagactgttggtgatgctctaaggcactgcactggcagagaaaaaaagtatggtactccctccgtttgaaatacttaggccaaaggaaattcataaaaaatttaaaggattttattcttatagaaaatttttctatatatccctttgaatcaaaagaataaatcctataaaaccatatgaaatttctatgaaatgtctcttcccagacaagttttagagaaaatttaacataaggtagaacctcatggaaagaatatttctccttaaattctggtgtttttcctgtgacttaatcaaatggtcattcctatcttctactgtgttttacaatcctctgttcctatcttctactgtgttttacaatcctctgttttacacttacattcttgttagaatcatatgttttttttctattcctccgttttttcattcatgtaatttaaaggggcccttttagttgtagatttgttctgtcttaaccatcaacttttaaaaatttgtatagattaacaacatgtgaattatattttatgaaagcatttttcatagtaaataaaaaacataaaccttatgatgttaaacgaatttttaaaaattaatggtcaaagctacaaaaaagtataacttaggacaaagcagcaagaacgacaggtaatctcaaaacggagggagtatttgatatttctccacaagcagtattaaactctagcattctggaaatcatcatgacatcacataataagatgggacattacttaaggtcactaacatcaacatgcaaataattccaaacagcccggtaacacttaggaattatttacagaaacatgcaattcaagaagtatattgacactcgtctagggaaataacctcaggaattactatgaacaaacggtactgaagcacgcgtgcatgtgatacttacaatagaacttcttttgcctaagtttttatctcacaaaatatcgaatacgtagataaggtattactgcagactttcgtaatgcccaagaaatccagaacatccattccctgccatcctcttagatcaatttggcctggagctgaccatctcttatctgcgcagcgatatctttgacggcacctggcccgtgagggatgaacactgaagaggacttggatgaggctcctatctccttcatggtgtcgaagtattgcgtaaccagaaccatatccatgacatccttggcagaggtcccaggcacgttctcggagaaggcaagaacactgtctctcagcccatccactatagcctgacgctgccttgcgatacccagaccagccaagtacttggattctgcatctccttcagctctcttgatctgaagaatcttctctgcttcagctttctcattggctgccaccctcagcctagcagctgtatcatcaaataacagcagttaaaactatgttgccgtccagcacatttacagccatacagctcatctttagaaaaacaccagaccaaccaaacatatatgttgcaggcccttaaaaagcacgaaatatttacttgactagttgaccaacacattttttgttgcacacaatgtaatcaataggttgcagttacatgtgcctgtgttacttatgactgttatggtgcaagtattcacgaagttaatattcataatatgttatgtacatctatatataacttttcagtgttccatctatatataacttacagtgttactgtgttgaaagcctaaaaatatttgtggcaacaattttcagtgtttcagtataaaacttgaataaaactagacaatataaacatggttttgtttctcggaaagagaatttaacattttcatgtctaaacaggagaaaattgtttccaatgcaagctcaaatgtcaagcataaacaccaagccaaataatgtctctgaagaaatggaatgaattgatgttttaattaatacttacctgcgttgatttcattcattgctctcttaacatgctca

SEQ ID NO: 6304 - DNA, 4822 bp, Oryza sativa
tacattgacattgcctacagagtatatactaggtcagtataaaactccactatgctctagatgaccaccaattattgaacacaaaccttttcaagctcatcttccacagcttttgcgatctcattcttctgctcaaatgcatcatccaagttcatctttggaacactagccctgatcactgcgaggaagaaagttctgttagcattgaacaatagaggcaaaacatagagaaggtaatcagaagagtatgaactgcaaatgcatcggatgcatgaatgttcacagcatacaggaaccttaccatcaaaaacatacgactggatttgctccctggtgttgctaagcctgtaaaaggcgtctgatgccttctcagcaagagcacggtattgcacagatgccacaacattgacaaaaacattgtcctgcagatatccacaaaatggtatacatcgtcagagagctcagaaaaggtgggtttattctttgatgcatcatgcattagtgtaagtgaagaataaggaaaacagagatatgtgcacataaccatcatcagtatgttatcataaaggagtaaacgaatggaacaaaatgcaagaattttgagaaccattttttatcatgcctgacaattgctccagacacttgccatgaaatataaaagaaaccagagttaagaaaataaactggggaaccctagtctttgtttcacaacggacatccagctgctgcacacgcaaggaaagatatccagcgatctgcttccctatgcaccagggtaaaaagtggcatccaggctcaagaacctcatcaaacttcccaaaggactccttgatggctactgtcgattgatctacttgtaccaaaccgagtgcttgacccatggcttatctagaaaggaagaaatgcagaattacaaatggtgccatatgctaacgaaacaactaacaactgaatgttttgccataatcttgcttatactccgttggtgttaacttctccaatggaaattcatatttcaagtttttagtacatacaaacagaaacaaaagatatgaattaaaaaagataaagccatggcttcaaatgaagatgaatgtatgtcaggacaatagattgcccaacgcatcccaaatgaaaagtcaagcaattgcaatttcagataacttagaccaaacagtgttgcaaaaaatatgtatatcttgttgaaaagcatatcatgataacacattactcaaacttatactgtgtaatcattccctgaaaaatgcctaagattactactccctccgggctgataatacttgtcgttttggacaagggtgaggtcaaactttagaatatttgattatataaatcatttttaaaatatttgtctttcaaatatggtgactacatatatagattggtcttaaaaagtactttaatatgatcatatatttgttaacacttttttacatattataataggaaataatggtcaaagttgttttttgaagaccgtgcgcttgtccaaaatgacaagtattatcagcccggagggagtacatcacaggctcacagaagtcaacagggtaatagatgtagccatacaaaagaaaagaaaacaattcaccatagaaatgcagtaatgaaaaagaatgacgcaaaagaaaacctatacgtgccgatcaacttagtgctgatagcctgataggataaatctgcttcaggatgttcttggccactacagactacagacaagccaaatatatcatataaatagttgaagctaaagattatgctaatcctgattatacttgggggaatgattatacttttgattaaatgccagcgcaagccagcaaactctggcgatgcaagccaaagggcagacgaatcaaacaagacacttgccaagcaatcattgtttgataaaagtcaagagcaagaacccacagggctccacacgacgaggtgacaactaagaaagtcacaatctttagcgagtagtattcatctgcgtcataactaaacaagaataaacaatacagccacttggatactgttgttgagaattattattatttttagctgaggtgggtacagttcgacgttaacctccatctcatggcctagtctagcaaaaaagatgtgcttgacttgactgaaaaaacctcctgaaatttccaagcagtatgtggacaaagctggaacagcacaccatcgaattttacccccactcgcaaagcgcaagccctaaatctgtccgcacagaaagtggaaaaaaccaagaactcaaaccgcgtccaagaaccaaccgcaattcccaggctaaactcaaggaaaaggaccggagaatcgacgaaattacccaccacccgattccaacatccccctccccctcccccctccgacgaaattatccgcccaatctcctccacgagagctaaatccgtccccaaaataataaaaaaaagaaaaaatctagaggaaaccccaagaaacaaacgctcgccaagaaattccaagaaatcgaggtcggggctcgggctgggcgcccgccgaaggggagagaggctggagaggagcggggtagggcttacctcgaggaaatctccggcggcggcggcggatgggacgggatcgtcggagtggcgacggttgcctcggcccctcccaaaaaaaaaaataaaggaaggggattgaagtatataagtgaggagggcaaattctgaaaatcgtgggggcttccgccgctgcttatcaagtataaaccgtccctgtttctttgtgcctatccgcaagcatgccaaaattaatactccctccatccaaaacgagaactgcttctaatattaatactaatgtgacatatcagttttatgttgatatttattcgacggatggagtacgtcacaaataaaaaagctaaaattacacctctatccatatgattagtcatcaaagcattttctcgataaccagaacaaatacttcatctataaaaatacttaatctagtattctagtacaacgtatttgaacatactatattgttttttttttttgataaaaatgagtatacgctagatgacacattcgcaggtgtgctcataagcatttgtatttgctcggaaaaaaataacttcctttattattctaaaatataagtatcggtagagttttgatatttataccgtaatatattttttaaaatatatattctaatgaatggaaatctatatatttcccgtcactaagatgttaggaaagaatttaacgactaaaataactataaaagagaatattttctctctacctttcgtttcgctaaagaaactaaaaacgcttaaagtttgaaacgggtgatgtattaggtaaagtcgtcaatctatacaatcgtagtatcttccaatgccaatctacatactatagtcaacaatcatgcggataagacgagtttagtgccaaaaggaagttgcgggtcagagggcaccggatcacagagaaaattaattggactgctagtggataggagttgctgactagggggtgtttagatacacggcggtaaagttttagaatgtcacatcgtatattatatatggtatcgtatggagtgttcagacactaataaaaaaactaactgtagaatccgtcagtaaaccgcgagacaaatttattaagcctaattaatccatcattagcaaatgtttactgtagcaccgtattgtcaaatcatggagcaattatacttaaaagatttgtctcgcaaattagtcgcaatatgtgcaattagttattttttagcctatatttaatactttatataggtgttaaacgttcgatgtgacagggtgaaaaattttggggcggaatctaaacaggacctaaagacgtttcctaattcttactccctccgtccctaaaaagacaaccagctctcctaatataacgaatctagacaaccctctgtccagattcgtggtactaaaagagggtcacatcccctcctatgttgctttttttgggacagagggagtatgcactatcctccagggcaatctgcacttattgctagtagatataagcggagtttttattaaaagaatatccttgtctgttacagtgaaacagcatcggactcaccacgcgtcgtcctcgtgcaggctgcgggcggcttgagagccctctcatctctcctcttctccacctcaccgttgtcggagcacactgcctagagaacctagcggtgagtcatgatggtggcgacgaggctaaaccaaccccgatacgcttcacctcttgtgcgggtgaggcggtgtggagcttggcaagccaggagaggctacagtggtgaaccattagtatggggttgctgatacaacatcatcacgactgatctgatggggtgtccctagtccatcatctccacgtcaaatatgactagggtcaaacggcgggggcaatgggaggctggcgtggtcaggccaacgacaattaatggatggccgacctcgccggtggcgacaatagtgggaggcagtgctgggcagccggcatggcaggtgggcgtgacaactagtgcactcggtggttggtgtggatgacaacacttgtgatgatggcatgtttgttatgttttttttaaccttactgtgttgtaatgttgtaatttttgttatgctatatcaaaataaaactttgcactatatcaaataaaactttgcaatatctaatgtggatcattttaaaaaccttgatctcaaatatttcattatccatcgttaaattcaacttggccactaacgatgactttttatacggttagactactatgattg

SEQ ID NO: 6305 - DNA, 16343 bp, Oryza sativa
  unsure (1)..(16343): unsure at all n locations
tcaaattattatcttcacatcatttccagattatttaaagatatacatttaccatttctataatgtataacatgtattcactacatatctcgtaacaaagcgcatggtatcaactagtaatattaatgttagcatgcaacacgctttaataataaaacatcttttcagatatttaaatttgtttgtgaacagatcgtgatcaaaatagaaatagtatcaagcaattatttagatgagtaaatttcacaaaacttctcctaataaaattcacaaaactatatatatatatatatatatatatatatatatatatatatatatatatatatattgatcaaactatcataaaactacatatttaatgcattgtatcacaaaacaacaaatttagcgtaaaatttatcaaaaaaaactacagatttaaagccaagtatcacataactatatatttaatatcgaagttatcacagaactacagaatttagaggtcaaatccttagcactatcaatatgtttgagctataaacgttgcagttttatgattaaataaacactaaacctttagttttatgataaatttgctacttaatctatagttttgtgataaacttaacactaaacttgtagtttttttatataacatcttaaatctatagttttgcaatagtttgatgaaaatatttgtagttttataaaatttactctatttatatcaaagtgcaaatagtatcaagcaagtatttatgaatggagggagtatgaattactctgtttttctctattttgaccttgatgagatgtggagtgaagttaactagttcggaggtatggatggtttactacataattaattatgtattagctaaaaaacataaaaaatacattagtatgattttctaaagcaacttttctatagaaaatttttaaaaaacacgtgcgcgcaaaaaataaaggagtagaagttggtaactcggaaaaaagaacatagcctagggctagttcgtttcctcggtttggagggagatttccagagcacaccaaacaagaaatattattagcatatgattaattaagtactcatttcatcttattatatagaggattataccttttttaaaattaataaagtagcaaaaggacatgtgataggaaaaaaaatgatgggtgaaaaaagtactcatttcgtccctaaatataaggtattttggttggatgtgacacattctaaagcctatctagattcgttgtactaagataagtccatccaaccaaaacatcttatatttagggacagagggagtagtacaaaaggtagatgagagaatatattttttcaatagtgtatagtgatggaatatcccagtccaaaagttggtaggttgagattacaattccagcttaggatccccagatctcttatattttgcaacaaagaattgcaggaacagccatcttatgttatgggatggaggagtattaaatattctatacatgagtaatcaccttatttgacttctaaataactnttatatacaatgtttttccctgcatagatttgatattttgaggagtgtcatatataggacgagatatttgagtttagagttaaaagaaaataacaaattgttaattaaagtcaatataacaacatattgttattatattgtctaatattattataccctcttgcacgtatggatattttcatatagtaacttaggagttaataatgtcttatgatataaaatgaaatggaggtaataacttatcataattataaattgaagtgagtagcggataaatgctactgcccccaaaaccaattaattactcttcatagttcatgctttactagaaacagaaagtcagttttgtaaaatttgcaaatgtcaccctaggaaacacgagaatttaccatccacccccaccaatccatcgcccatccgctggctaagctacgcccactcgatcgccgctaaattagctaaaaagctacttaaagcaagctcacgagaggacgtgggcggcggcgcgcgcgtccatggcgacccggacgaacacgtcctccagcgtcgcgtccgccaccccccacgccaccaccggcgccgcccgccgcgccgcctccaccgcgcccagcacgccgtccagccgcgcccctcgccggggcacctcgaaccgctgcgtcccgcccacgccgtacaccttcgccgcgccggggcaccgccgcgccaccgcgcgttccaccgcctcctcgtgccccgccgccgtcgttatcgtcagcgcccgcacgccgccgtacctcgccttcagctgcaacatcaatcaatcaatcaatccatcaatcaatcaatcaatgcacttattactgaatagccggcaaaaaaaattcaaactttcagatgaattaattctgcatttgctttttttaactgagtttttgaggtgtttaaatttgattacctcctttggagttccgaggcactggaaattgccgtcgacgaagatgccgacgcggtcgcagagctcctcagcctcctccatggaatgtgctgaaatgttcagtgttcatgtatataaattcagttctagttgctaaattagtcacaaatattgcagtttgcatgtatagctggaaagaaaaaaattaaccaagaggaggagtaattaattactggtgagaatgatggtgcagttcttctttgctctcttaatgacattccagagattgctcctcgatgtcgtgtccaatccggtgctcggttcgtccatgtaaacaacctgttcaacatcaatggaatcaatgagagatagttacagcagaagttttttcagagatgtgagtggaagggaatgaagaacagttcatggtaaatttactacctttgggttgccaatcagtgcgatggcgacactaagccttcttttcatgccaccactgtacttgttcaccgatttgtcgccgaaaccgctgtggaacagatttacactcttcagggattcattcactgcctggatcaagaaaagtaaaatctgatgatcaaatactagaattgtttccaatgtcatgtgtagtactacaaatggagtgaacatttgcaattttacttgtaagaagtatagtaggagtatgagatttgaaactcgcagtttgactgtataaagctagtgctgtaattttacatgttctttccttttttcatggcttcaattaaactaccttcagtagagcagcacctgtgagattcttcagtcggccatagaacattagatgctctcttcctgtcagagtttcccaaagcaaactgcacacacattgaacaatttcttttttgttggcaatgatatcactaacaaaaccatcttcagaagaaatgcaaaagaactagccacttgagatcatactcgtgctgtggacatacaccaatgtttgcatatatttcattcatatctctcctcaaatccatcccatgtatgtaggcagttccataagttggcgccacaagtccaatcatctgcaaatataaattggtccaaaaggtgtatttgttaggttttttcatgttatttcactactaggaaaaatggataaatttaagtactacttgattcatgtgaaaaatgagagctactttgaagtgttgatgaagcagatataaatgctattttgacaaaacatcataagaagcacaagaatattgtgaaatattcaccatgttgatgaaggatgttttccctgccccattgggaccaagcattccaaaacactgtcctttgcgcaaagcaagcgacaatcctttaacagcaagcttatcagggtttccattctttccagggtacaccttcttcaggttatggcatatgatcatattcctcatgtccatttccttcagcaattttttcaccaccttgcgctgaaaagtagaattttgaacaacaatttatgacagtatccttgttgcatattatagttctgcattacttcattatacttctatcttggaaaacgccatctattaacttctatagacgtgtatttaatcacacctattgcagataaaaaaaaagaagcacgccaattcagatggattgagatcctctaccttcgaaatcaccatgcctttgtcccacatgtcagtgacaaagtcacatgactttgaaggtaggtgatcctgatcctattcggatgtatgcttaactaacctcaaggaaaacatcaggttttgccatatcagcaaacacctttctggacctctgtttcactttgtctggtatgattgttggtgaagagtgctttgttgacataaacccaaagaggaacagtggatgccatgtaggtctatgatccagtaaaaatgccacaggaagcagaagtatccattctatagacattagaagcaaaacatctttcatcccattgatggggtcattcaagtccctccattgcatcccaggctttcccatttgccttcctgcaaatgcatactctgcgagctcgtaaaatcctcggtagagggcgaacccgggaacaagctccattgtcacaagccattgttctaataaacaggtagaatggtagtttttaatgagtatccaataaatattcagaataattcctgggaaaaaaatttatatgggaacaattgcagaagtgcttatacttacttgggaatgtaatatcttcaatgaacaattgcagaagtgcttctccaagaaggcttgatccaaagacataaatgtaactaattactgtaacacagaaaatatttgattctgaggtcacttgaagagctatagaatgaacagaacagaaggtttgaattttactaaccactagcagacttgacagacgagaagaaagacgcaagcagaaaggcgagcacgatctgaaggttgatatatagaaaatagaatacaaattgtatgctgtagctatttaatctgaagatatctagccctgtaataccaaaaaggttctctcagtgatttcgaagattactcgaatgtgctaaattctcaatttccatactctgtagttaactagcacagtacctataagggacccaaacatcacgaagaacatcatataagctgctgaaagggacaaaaaataggcgtaagatatcatccaataaggtccatcctttagcccatgcatcttcatcatcagtcttaaattgtgctgcttctcataaacaagatatgtcaacattacctgaaaaaaccattgaaataaattggtaaataacttatgtatgaatccaagatagctttgataagagattgattgtgggacgcgataaagttaactcactggaaggaggagttgaactgtccatgtaaagaatagtgcatcaaggagtgtggtaaggtctagcctgattttcattgcagcttttggcatttctttcaaatattccaggcgcatttctacattaggtcctcgaagaaacttcagatatgcggtggatgcctgatgaaaatgcataacagtagtgataatactaagttatttaggacctataacagatgaactcatttttaggaaaggactctgaaaaaaaatggcacatatatccatctgggcaacaaaaacaacacaaatgacaagaaccatgaagtgttgttgtagaagatgtgctgtttttgctacagtagccttgttttgatggaacagtacaggagtgcaccatgccttttatgtagcacttccatttctagttcttaccatatattttttgaatgcgggtatccccattttccattaagcgaaatggtaaaaatcatgttttccggttcttactatataatgattgatatttctttagttcagataaatgccctttaatattcaatggagtattcctctacctaaaagtgaaactgtaccacaacaggcaagttaagtaccatattaaccaaccgtgcaacacgcaaaactgtcatgggatggtgtccattgtccctgctgaaggtagagttgtatgagacatacacatgaaacctcctcttgcttgtatcaagaaaatcatagcctgcaaaaatggaccttaaaataagttagttgttcaacccgccaaaaaaaaactgaactgctactttagtagcacagttgcaaggaaaactaaattaaagtaccagcaagatattcgttcgatgtcctcctcttattcccacccttataacccttatacaaatggtcattcatcaccgctgaattccggcaccacagtgataaaccttgaacgcacttcacatctattacaattaaaataaaaaggagtgcacaaatgcacaagtaattcagggttgaaaacatttcatgctagttgctacgacttcatacaagcaagaaacaaacaatcttttaccgagttgaattggcatcgcatcagaacttctagaagtattgtgcgaatcccatatacattttctttgaatcacatatagggtactattgggcacaaatcctggtctatgaacaatacatgcgctggtaatgtgcttgtaccctggaagaaaaatattcggtatcacctttccatcacaaatcagagttaaaaaagtatcgaatcttttgtgtaaaacgccactgatcactcaaaatttcaaatattcaactcacagggactatttttgataactcatcaatataagatgaattgttggaattgggcacaccaagatagtatgaaggagggacatctgggaaaaatccccttccaaggcctggcaaaaaaaaaaagttccattcacaacaacaaaagcaaaagcaaaagttgtagcaaaacacgtgtgatgtgtgtgcgtagtggtgtttgtaaggaaaatgatcctctggcttaactgcatgtgtaattgagccactgacatgtgagctatagtaaagtgagactcacatgttagtgacttaactgtcagaggatctgcttcctacgtgtgaaatttgacattatgccattgtcacaagtgggtttcgcccaaataccattctccaaaagggattcgataaaatgccattatcaactcatgcctactcgctagaatactatttgggaccaaattacccctccactcctcttcttcatccatccacagctccattccctctccatcaaggatagtggcagcggcccggcgagctatggccatcgcctcctcctcctcctccctctccaccggggatagcggcggtgccccggtggtctccggccatcgccacctccaccttctcctccctctccactagggataccggcggcgcctcggcgggcttcggccatcgccgcctcctccctctacaccggggacaatggcgccacctaggcaagctctggctatcgcggcagggagttgagtgcgacccctctcttctcgtcactacgcatgagcggctcgtgaaggatggcctacatcaagcattgcctcgaccaggttcgccatcgactccagtgtaggtcaccttgtcgtgcacaccgagtgccgatgacgtggcctctgctttcttgctaatggttagtgccctatctcgctgactttgggcctcaccgactctacctctccctctagttgttggcccaccggcatttggtcccatcgccgatctgctctcctctcctctctcttgtcatgtaaggggaaatgtttggactagctgagaggggggagaagagtggagggtaatttggtcccatataatattctagcgtgtaaccgtatattgatagtggcattttatcgaatctctttttgacagcggcatttgggtgaaacccacttatgacaatggcataatgtcagattattcgtgtatgggtgcgtctttcatacaataaagaaaaacaaatttaaaaaatcgaaagaaaaaatgcagaggagctacatgaacaacataaaaatatactacatttgctggtttgcatgcaccttcagtcagccggcggttctggccggtggtgagcacggcgaccgggcacggcgcctccgacgcgccgctgccaccgtcgccgcgacacctcgccgggtgcacgggcgtcagcgcgcggtacggctcgtccggcacctgcgtcaccgccggccacctcggtggcgccggcacggcgcagctgagcgcctgcgtggccgtggagtgctgcacgccgcactccgtcgccgcgcacgcgcccgcgcccgcgcggccgccgtcgcggcgcacgcaggcgcagccgcaccggaacggcggccggtccagctcgccgtcgatgacggcctggatcgtgacgagcagcacgcacagcagcgccgggaacgccgcgatcgccgcgttcgccttggcgttcctcctctgccatcccaagaacacgaaaaaaattcagcaagctcttgataacatattaacatctcagaaccaaacattatcttcatccaagaacaagtttgaaatcgatttcaagaaccggattcgtggatggatgaaacagcatttgcatcaccatcacctacctggaaagagaggttcttgaggaggagcgcgtggacctgcctgaagaacctggagcaagaacctgccgccgccattggagcaagcttctccgagctctgacagatcaaactcgacgcaacaacaacgatcgatcgatcagcaagctcgcatatatagcaaattagcaacggtttgcagatttgcagtgttgactcaactcaaaccgaccagctgatcaccacggcgcggcgccgtgagaatcacgcgtcggttgccgccggggcatcaggcgccggacagggagagatcagcggaggattgcagatgaagcttcactccttccatggcagcaggcaggagcactctgatctcactccaagaaaagctgcgtcatcgtcccttaactatggcgggtgttacgcttgcattttaattgtttaactcaagcttcgcagtaactgaagttttgcttcatcagttacatgaggagagcagagagattgacaatggcatggctgcattgggatttgatccatgtgtctagcaaggagtgacatatatatgtatattaaatatatactatatagttaattagtgactggtcctaaattcttcagagtttagagcattgtcacagtgcagaagtcccttctatgaattcagtttactagccacctttcttgttttggagttcagtttgggacttgggagttatctgaactcatggtagctagtagctgagacatcaagaagagagggacagggattgatggaataagacaagccttgtgttcatcgcttctaaaacggtactaccaaatggactaaatcttgtggttgcagtaacttcccatgactcatctttcaaggaatttagattatcatcagttcatgcttccatttttttttatccccttgttattctattttccctctgatgctctgttacgcaagagttttcgttggtacgaagactgatgctctccatctccacattgatctcattggaagaaagaaagaatggtattaaatgatattagcagagataggtttaggttcttgagtactactcaccttgggttcgtcagtaatgtgatagcttcatgtgaacgaaaggtatcaccgtatcagtactgtagagtgataaaatcatccttggtgccggcaaattcaaagatggatcaaaggaaagcacagttaccaacataagcaaattgacagtatcttagtttagaagttagagcaacctcccttcgattccagcaaattgacttttgtttacagcatgacatactaagcaaaacagttgacagatgtctgaggactcttatatctcctccgtttcaaattacttgacgttctagatttgtcctaggtcaaacatcaatttctctaaacttatatagtttaacatcataagatttatattttaatatatccatcacaagaaataatttcatgatatataattcgcatattgttaaactatatagatttatagaaattaatgctcaaaaatagaaatatttgatttaggacaaatctaaaatgacaattaatttgaaacgaagggaatatatatatgagagtgatatgacttgtacttgttccatgtgaatatagattttagatcttacagccaaaaatctaatgatgcattctaagataatatatgttgtgtgacttctgtaagtcctggactattagaaattcaaagagagcagatgactgtagatgctttcctccaaggactcttaaaaacaaaatcttcaggttcttattttttaacaccaagataattatttgactaatgacaatagtttattcttgtggttggaaccagcgcactaaacaaaaacacttcatgtggtagctgcacaagattacagcatctgaaatccccaatcaaataaattattcagatagatcagtacccaatgctattttgcttgcaatttcagttacggccaccctataattactggtcaaaattcaaaagattgacaaaataacaagaccttattcagaggcacaacatctcagtatgagaagaggtttgaatccattatctatcctattccaaataaaataatactctagtttttttttaaaaaaaaattccgatgctcccacaatgaaatgatcattggtaactatagcagtataaaatcagaataagtggtctctttagttctcagaagctattaatgtattgttcaggatgtcattgaaggataatgaatcaaagaaagatacaagtagggactaggtaatgtgctttcttaacattgttttcaacattttactaaataaaataaaatcgcatatagctttctgtttgcgggaaaaaaacccgatatagttttaaatatgcacattctgctcagctggttttagtcaaaatcaactaccactaaggccatgttcggttaatccccaagagggagggattggaggggatttattgcacacctattgtgatgtggaattattccccctcaaatccctcaaatccccttcaaccccctctaaacccaaaaaggcctaattggtgttatacattacaatatgaattccatggttgctaaatatacaactttaccatactacatgaacaactcaatcacaatgccaagtaaaggttagcatatagttcaaacaaactatatacaacacatgatcctatgaaggaaaaaaaataaccacctatcgatccataatattatttacgcgatcacattgactccttgtgctcctttggcaaccttgatgaagacatcctccaaggtggtgtcgacgaggccccaagcgtgtatgctgaactgtctttttgccttctcaactgcatggaaaacgtctgctatcttcacctcctgttttggcagctcaaatttctgcgtccctgatatgtgatatatcctgtttgcacttggtgacaaatgctgaaccagctgtttgacctcctgttcatgttctgaagatgttgtcatagtgaacacatatgtgccaccatatctagctttcagctgccaaaacagaatgcaatccaaatattcagatattaacaaatgtttataataggcatgttacattaagtgtatttatttgtttttgcaggtaactatgtaaattacctcctttggattcccaaggcattgaaaaccaccatctacaaaaataccgagtctatcacatagcacctctgcctcttccattgaatgtgctgaaaaaaaacatactggattatccactattattgttcatataggcaatttaaagaaggtcaggaaagctcattacttgtaagaatgatagcacgatttttctttgcctccttcacaacattccacaagttatttcttgatgctggatctagtccagtgctaggctcatccatgaaaacaacctaaaagaactttttcagttgcacattccattgattatgtgcagttgaaaatcaacacacataaatcatattagtaccttggggtccccaatcaatgagattgcgacactaagccttcgtttcatgccaccactgtacttccccacttgcttatttccaacaccaccgtgaaacaggttaacattcttcagggagtcatcaactgcctgatagtatgctatttgtcagttcaaatattgatatattcatgtgtaatattggaattgttaccacaagacaaaattaacacaccaatttacagtgaaggaaaataaagagatgagtgtgaagataactataccttctctaattcagcgcctttaagattctttaatctcccataaaacaatagatgctcttttccagtcaatgtttcccaaagtaggctgtattttaagcagcattagcaaccacaatatattttgcaatggattaccataaaaatggtactaaataaattagttttagagcaagaatcatactcgtgttgtgggcatacacccatatttgtgtagatgctatccatatcagtgtttatgtccatcccatggactaatgctgtgccagatgtgggtggaatgagcccaatcatctatggaggaaaaaacatggaaagtatatgccaagtaaggatcgtgcaacattgtctattttttttgtcagaattgaagagctacttgttgccactgtaccatgctgataaatgatgttttcccagctccattcgggccaagcataccaaaacattggcctttagggagggcaagagacaaccctcgaactgcaagtttgtccgggtttccatcctttccatggtaaaccttcttcaggttgtcgcatatgattgcttggcttgcatttggttccagcagaagttgctcgactacctctctctggatacaatttagcaaaatcaggaatgaaacatttatgcaatttgagaatatgcaacaacacgatttcaacatatatacaaaatcaggattaacttacttcttgggaaacatcagggttgtccatttcaacaactactttagacccttgtctcccaaagctcctccgcagtgatacagcacgatttttgaaacgtttcaagaagaacatgggtgttttacgggctccactacccaatgatgagattttatccaaataaaatgctaatgggagtagaatagcccattcgacaaccatgataatcaagacattgcgcattccattctcagagtccctcagattagtccactccataccatttgttcccattgcatttccagagaatgcatattgaccaagctcatataaccctcggtacagcgaaaatccagggatgatttccatgactactatccaaccctctttgaatggagaaaacaatgctcgtcatgcataagatataaaaaacaatagctaaaataaatagaaaagaaacctactcggaaaactagtagactccacaaaaaacctcagaagaaatgcccctagtaagccagaaccaaatacatatatataaccaaccactgcagcacagaaatttctcaaattagtcatccacgagtcttctttggaagttgagcatttgaatcacaaacctgtggctgtttttacagaagaaaagaaggccgcaacgaaaaatgcaagtgcgatctgaagatttatgtagatgaagtagaaaacaaactgaatgccgtagttatttgttttaaagaaatttaaacctgtaaggaagaaagttaattttgtaagcatgataaatttatttgcaaaaatacaatggattgaagaaatttccagttgattacctatcaaggatccaaataccacaaacactatcatatagacagctgatagagcaaagaagtaagaatatgatatcatccagtaaggctcatccttcaagccgtgcatcttcatcataattttcagcttctgttgcttctcgtacacgagatatgttaagataacctgggaacaaaatgaagtaccaactaatttgatgtcctctgcaacttatgtaagagttaagaaaggttgcatctcatactcactggaaaaagtagttcaatgatccaggtgaagaacagagcaccaagaagagaagagagatcaaattttggtttggttcctacttttggcatatctttaacgtattcaagcagcatctccactccacttcctttaagaaatttcatgtatgcattggatgcctataggaaagatggaatgagttgtattagtagttgtagtgcatatgaaaattgttagacttgaggtagtggaagttcagtgtacgtaccgtgttaaccaagcgtggaactcgtagcaatgagatgacgtcatatgcagtgttgttgttatatgtagagttgtaccaaatgtttatttcaagaccattgttgtttgtgttcagaaaatcatagcctttggaaaaaaagcaaacttagacataaggtaaggaaccattacatcaatagtggcagacacttttctctgaggggatcagaagatgaaatcacctgcaataaattcatttgtctttcctcctccacctcctccaccttgctgtctataacctctaaatagttcattattaatttgtgatgcactttcacgccataatgataagccttgaacgcagtctatatctggacattgcgaaatgcatatcagatttggacattttcacaggtgtaggaaacatatatgaaagattgaagggacattgacagactttagtcttactgttgaagtataacactggaattcaacatcaacagaacattgctaatcaaacatatttaaatctagatttttatagtcaaatgatgttatagaactttatgccaatatggctttggtgtcttatttaataatgcctcccccagtcccaaatacatgttgtcttgaacatatacacagtttctaaaatgcatctttgaccgctgatttctgttgcaatatatttataaaacgcgatagacctataatattacaaaagagcatttcaaaacgacttgtatttcttactggagggtataactgacaaataacgcggtacgactactactctttttaccaggcattaagtctgactattgataatgacgaggaatactgtgcaattccaggtccgagaatataactgtgaccagtgctgaggtagtaattccaaatggcaatgatttttttataatattatcataattacctacttattcggtataccatatgcctttacttcctagtacatattaaattaaataagttaggcctagcaagttaccctgttttcgctacctgcttccttcaaacaaagatgcagctgaacgaaaaactgtgaaaagaaaagcaacttactgagttgaatgggtacaggtccagctttgttagaaattgttcgtgataaattggacgaacactgaggctggaccacatataaagaatgccctggggtaaataccggctctatgaactgcgttgtccatgtccatgtgtctgacccctaagacaaataaatccaatcaagagctccacacattagagaacatggcaaccatgactaatgactgtacaagcaattctgccattaggcacgaataaactcacagcaacaatcttggagaacgcgtcaagataatccgtgaaattcagagagggaggcacagcagggaacaatccaccccaaagacctgccaacagtaaagcatcaatgaattaatgaacacttttgatccaaagattgaacaacaaatcagatgtttttttccccttctagtatgtcttcgaactaagaacatactttgagcaagcgagcggttcattccggtgacaaggacagaggcagggcaagaccctgtgtccctgcaggtcgggtcaggcaaaccgtcgaacggctgggaggcgatcctgacggcccgggactcggggcgggggacctggaccaaggccggccatggcgtcgggctcttgatcgggcagctccccacctggtccagcgtggagtgctcgacgccgcactccgtcctccggcaggtcccgtccggcgcggcgtccacgcaggcgcagccgcactggtacttgggcttgttgatctcgtggttgatcaccccctggagcaccacgaggatcacgcacaggaacaccgggaacaccgtgatgcacgcgttcgtcttcatgttcctcctctgcatcaaagcaagaaatcgcaagcaagcaagaaacggtgaggaaatcgaaccaaaacctgcgaaatcggggagacgcgccaagaaagaaagagggaggaggggacctggaagcagaggttcttgcggaggagggcattggcctgcgtggcgaatccggcggcgcccctcgacgacgacgaggaggaggtgtctgccatcgtcngaggcggaggaggtggggggagaagctacgctgcaccggcgatcgccttcgtct

SEQ ID NO: 6306 - DNA, 2796 bp, Oryza sativa
tcctgcaccccctgaataccgttagcatgtttggtaataagaaaaaggttaagagatcactaggatgagtgccaactgccaatgtactgctaaggacgaattgatcaagagttgctatttggtgaaatctaaacatgtttgataagaaaatacttttggcatttcccgcttgtgttaagtgttagaaacatgcgtaactggcctttttgtcgaaactaattattggagcatttgtcgagactttgggtgtcggtccgttgttattacgcaccctaggtttgacgagcattatgtaaaaataataaatttactattggcattcactaatcactaggcttggattcgaggcgaagaaagaacaaaatctgcgttgaagaacaacaagatcgaagaggagaaattaattgcaacgtgcatctaaaccatgttatcgtgaagagagaatctttgacaaatcaaatgaaatatccaaaaaccaagtcaaagtcaaacatgtagagcgagaggggaggatttcgtacaaggggcttgtacttgtacctcacaaagtgacaatggacttcaagtgtgtggtataggttgaatttgtttaaacaactctgttatttaagttggaaaaacgataccctgcggcatgatgggattccatatacgtggattgcaaaaggtccactcgtattgtataatctgtggaagggtaggacttgttaattactccatccgtattttaatgtatgacgccattgactttttaacaaacgtttgacctttcgtcttattcaaaaaaatttatgtaattatcatttattttattgtgatttaatttatcatcaaatgttctttaagcatgacaagcatttttgtatttacataaaaaaaaattgaataagacgaatggtcaaacattggttaaaaagtcaacagcgtcatatattaaaatacagagggagtacttgcttaacatttccttgggcaccaagagatttagtattaaatttattgtgctattgatcatatgtggttgctaagatgatgtgggattagcagacaaattaaattacacttagaataatatccaaacaaaaatatatctaccgtaaacctcgcaatacttcctcgaagacctaaagaaagtgattttatacttacatattctagtgtaatttttttatctcacctagcgtaaatgtgatacaagcttagttccaaattttatgctggaaatgtaaaataactgtagaatttcacctaaaaaaactcttgaatttaacgtggtgcaacatcactttctacttaggtatagccaaatttggcatgtattagtaattatatttttttactaattgtgctgtctattgtattttgtgcttaattattgcacaccagaatctctaggagtggacagctgattgttttacaattagaggggaaaattatagatagaatgtcaaaagcgatgagcttaatttgagaaaattccaagaaacaagtagcttttcacgcaaaaaaaaaaaacagaagaaacaagtagctcttggcgttgattagtaatcaagcagggtatatagccccaaagcaaaagaagaagtaggagtatattacacataagaaaaacaaaaagtccatttatagtcaccatcacacacttggtcacaaatcacaaaacttgcatctgattgttcagatcaagtacaattcaagcacgaagacatgtcaaaactaaactattatatcacgcgctgaagaattttcatgttgaacttgtttcgctaccgttagtaactattcaattcaaaatttcaaatatggcataaaagggttcttttgatcacatggtgtgccctcgcatatatatgccaaaactatcatgagaccacatccagtttattgtaattattaatcgatttcagaaacttcacttgagttctcatagctagttgtaaatatcgccgttggtggtcaaaagataagaccattagtatattatgaaaacgaacgttgataacagcaaaattgtcaacatatgtggcactacgagcgagctagcatgcacatgtaatctatcaccatcacacacatgcaattcaaacttggattatttgtgatcccaattattttgtacatttacaagtcacacgtattggataatctgtggttgaagagatacgagtttgtccccgtgcagatcatgatgtaaaatcagcagcaaaggtacataagcattctatatatattcttataataataataatgaaaattttcctcacaaaaatggaatttactatgtacatttttgccctgtttagacccaaccccaaaatttttcaccctgtcacatcgaccgtttaaacacctgcatgaagtattaaatataggctaaaaaataactaattgcatagattgtgactaatttgtgagatgaattttttaagcctaattgctccatgatttgacaatgtggtgctacagtaaaaatttactaatgacggattaattaggcttaataaattcgtctcgcggtttactgatggattctgtaattagttttatacccgatgtgacatgccaaaactttacacccctagatctagacactccctttgggtgcctattcctaatatttgacatacagatatgctagaaatttaacactaaaaatgacgtaacttaataccttcttatagtcctaagaaaactattaattggtactaacatgccacattatctaaactttgggcgccatatttggcatatattagtaattaaatttttaattactaaatttcctactatatt

SEQ ID NO: 6307 - DNA, 16104 bp, Oryza sativa
tcctgcagcccatcagcagctctaggagtggacagatcagcatattgcaattgggaaaaacatttcatttttgttatgaatgttccatatgatctttaaatagataactatcaaattaagttacaggctaactattatttgagaaaacacagagcaaccagtagctcctcgtgtagattggtattcaagaagagccaaacaaagtcctcaagaaaaaaaggagaagaagagccaaacataatatattatacagcagagaaacagaagtccaaatagtcatcatcaaacacatggtcacaactcacaaaaacttgcatctgattgttcagatcaagttgaattcaagcatttagacatgtcaaaactatcatatcatgctgcagaatttccatgttggatttgttctttaccgcgtgtaataaaacaacacaaagtttcaaatatagcataacggttcttttcacatggtcgtgccatcacacacacacacacacacacacacacacacacacacacacacacacacatatatatatatatatatatatatatatatattcctaatttgagtgactatcatgagatcacgtcgagcttgttgtgattattaatcagttttaggaaccttcctatgagttctcctagttgtggatatcactgtaggtggttagaagataagagttgaaaacaaacgttgacaacagcaaacttgtcaacatatgtaatactagctactggctagctatcatgcacatgtaatccgtcaccatcacacattgcaattcaaacttagattatttatggtccaagttattgtgtagatttatataagatctcatgtcatggtaacatgtcatgttgcggaatgttggtattgttaaggctagtaattgtttcttaccaagcattgaaaaatactaaactatagtcaaataataggagtatcaagagctctttgtagatgatgtatctgtacctcccaaaaattatatccatgtgaggctcacttgtctgaactcaattatcgaagcactgaatttggtggaagtttcgttatttttggagcatatataacttaacctacgcgtactttgttcagtttaattatgctctcagacatgaactgttggccaaatgccaatggtattagacattggggagtctatttggattttgtttaacaaaaggttaaactaaaggcccataacctgggactgccaattggattggaaagtctaggtatctgctggtttaacttaagctcatgggatataattatcagatgaagctatacacgcataattaggtgtcatctttaaatttatataaggctcaacttgtgttataacccacgtatatataatttatctatactatataaagaagctaatcctgtgctattaaaagaagccaatgatgattgttagtgattttgcccccattagcatatctttaattggtctatatttttctgccaaacaaatagatcatttgtgaatatttataaatttcatacatagaggacaaacagtcaaagtttataaatgaatttagtccccgtgcttaattatttaaaaatacgaagtactccctccgtttcatattataagtcgtttgatcaaagtttttgagatttgacagtttataagaaaataacaacatttacaagactaaatcagtttagttaaatttaatattgaatatattttgataatatgtttattttctattgaaaatattagtgtaagtttgattaagaaaagagtcaaacaatttataatataaaacggagagagtaatatatacttaagattatttgatgagaaagatattaaaaaaggctaggatattgtctatgtgataattttttaaaaatatagttaacatgggatgtaatatttttttttattatgtttgaagacctaatttagatagatcctactcaagccacagataagagagaagctcatatgtatgtatgtacaaatataataaccttttaatttttaatttgaggattttatgggaaaggactaatatagtttgttttcaagcatacgaagtatgcatgtttttctcagcgaatatctctcgtacgtatgttttccgccttttttttacgaataattatacgtatttatccttctcttatatgtacaggaatcgggttttccatgaccgcatcccttctaatcgtacagcatggaactgatctccatgctgggaatagcatcgatggagttagtttgcatacttacttggcttaaagtatgtttacgataaagttggtttgcacgaggcatactaagaacatttgtagagtattcaatggacttttacggtatatataatacttcttctgtctcgtaatatagttacctataggatcggataagaccctacgatacaatgaatctagtcgtaggttcttacatacgaggatggagagagtatataagatgcagaagggtagtacagtcatattttccaatagaccctttgttcatctgataccttcactatgatcagtactagtaggaaattaattaaatgcaagttgatcttcttcttaattaagaagaaagttgtcgggcatgcagcaaccaatgcaagctaggaaataaagtaaaaatgcataaatataatgcagtttatagtaaggatccatggtcgatctccatacaacttctttaaaccaaagcatgacgacgttcatttaaccaccaataggcactagctagcttaacttcatctccaagcatccaatttccaaaacaaaccaaaaagaaaaggatatgatccaagggccaaataaaagtacagttaaatttgaccgtgcgacttgttcaaactaattaactagtaataattaattagtgcaactcttgcatggcagttctgtcacactatttatcttgcaattaatattgtgagacacatgaactgatcagggcattcccttgcatcaggtcaatggcatcacttaaaatttgataaccagatgcaacctgctgcgattgttaattgactgactcacatggcagacaataaaccgtgagcagatacgccgtctgtttttggtgtaggcagcctcaatctttccgaacattcgttttggatccttgaggactagatgaaagattccattaaatccacttgaaattgaataaattagcgctactacaaaattaatttttctggacgagaccctccttatatagatcataaatactatatagtctgcaaaaatcatttccccgtgttaggtttatgagccgaacacgaaaattcattttcgcagacgggcccattaacagtattttagtatatgggcctgttaagtgacccgcatgcgaaaatagcgcgcatctctcccactcccatctctcccaactcttttttcttttctccccacttatctttttccggcatatatattctccccttcccactcctcccactccctctccccctctacccactcccagcgatggcggcggcatcggctagggcggcggtcgcagtgacatcggcgagggtggtgtcaactagggtggcggcgacggtctcctggcaaccatggggatggcggatccgtcgccggccactgcggggagggcggatccatcgcccgccaccgcggggagggtggatccgtcacttgccaccacggggagggcggatccgtggctagccactgcagggatgacagcggcgggcctcgggtaggcgacgacgatgactgcagttgcggcggtggtctcccagcaacggcagcgccgagagcagcgtcggatccgtcgccaccgggtctcgggcagctagatccatcgctagtgaccgcggggacaacagcagcgggcctcgggcaggacgacggtagcgggtcttgggcaagacggtggcggttggattagggttcgagggctagggctttgatttttgttttattttgttgcaattttatatttttgtgtacggatgacttaagcgcccgcacatccaccgcacgaaaaaatcggatatttgcagactttttgttgcagacgaatgggtgatccgcacacaaaaatgctgttttggccgtctggaaaaacctttttttactagtgtggtttaggtaaatttataatattcgtgtccccaaatacctcctctgttcacaaatatatgtattctgaatgtttaaaatttgttcataaatataacagagtactacttattatggatagttagattttagttatgtagaggtcataactctacagatattaaattttcactcagctggaaacatctgtttcttttccgttgtttttttaagaaaaaaactgcacaccttctttcaaagaaaaaaaaagattgcacactgtttgattggatcttgtttgcctaacggtgatctctcatgcaagttgcgctctgtggtggtggtgtttgaatcttctaaagatgaagatgaagatatagattaagtgtttcacgcaaaacaatatggtaataacatgtgattaattgagttctaattattataaacttgaaaaatggattaatctgatattttagaggaactttcatataaaattttttcgtacgaaacgcaccgtatgtgtgatgtgtcatatgtgtgcagcacacatcgttccaatcagtcaaagaatttgtgtagcattaagatctgtggcttgatgcgtcgatcacaattattatttttaacttgtggcatttaatttgtatttagattgcctaaacttttggttgatcacaatatatagtgaattgtgatcgatctgatttctttggagcctaaactttgcatgcttgtcgccaagaaacttccttcgagaaatgaacatgtatcttattattgtttggatgtacgtagatcaacatttgcttcagataatggcaaccagtaattaattggccttggtaggatgtgatctagcttgcttctgatcgacctaagtacagctgacattaattttttttccttcgttttgaggtttgactcgatgtgaaaatattataatactccctccgtttcacaatgtaagtcactctgatatttcccatattaatattgatgttaatgaatctagatagatatatatctctagattcattcacatcaatatgaatataaaaaatgttagaatgacttacattatgaaacggaggaagtagatagttgtaacaagaaaaaaaaatagtatatgcgaataggattgttgtgtacagtataggcttaaacaaaacaagaacataattaagtgggggaaaatgttcaaatactaaaaataacagcgagaaaaaacagaggccagttggatatttcccctttaatttccacgttctcaactgttggccaatgcaatattccgtttcctattttttctttcaacataaaccaaagcaagacgaataaaggaaaagaaaaatgaagcgacgccacctttcatcaagttttaaaaatctacttgaaaaaagattagattttggactaaaagatatcttactagcaaatttgattttcaaacttcttgctagtaaataatcctactttactagcagatcctttcgagtttcaacaatattttacccttaggctcgctcgcggaaataccaacaaactcactaagggacaatgacgcatttctcttatggccagtcaaggatttgacctagaaaattcaagtcatgtgagcctctccttccatatctatcagaaaactctgcttgaagaatattatagccagatcctacttactgatcttccctggataattcaattcaaagcaaaagcgtgtttttgcttgcatatgcaatgcacatgtaatataatatcgatcttcttccatgagcttagcgtatcatgcagctgacttctatcttaactacgaccgttgaaattattgtttgtagcgcccatcattaccataaaacactacttaagggcacccgtaatagttatctataagctctctacaagagatccatatcagcatatttttctacttagaagagattaaatgaagagagagagcaaaactatctattaacctggagatagtctatagagaaaaacgaggcaatgcattagagaactatagatacctatgtagacataccattgaagtggtttactattaatctagtctattgctgagatgtacatattttgtagataacatattactttaccattgcgggtgctctaaggtgagtttatcagctcctgtgttgttaattaggtcaacacactttagtgcccaagaaattcccacgaagttaagcagcgagcagcagtagacgcgtcaaattcttcacctccaagcatcctagtaagtcgtttatcgttccacacaataatgtatcattttttttccgggaaatgcagtaatgtaattcaaacatatgtaactaatattttttaaataatttatgaagtagttagaaaaagaaaataacgtacgtgcgctgtgttatttttttaaaagaaaatactcttgccatatgaaaataattgttattttaggtattaaatgtgtctcaataagaatgatattctagagtagtccttgttctccaatcacctatcattcatttttttcccatcttatcctaatcattatttcacttccaactatccctggtgtaatagagagcatatatctaggtcatactccttaattttgactgtcaaaaggaacatttattttaggaggagaaacattttcgttacaccaccaatatatagagctaccatccatgggatgaagtagtgcctctttgcaattaccaaaatctatgtttgttttaaagaagtatagatttcatagcttgggaataaatagtctacatgcttcatttagtggcacccatatgtctggtgatagtaggagtagatggtgacaccaatttcaagtctccacgtgtcagttggtgggtggtaacggattcatcactcatcaccatcattagagttttttaaaagagttgaatagttggtatcaatataattataattaattattataaaacttgttccatgtaagcctaggggagggtatttaactttttctttttacaaaatagctttctatctaagcttaaaactcaaaagatacattttattttttattaataacatagtttaaaaattaaatacccaccgtgaaaatcatgcgccgggctctacccttcacatggtttcacgttatcaaccaatcagagccctcggattaaatatcactagttacaggggataaccgaaagaagaggacatgatcgaagactaatgcaaagtagtcctactactccctccgtcccatagtttttgagttttttttacaacgtttgaccactcgtcttattcaaaaatttttaaaattattatttatttttttacttactttattatctttattatctatggtaccttaagtataacttttcgttttttatatttgcaaaaaaaaattaaataagacgagtggtccaacgttataatcaaaaactcaaaattctcttatattgtggacggagggagtatacacaggtcaaacctgcatgaatccctaggctgtagtacggttctctaaccagcaggatggacggcctcggaaactcacaaatacgtacgtcgacggcaacacgttttttacagaaacagaactcgttcaatctacacttacacacccacaatttttacaataatacttctcgatcgagtcctggtttatggacctttctgtgtttctttagaatccagagggcgtaggtaaaaaaaaagcttaactgttctctggctcacgcagtcccacagcttattagccgcctaaaagttgttaactatacagtaatttttgttaatttgcagatgatctcttctaaatttattatcatgaccgttcaattttatcatacggctgctttcacttcacatattgaggatatagtttcagaaaacaatcaaacgattaacattgacgtttgccgtccgtttgttggcttagatgtaggtaaggtcgtaaggatacttccttgctattccttctgagcaaagaaacgtgtatatatttgggagctttgaaatgcaaatattatttttttaaaaaaacaattagtatggaaattgtatgtctagatttgtgctgaaaagttgcttttattataggacgagactaccgatcaggtgccgcacccgatccaggcgtgcaaaaatcaggtgctgtcactagtggagaaaccatctttcgtcggtcggccgatttccacagtagtcacggatgcaataaaaaccggggctaaagatgatctttagtcccggttcaaaagggtaacgggcatatttgatctttagccccggttcgaatgctgtcagggcatgtcaggccccccggaatctttagttcccaaccgggactaaagtcccacccctatatatatatatgtcttcttcctcctctagctgcccgagcaagcttcaaaatttcttcaaaaaagaggggaggtcatgccaaaatttctattgaatttattttggtgattacatacaaatcggaggtgtctaaaaggtttgcaacttcatcctccaatgttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggttttttttgactcatgtagatggatcggcaatggatgtacgctgaccagcggtccaaagagtttattgacggcgtgcactattttttgagagtggccgaagctaacaggcaaaggggttttatttgttgtccatgcaataattgtaagaatcagaaggagtattctgcatccaggactattcatttccacttgtttgagtcagggttcatgccaagctataattgttggacatcccatggagagcaaggtgttgaaatggaagaagatgaagtggaagacgacaatattccggactttgctcagtatgttggatttgaagaaaatcaaatgggcgaggaggaaatagctgctgatggtaacgacattgcggatgatcttggtcagatgttgcaggacgccagggaggactgcgaaagtgaaaaggaggcccataaattggacaagatgttggaggaccacagaagttcgttgtacccaggttgcgagcaggggcacaaaaagttggataccactctggagttcttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagtttataagatttacgcatgtccgaacgattatatcctatatcgcggtgaggagtatgataacctagaagcatgccctatttgcaaagcactacgatacaagattagacgagacgatccaagagaagttgacgggcagctaacaaagtagagaattcctgctaaggtgatgtggtatttccctataataccacgactaaggcgtttgttcaggaacaaggggaatgctagaatgttgcgatggcacgctgaagagtgtcaacaggacaggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctctccccctggctatgcatgaagaggaagtacataatgatgccgattattattcaaggccccaagcaacctggtaacgacatcgatgtgtacctaagaccactggtcgaagatcttaaatagttgtggaagaaggaaggtgtccccgtgtgggacgaggacaaacatgaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttatattccttgcgattccttgcaacaaaccacccggtacggaagaaaggcaagcacttcgaacataaggccgatcaccgtacgaagcctaaacatcgcagcgggaaaacagtgtttgctatggttaaagatcttaaagtagtgttcggaaaggggcctggaagccagcctatagagagcgaagatggtcacgtggcgatgtggaaaaagaactctatattttgggagttaccatattgggaattcttggacgtacgccacgcaatcgacgtgacgcacctcactaagaacctttgcgtaaactttcttggcttcctaggtgtatacggaaagtcgaaagatacactggaagcacgtaatgatctgaagcatatggaacaacgcggcgaccttcacctggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgacgacacaactgctaccagttgtaataaggggtatccttccagacaatgtccgggcaacaataacaaagctatgtgcattcatgaacgcaatttcgtagaaggtcatcgatccggatagattagaagcccttcagaatgatgtggtgcaatgtctcgtcagttttgagttgatatttccaccttcatttttcaatataatgacgcatctgctttgtcaccttgtgaaagacatccgtattctcgggcctgtgtacctgcacaacatgtttcctttcgagaggtacatgggcgttctgaagaagtatgttcgtaactgtgttcatccagaggcaagcatcgccaagggttatggaacagaggaggtcatcgaattttgcgtagaatttatcgaagatcttcgcccaatcggggtacctgaatcacgcaatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccacgtggctacgacaacatctcatgggtaacgagtcgatcaaccaacaacttgccttcctggcgaggggaccgtctgggtcgatcgcaacattctagggatatgagatcaatgggtacacattctacacgagagcccaagacatgaagagcacgaaccaaaacagcgctgttcgtgtcgatgccatgggatacgatggaacaactgccacgtattacggtgccatcgaggatatatgggaacttgactatggtcctctcaaggttcctctgttccggtgccaatgggttaggttgactggtgtcacgcccagaaattcatgaaccagaatttctaagctgaatgtgtattaaacccctgtccaggaccagccagggtacacaaacgataattgttgacatacagatctacgtcttacaaaaatatgaaagattacaaatgcagcggaaaaagataaaagcgagctgagcctgaagacttgactcctgcagcgagcgattccattccacaggcaacccttgacggcagcgatgaaaccaacctcttcaagacatctccaactgagaagaacttcaactctggtgtgggggaaaagagcaagactgagtactacccactgtactcagcaagtcataccggaagaggaggtatgatgcaggatataaccaacggaggctaggggttcatttgcataaagcaggcatttaaaaccagtagttgaaaacagtaaaaacagttgtagtaattaagcaatattaaccagtcactgtccaacgctacgccacgttgcaacaggcccaaccaaccacctgaactacactagttcattaagctaaactaggggtgagactaatcacggtgaatctggtcgaccgcccataaccgcgggcacgactattcgaatagttttactctgatcagaggtgtacaactgtacccacaagacacagccccacgacacgttcccgtgcgccgacatgccaccacgacataccggaaagaggccgtgacaggacccttcgcataaccctctctaaccgatcgcaccacaccttagggttcgcccccgtccccagcaggcaacgggtagcccccctttcgtgccgcggtgaatccggaagccgatcaaccggacaccccggccgacccaactccatcacgcccaccctcgcctgggtacgttggctagagaaaagctacactacaaacccagccgttgcccacactggcttgtggtaagtacgataagttcttccagggcatcccgcgaaccggtccttaatcgccatgggcacgactagcaaaaccatgcacccacagcccaccatgtagtgtattttaattaaccaacaccattgcggtggcactaatccaaagctattgccaataatcaaagtctatgctttagtgtgatccccttttgtgcactagttgaactaagcatggctaagcatctcctaaaccagcatctagtcattttaatacccaagttatcaatggcgtaagggaaacaacatatagctgagtaataggacccatcccacatgatattgtaaaacaatgcaatatttaatagaaatacgggacatttgtaaattgggtacaatatgatcaattgcaatgtatgacttgccttgctctcgcactgatggaaccacagcaacgtcttcgagaaaccacgaatcgacgaaacgggcgaaatctacgcgacaaacaatgcacacaagcaaaacatgctataagactactgaaacaggaaacaaaaccatttttaatggattctatacatttttatgaatttactgagacttgaatggtcttaatcggagctcggatgaattagttatgatttttagaagattatctgtgtttttactaataaagaaaaagccttaatgtatttattgcgcaatattgccccagggctgacgtcagcaaggggggaggcgccggcatgcgggccccatgagtcagcggctcaagagagagagagggaggggcgccggcacatgggccccactggcagtggcacaaggcgggaggggcgcggctggtggctcggctcggcttcaaagccggcaggccaagcatggcaagcgacggcggcacgcgcggtcgccggcgacggcaaccggcggcgcggacggcgatggcagacggcgcgaaaagcggcggcggcggccgaagacgacggtgcgcgcgcggaggacggcggtgcacacgggagagagggaaagagggaggagggggagtttctcaccgaggttggccggcgcgagtggagacgacgatgaacgacgacgacgagcgacgggaggacgatggcgatgggcggacgatctccgggacctcctagggaacaaaatgggaaggattagagggagatgggtggtctacggcgggcagaaaccatggccgaaggcggtggcaatggtggtactcaccggcgcgcggggagaagcgggccccgacggtggatttggccgggcggatggcggacgcgacggctcacgggatggtgaacgcggcggcgtcgacggtgagactcggcgcggtggctagcgacggctagcagcggccggagcgcggcaggagggcggcggtgatgggtgtagcggtgcgggagtgatggagggcacgggagagagcggcggaacgaggaaaaaggtggaggggagtgcggggaagctttattggggctcgtgagagatggacgtggccggggtgctcccgatttcgccggtgacgtgggaggtggagagagagtgggaggggattcaaaatttgaatccaccccttgtgggctcgtggcgcgggcgggaaggcgtgggcggcgtcgcggcgacgtgggcgcggggcgcggagtgggcgcgggagcagcgggatacgcggcggcatgggcggtggtttcggcggcggttggcgcgggcgtgggcggccggaggttagggaaagggctgacaggtgggccccacctgtcagcgcccgagagggagagggaggccgggtgaacttcgggagtgggagggaggagcgggccggcgcgggaagaaatgggccggcggcccaagaaaaggaaaaaggagggaaaagaaaagataaaaaggaaaaagaattttcccagggatttaatattgcactttgcttattttaattggttaaaattatttccaaggctctgaaaattccactaaaaatcctgttagcatattttgacatgtagaatccaagaaaaattccacatgccgattccgatgattatttgcatttattaattaaggattcaactctaggttaaagtaaacaattacttcggacgatttattttatgaatttagagcaagggaggggaacttcagggcgtgacaactggtgaggcgtaatgattgatgacagtggtatgacaactgttgaccttaacaaggttggatactcggacgaaccttttgtccttgccaatgatgtaacgcaagtctttttcgtgaaggacatgtctagcaaaggaaagaagggcagagggcctgacgagcctaagcgtcaagtggttctcccaggcaaaagaaaaatcgtcggagttgaggacaagactgacgaggattacgatcagttcgatgggcaatcccctttcacggtgacgattgaccctagcatcctcctatcaaatgaagacaccccttactcacgcagcgatcacaaggagggaacaatagttaggagaaagtacgtgcggtcaaccgtcaccgccgatgtaatgccgtaattattgtgtacacgatgtaaactattttggatgtattgattatccatataaatcaattgatgtatggcataatttactatcattcatatgctacatttaattgactatcattcatatgctaattataattgactagagaatttttaaaagtattaaatcattcatgtggcatttacagatgttaattagagtttttcacaatttaatttactatctttcatatgctacttatatatgactattcgaatttttaaaaggtttaaatcatgcatgtggcatttacatatgttaattagagtttttaacatttaatttaatataattcctacgctaagtatatatgatgattacaatttttattaattttaaatcatacagtatgtacatacatatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtactttaaataatgttaatgcattaacttctattttagaaacacatatgtaagcaaaaataatatgcagtgctataatgtttagtcccggttcttaaccctaaccgggtttaaaaagaatttgaaaatagcgggaaaagatctttactcccggttgggg

SEQ ID NO: 6308 - DNA, 6205 bp, Oryza sativa
  unsure (1)..(6205): unsure at all n locations
ccacgctgccgcctctgtcgccacgccaccgtgccaagcgccggcccgatgccgccacaccgccgttaacaaacacgtgaacgagaacgaacacgtcaacgtacgttgccgcgagaacgtgaacgagaacgagaacgatcgaacgaacgagagtgagaacgaacacgtcaacgtacgttgccgcgagaacgtgaacgagaacgagaacgatcgaacgaacgagagcgagaacgagaacgatcgaacgaattaacgtgaacgagaacgacaacgaacgtgaacgagaacgaacgtgaatgagaacaagcgaacgaacgtgaacgagctagggaacgtgaacgagcgaacgaacgtgaacgaacgtgaacgtgaaatgcaatatatatatatatgctacttcgtatttatcctaatacatattttttgtatcttgcagaaaagacgtgctgtcggagtcgtccctcaagccagagtggaagagctagccctagaaggaattcgtgcaggcaagtgacgtaataatataaatgattgttatatttgtaatgcaattaagaatattagacttgtaattagacttagcatataagattgtgtagtgttctatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtcatattatttgagttttaatgtaagattattttatttgtaattagacttactatataattattgactacggaattggtgcgactcctagcaattgacaattttagtcttaattagacttagcatatacgacagttacacctagcatacatgacttagattgttaaaacataaatgtctcgtgacttagcagatgtttcttgtatcaacagatggctgaccgcgatgaggaacaaatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgtgggcaacgaggtgcagcgaagaagcttgagggtcggcacatcataacagaagtggaagaagatggacgtcctagtgccccggccgaagccgccaagaagtatgtacgtcacagcggttgggttgtgcgggataacgtgcctgtcagtacggtgtactggcgaagaacaagggcacgcggagatcatgagacctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatcctgaaggggcagacaccgaacttcgacacattcccaaagctaagggatcactggtacgagttcgttgcatataaaacaggtgaataagggcaggcgatgatggaaagaaacaaagaaaatgccgccaagaagaagtaccatcaccacttggggtcaggaggctatagcgtcgcgatgccgaagtgggaggagatggaggctaggttgattgagaggggtatcgaaccggcaaccgccaattggccggaacgatcgaagttctagtactatgctcatggtggaatgctcaacccagctgatggctcactggtcttcggtgatcagatacgagaggctgcgcgacgactaacagatgcagtggaagcctcctctcagggcacgttccaaccggacagagatagggacgagctgacactcgccctgcagactccagagcatccaagacgaacacgagggaaatgggtgattccttggaagattggtttcaaggaggacatccacacgtacaggagtcggatgaggagcaagagagataccgaggcgaagattgcagatctagagttccgggtatcgagctacgaactcagcatgcaagaggaggtggcaaggaaggttgatgaacgcatggccgcacatcggtcctatgatccccagccgaccattcctcctgcaatggtgagcccgtcaggaaaccgtagcagctgcgcctcaacggggcaggtaggatcacagagcatggacgccatgcaaacacaggacgaatcgacctatcccattgatgacatcactcagcggacaccatgtgagctgcatattccttacaagaacttatcaataaaggtaagctcgtagtttatatattttagatttagccattccgctagttgctgcttatatatgttgattactaataaataatctctcacaacatgaaggtggtgtcgggcatggccatcccaacggacccttcaggtacataccactgcaggccgattccagcaggatactcgaaggtcaaagttgagttggtcgaaggcgcgtacgaggacctcgagctggattaccctggaggagacggtgagacgcatctacgagacacaagccatgccattattctatggcgcaggcggtacgtcatcctccctgggcgacaagcggcgtcttgtgcaccatctcctccggctccgccatctcctcctcaggatcctgcaccgtctcctcctcatgctccgccagcaccgtctccacctcaggctccagcaccgactcctcctcaggatcctgcaccgactcctcctcgggctcctacacctactcctccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcacctgtcaaggaggccatcaagctatcggactatgagcgaacgctgaagaaagcatcttctggaaagtccaaaccagtccctcagcttggagagcaaccaaaccaggagatcgagccgttggtgaccggggaagacatgacgatagaagaatttattattaataccggtctaactacggatcaattgctaggagttgaaccaatagaaaaggcagaattgaaatacatgtacgaactcggtaaaccgcttgtcaagcctgagctggtgcagtccctacccacacaaatgtacaagttccatcagctgtacatggagatgagcgccaccggtagagagatgatcggagcgaggatcagggacccggacttcttgcaaggagatgatattctctggatcaatttcaagggaatctacgaagtataccagctggatgccctcgacgtctctattatgagttgctggattttgtaagtatatcgttcagttatatttcttaattactacgtctcctttaattaattaggtccttgtatataagtaaactatataaaataaaatactcctttttatcgttgtagaatggagattcaaagggcccgacgacggagggttttcgatactggattcatcgaccctcggagagtaaacgtcgcaatgctcgaccaatatccacaagaaacagaggaaaatctcgtccatctcctgaaggcgcagcattacaagacgttcatactgttgccgtacaacacagagttagtttaattttactgtcttcctacataccaaattttattcccgtacgaacttgctaagtgtttcatatgtaatgcatcccacgcacattgcagattccactgggtgcttttactcttcgacctgtcggcctgcaccgtcaacgtatatgactcaatggataaaaagagtctacgtttgacaaggttttcgaacttatagacaggtactggcataagttcctctgttaattaagaaattattgttatgttaattatttctactacgaatcatatctttaaactccttgtagggcttggtatcggttccgtcatttggtccgcggcaactggagagaaagacttaggcggaggttcaaatttcctgtgagtacacatgctctacatttatatttctccgattcaaattaatacatacaagtgtatattaattagatctcacgccgttaatttgtcatttatttgtagtgcgcaaagcaaaagcagggaactaacttgtgcggctactacgtgtgcgagtattgccactgccttgcagaccaaatcatcaccacaagagagctcgatgtacgtacaaataaattcaaaatttcattacgtaacgatttcttgtttaattactaatcaatttcatacattcatatagtttattcgcatgagggataacctgaccacacacaaggaatttatcgcggcggttcaagaacaactcatgggattcatcaacgaagaaatccttgatcccaagagtgaattctactacgatggaaacacaattcaccggtccttagcttctgagctagcagtgagtactactactacgtcgaaatcgtagctagctaggacatataatggattgtaattaatacatgactacatatgtttctatatgcatgtgtacacattttctataatgtaaatatattttggtcatatatatatatatatatatatatatatatatatatatatatatatatatatatatatatgtatgcatatatatgtattgaaacatatatatgcatggtttatgtatatatataaaccatgcagcaacagggccatgcaaaaaaaaaaggtcagctcaacttttagtcccggttggtgttaccaaccgggtctaaagatcgatctttactcctggttatttcacccgggactaaagatagcgatctttagtcccggattggtactcccggtttggaaaccgggactaaaggggggttacaaaccgggactacaaagagtttctccaccagtgtgtcagcgccatgcatacgtataaaaccactttaaactattttttctcttaaattatttatccaaatcatgatctgattgcaccatttaattcgttgcaattaaatcttgaaaacaagaccacacatggatatattccggcgaaatttttttttagcttattattgaattatttttaaatgttgcacgatgttccaccaagtatatcggaattgtttcactaagtagatcgaaaatgtttcaatcgtttaaattgggcgttgtttcatcttatataaaaacaatgtttcaacaaatagcgaaagaatgtttcagttcactgcaacattagatctatacatagtgaaacattgtgagtacacgaggtgaaacattttgggtggaacaaaaaaatgaaacgaattcccttaatagagggtttccaaaatatgttggtgatttgttgtaaaagaatgtttcgttcactgcaacattagatctatacatagtaaaatattgtgagtatactaggtgaaacatttttggtggaacaaaaaataaaacaaattcccttaacagagggtttccaaaatatgtgggtgatttgttgcaaaagaatatcttaattcactgcaacattagatctatacatagtgaaactttgtgaatacactgagtgaaatatttttttgagacacgtggtgaggctaggggaacgtgcgcatgtggggggtgnagnnccgatcntgctccacccccgtcgatcgcccgggcttgagcattttcctttattatatcataatatgcttggttctaaaagtatattatagtagagatgactagaactcgaaatcatgcgcaaaatttgttggaaagagtccttttttttttttaagtatagcttccaaaattatatttcggacacggtgtgattccataaaggatatgttcatgaatgaatttatggttttttctcattaaacgcgaaccatatagtgcaaaaatgtccatgatacacttgttctggtatttattgcataatgtggctataccttatatattaattaattaattt

SEQ ID NO: 6309 - DNA, 21612 bp, Oryza sativa
tactcattactgtggtcaacgcttacgtctgaagatagacaaccacccgagtattatacactctcattaaagcttttaatttgggcttttgtccacattgcgggctaaaagaaatcagcaactctacttttcaactttgtgcttgtaaaaataacaaactttgtgcttgcgttgtttttggttagctcaattctttttatatcaacttcatgtaacacctgaaattccatttacaaataacttatatatatagaaagttagagcaaccatgtgttcagtttgttactagctagtagctaatagcctatgcgttgcaacgaactttctaatagaagaaagggttgtcaatactagtaagtcgattacacatgtaacaccaaaacaatcaacacttctaggatttctatgatttttctattatacaaacattcattagtcacatgtccttgatataatgcaacgagttataattgtatatacaatttatataaaaagacatgactaattaaatgggcttactactaggtgggtggtggtggtagaaccatgaccaccactaccttcttttaatgtagtatagaatttggctcggatttaagttagtcatagatttttagtcctcatgtgaaaaaaaatgcttacaaaccatagactggaattttttgaaacaaaatatgttatttgtgtaaatatcggatagatatattagtggtttttctaacatgtgaaataaaatatatacaatacaatatataatcaacgacacacaaacaattataagttttatctaggatatttccactacatagcaccagccacacccacaacgctagcccttcgctctttttccttgaaggttaaccaaaagaaaaaaaaaacccacatcactccacgcggcaaaaaaaactcacacaaccgcaacacacaagcagcagaggatgcagtgcagtccgttcactgacacgtgggccccacagacccccgggtccacgtgccagtgagcagcactgaagcactggagatgatctccacggcaagcagcagcagcagcgcccgttacctcctccccactgcggccgttttcttacaaatccccccctataaataccccaattcaccaacgcccccttcttcttctccaactccctccccctccaagaagcgaacaagccaagaactcctccaactccgccctccaatggagctcctgagcggggcggcgctggcgtggcagcagtaccgcgccctcctccgcaagaacgccacgctcacctggcgccaccgccgctccgcctccctccagctcctctcctcgctcgtcttcatcttcctcatcttctgcatcgaccgcgccatccgctcccgcttctcctacaccaccgcctaccgcaacgtccccgacccggccgccctcgtcgccccgcccatcccgccctgcgaggacaagtacttcgtcagggagccctgctacgacttcctctggagcggcggcggcggcgccgggagcgcacgcgtcgccgggatcgtcgaggccatccggaggaacaaccccggcaggccgatccccgccgagaaggtgatttgtggatttagattcatcttttttttctgtacttgtctctttgtatctatgtggatttcggttgggaatagaagattcggttttctctctgttcttgtagattgggcgcgattggttgtgtgatttgggcatgcaggttctggttgattagtttgggttgcgagtaatttcgctcaagcacgtttggtgtgaggattttgggtttttggtggagaaagatttgctctttttttttgggcgtattttgtggtggcaaaacgctatgatacatactgaatttgggtatttttattgttagtggttagcctcttgaaagaggggaattcgaagcattttgagggtgtatattgtatcttaggcacgtctgcttcttcggtttctgcatttctgaattatatattcccctattcctgcaaatattcttttagtccttcgaactggttgagtttgaaaccttagcatgcgtgtttcacagccagggagagatgtacttgtgaattctgagcaaaaatttgatattgagaatttgaaaaggagagattgattctaattcaaactcttttttttttaaaaaaaataaaataaagcgaagttctaataatctttaattctttttggagcagacatgccgatttgacgtttaactgagatagtctgaatttgcaattttagtttgtcatttgttccgtgtggggatgtcagcggtaagtactcacctagatggtggaccttgcgaacttttcaaagaagtatgaaaacgatgtttattttgttgtcaacgtggattaggaagcatcggagttcactaggaacatctaacttcatttaagcttgtcgtaagcacacttgatgtcattttcgtggtatggtactagtgcgtggcttcttgatacattgcgtataaagccttgtcttgctggaaataaagatggtcgcattgtgcgttggaaatttttaccgggaatatactaattcttttttttttttgggagaactaccggttgattgatacaagtacacatttaagtagtgttggtcttttgtataagaacatgcatacttttcttatttcctaatgaatattcaaattatgatgatctgagagtaaacgctgaaattctgctgtctaaaacttacacaaaatttatagaacttcctgtttgcgtgaggatttgattacataatttatttgcgcgccttcatatatccattcattaccaatcgacataagcttggctttagtggtactggtaaactgcaaacgcagtatgcactagtagtttcttctatactgcttaaataagattcatgaccccagaattattgttacactgaacatgtcgtctgactgtttctgctaaatttctcaggtcttgggttttaatactccagatgaagttgatgcttggcttttccaaaatccaatgcgctgccctggcgccttacattttcaagttataaacgacactcagataaagtatggtattcagacgaactccactccggtagctcggagaggaacatatgaggatcctaccttcaagttccagataccacttcaaattgcagctgagagggaaatggcgaggctgctgattggaggtattgctacttccatgccttttttgttacttctgtgctttgtacttggtaccacttatgtcataccctttgacatcaattccggttgttcagtaattcatgaagccttttgactagattaatttgaactatttatggtatgctgcaaaaatagttgttagctgtatgtatgcttctgtttgatagttgtcttggcaaataacagtatatatttatactgatgaatgtgacagacccaaattttagctggactgtggggttcaaggagttcgctcacccagctacagaaaccttctctactattgcccaagctgggccaactttcttccttgctattgctatgttcggattcgtttttcaaatcagtgcgttggtgacagagaaagagcttaagcttcgtcaggttcgagctcccccatactctgcctgtgttgtaagatttacatgacaccactcaaagtttggttaataattgcaggctatgtctatcatggggctctacgagtcagcgtattggttgtcttggttaacctgggaggctttcgtcacattactttcagcacttcttactgtgctctttgggatgatgttccagtttgacttctttctgcacaataactttgggatcctattcctcctcttctttctcttccaactgaacatggtaattttgacatactaaccatcagtctcctatctccatttaaaatgttaaatttagataataaaaacatgcttgcatggttggtttttacacatttcctgattcctgttacaacttgcaaaagaaagaagtttttaacatattgtcctcattcatgatgcttgctgcagcttagttttgccttcatgatatccacatttgtaacaaaagcagcatcagctactactgttggatttgcaatattcattattggcttcttgacacaagtaagttttctgaattgtaatactatggatccagtacttcaatttctcagaacaagtgtgtgaattctttaattttcttgttgtgcagcttgttacaacctttgggttcccatattcaacttcctaccagaagtactaccggacaatatggtccttgtttccacctgatgtttttgcccaagccctcaatattctgggcaaggcaacggccactcctgaagacaaaggaatcagctggaatcagcggggacaatgccaatcttttgagacagattgcgtcattactattgtacgtacgaatcattgcttattggatattatgttcttaaaccttatgcaaatatcaatctgaatgttcacaacgatctcataggatgatatctacaaatggctcatctccacatttttcttgtggtttgtcctggcgatctactttgacaacataattccaaatgtcaatggtgttcgaaagtcagtgttctactttctgatgccttcatactggacaggaaaaggaggaggaaagttgcaaggtcaggactgtttgaagttcttggtagttctggacaatgttctagctatagtttcttgcattacttgctaatctgtatgctccattacagagggaggactctttagcttttttggttcgaaccgcccagctgatgatgcttctcctactgatgaggatgttattgctgaggaaaatctagtaaaacaacaagctgcaaacaatgaagtagatcctggtgttgcagttcaaatatgtggtttgcggaaaacatatccagggagttttagtatgggttgctgcagatgcaggacaactaaaccgtttcattctgtcaaagtaagtccatatgtcacttcttgttgtgtaaaacatggaagatttgcttattctgattactgattacaaaaaattctccagggtttatgggtgaaccttgagaaggaccagttattttgccttcttgggcccaatggagctggtaaaacaacaacaatcagttgcttgactggaatcacaccaattacaggcggcgatggttggtatctttcttaaaagcaaaagcttgtatagttgtattgttttgtaatatctaataagccattttgaacattggcagcgatgatttatgggcattctgttcgaagcactgctgggatgtcgaatattcggaggatgataggagtctgtccgcaggtaggtgctttaaacattgttatattactgatgcatgtgaattgatcaaaggaagataaacattcgtgatttatttctttgcagtttgacatcttgtgggatgcgctaacagctaaagagcacatggagctgtttgctagcattaagggactgcctccatcaacaatcaagtcggtatgtttctttagaactgattacacgtactcctccctaaagcacttaatttaattgtcttgcattgatcttcctctgattgttcaaccaatgcaggtagcagaacaatccttaatccaagtgaagctcagccaggcagctaatgttagagcaggtagctacagtgggggaatgaaacgccggctaagtgttgcaatagctctaattggtgatccaaaattggtctttcttgatgaaccggtaaagaccgccaaatttgctacaaacttccttccaaacatcccttatcatgtgctgatctaacaatgtatatcctacacagactactggcatggatccaataacaaggaggcatgtctgggacatcatagaggaagcaaagaaaggaagagctattgtcttgaccacccattccatggaggaagctgacattctgagtgacaggatcgcaatcatggctaaagggaaattgcggtgcattgggacttcaattaggctgaagtcgaaatttggaacaggatatattgctaatgtgaatttctctggaaatggtcacacacaaagccctaacatcaacggcaacactgaagtcccggttaaccctaacatagaatctgtcaaatggttcttcaaggaagtatgtggctcatcactaaattctatatccttcaaaattatcttttcatatagtagagctggaaatcatgtgaaatttattgacagcggcttgatgtggacccaaaagaggagagcaggacattcttaacgttcgtcatcccccatgagaaagaaccacttctgacggtactgcttcctcacccaaaactctggctgtcataacatcatgctttaatttcatgataggctaatatattttccattaagcagaggttctttggggaactccaagacagggaacgggaattcggtatctcagacattcaactcggcctcacgacgctcgaagaagtattcctgaacatcgcaaagcaggcagaactggagagctctactgctgaaggcaccctggttactctgaacctatcatcaggttcatctattcaggtttgttccttagtacccctaagaacaatgctgcaatattggacatgaaaaggataatctcactgctatgtagagaacttctgtacagcagcaacagtacagaaaactctgaaacttgctgctatgctgtaatttgattgtgtgatttcttcagaaaactctgaatatctctttgatatcacttccattttctatggcaatgcagataccaaagggggctcgttttgtcggaattcccggaaccgagtcggaggatcacccaagaggcgtgatggttgaagtttactgggatcaagatgacaatggatcactctgcatttctggtcactctgatgaaatccctgtcccagccaatgttcagctgggtcggcccccttcgctgtctcgtagggcctcagtgggccgtggaaaccctgttgggtacatcattgatccgaatgaggtcacagcagcaagatgagtgccaaagaaagaagaatattctgagagtggatgaatttagatttgtcttcatgtaaattatctctaggtgtaatgcaactatagatatgtttgtactagaacagtgtattttttctgttttgtggtaaaggaagtgcttgatgatagatacaacatgcttacatcttccatttggtggctgacaaagagcttgacgattacagatgcaagaatgacaggaatttttacagtgatttaatttgttgcattcaggacggtaggatgtctggggtccttgttttgtcgctcataatttattttttttgttcatgggtgaagtatataattatcaatcttattgttttagaaatataaataatgtgctcattagatgcattagtgcattgttcctgttgtttatacatatcataccatagggatcgtacggtttctggttcccacggccacgatatatatagcttctgccaaattgagtacacaaataacacttactaaaagtattctgaatttctatattgcttttactttgtttgtgagatataaaaataacaattttatattttttggaattatatatttttatttcttacaaacaaaatcaaatttgaacaggatttttttacttggttacaaaatatcatcatatctacatttgtgattttttttaaaaaaatttagacaactttttgattggtgtttgcacgagttttcacttaaattgagttttcatcacatatttaccccaaagaaattatatacgattaacatttgcgacacttaaccgaagaaacagctatataagctagcttaaagttttgcaatctgaaattactgatcagtgttcactgtttagtaccataaaaaactgatacgtcagctattatataatctgaaagtacatacatggatgatatatatgtgcacgttatatctgaggtaactgggcaatagctagttacaaattacaagttaacttgggtgagggattaaattgagatcccagattgcgtgagggcaattccacttctttacttcaagtttgttgattgcagttcatggaatcaaactggaaaatggtaattgctcattcaggaatcagggctcatgagtcatgacctgggctatctgaatgcatatccaccgacgaatcatttgatgctgcaggatccgagtcaccgtttccagggcaaaaaatgccatctgcaaagcatcctgtgtcaccgcattgctgtacatggtacagttgcaggttttgccggacagggctggatagcgctttcgaaaatatcatagagtccttggaagggtttgatggtgtgattgaacaagatggcggctgctgcgtgcttgtgttggggatgtgcattggagcttggagattctggaatgcgtgttgcgatctcggtgaagttaatgcattgtcacctccatactcaatctcgtgctacattcaagaaaaacccataaacatggctacatgggtaaggagtaaggacaggagctattaatgaaatgtgatgaaatatcatcgttcataatactacagcctagctgagaggttcagtgaacagatcatagatgtgaaagtgaactatatgtagtacaataagagtgtgattagtctacaaatagaaatctggacctggatgtgggatgctatgtcagatactgtgagcctcaagccaatttcatgctgtcgcaccatccactggtagagtttttcctgaataaaacaaaatggctgcacattattaccaagcataatctatcaatctaaacaagagcacgaaaaatgctaagcaccagtatatgcaattgggtttgtgcatcatagcaccaattattgtcctgttgtatggacacaatccctgaggattgatttaaacaactaaaatacttgtctatctataccatattaacacaaatgggggaccagatgactaaatcaattatgtatttggtactgtgccaccatcacttaagctttttgtaaggaacaacgcattcaagtatgccaaattcattacacaatatcactgtgtcctcccatgaattactgcagcctgttggtgaaccaaaaagtccatcagattttaaatctcaattggtgtttcagtaggcaatggtagtttcggtggtattgcctcttctaagtcattcaaaacttataggagaagattgaaccacaaccaaaatgaactaatgcacaataacagaacatgtagtacaggtggactagtttagcacaagttgatgaaggcaaacttgtaaaacttaaagagcactcccagcaagctgtcttacagcaccaaaacaattatagctaaaatctatcacaggggggataattttggctaatcttccaacctagaatttgcttattgcaatgctttaagatgagaaaaaaaaacatgccttttaagattagaaaagcatacctacacctaacagtactactttttaattgtgaacaccaaacaagcaaaaggaaacttgtcaaagatcctttagaaatagtgtagaaggaaacctgtcccatacgtttctctattatgttctgtacgccaatccctttttttatctctttattactattagcacaatctaacttctttcttttttttgaacgacaagagcacaatctaacttgtgtcttggaatacagaattgaaacatttccacctaagtttgactaactgatggtaaacaaattcacaacaaaccacgatttctgcaattaaacgagaataccaatgatgaaaacaaagatgcatttaggtttcagtcatcatgaagtagcgataaactgcaatttcagatggtgtgatgacgcccacacaaattaaaagtgtgaattaactgagcaaaatttgcatcaagaaacaattgttgtcataactcataagtggcaactaaaaccaaacatgaatagcagtgaacaccaaaataaaaaatctccgcacaatttcaccacagctgaagacagaatatagcaaatattgcagctttatatgcacagaacctagcaaaaaggtgaaaatcgagagttcaattctccacaaaatgtaagtagcgaaaacaaaaattctgaagaaagaagccccacgactcaaaatgttcagcgtcccacccgcaccgcaacaccaaaaatcttaagatccaagaactgaaagaaatcgaggaaaaggggccaaaaaaacaaataatctaatctctcgattgcaaaactgaccagaagttcacccgactggaaagggtgggacttggggagggggcgattttagctcggggcgtaccaaggcgtggcgctcaccggcgtggaaggagaggcgctggtgggcaccggcgagcgcgtagagctgcgagagcgagttggcggcgccgcggaaggcgccgtagagcgcccggtcggcctcctcctccgccgcccgcgccgcctccgccttccgcttcctccccgccatcccggaccgacgacgaccacccgagccctcgggattcgggattgacggcggcggcggggagagggaggaggatggaatcctctccgcggcgcgaggaggaggaggaggaagacgacgacggcgagggctacgagcctatcatgcgtgcgtcgctgccgcgtggggcccactctctcagaggagtagctgtagctgccattggggctatttggagtggagaggttgggtgtgctagcacgtgggagcggagagagacggtagttgcactgagcgctgggtcccttcgatgtgggcccacatggcagtggcgctaaggagttccccgctggcggtgatgtacggaaacggatagcttagagcatcccagcagtccacataaaattgatcctccctgttcctatttgggttttttttttctcgcacgaatttcgctcggttttttttttctcgcacgaatttcgctcttttgttttgcacgacttttttaacaaacagtgcaaaaaaaaaccgggcgctatttccaattgggggcgacgtaggaaagtttctgggcaaaaacaccttgattttttataatgggtgaaggtaaagatatagatattcctatttagattaccttcggaaaagattttctcttcgtatctcttcttacttcaacaaattatctatattatatccatcatatcgcaccctcctatattttaacaatatctttcaactaaacaaatatactctattctcacatctctcttcctctctcatctagctccttttaccaatttctcctcctctcttctacttgtactccgagaggatagggagaatgaggggaagggagaggccggcgcggctcaatgcaggtggcataggggcaacatgggcttggcggcgtagggccgatgcgggtagatgcggctcggccaagggcggtgatggggtcggctctagggcatgcgcttagggccaatgtgggtacatgtggcttggtcgtgggcggtgctcaggtcgacacgcgtgcggcgcacggttggaggtgccgcgaatggagcttgtctgtccgcgacgaccacatcccttttcctagaaaatccctcacgtctacatttggtacatcatttcctagtcccggccgccattgccaccctagtcgtcgtcaaaacaagtagaggagaggaggaaggcatcgatccggatgagggtgggagttctgtttagacgtcaacagttgtggggtagcgtgaggagagatgaatgctaaatttgatgtttctctctctaggatggaggatacgctaaatttggagggtgggatggtgtatctgctggatcacgtttttcttctcctaaccgctattttgccaatcgatgtctggatggcatatctgctaggacgatactcttaggacctgtgtaaagaaaggaacgatgtaaatttttagtgatattaattaaagtgtatatagatctttcagtggtataaagctagacttgtaaattttggatatcatggaaccaatttcccgaagagaaaataaatcaatttctggtatgcagaagaaatgttatcatagacaggcagcgtataggtcccgcctagcgttctccacaagcctatctccttatggaccccctatggagatccagaggggcattggagaaaatcgcttttgtgctagtggttgcacatttgtggacggttggctgggggtagacccttggttgagctacatacactgaatctataaatggaaaaagtatgaattacccccctaactatcacgttagtatgaataaccctcctcaacccaatccagagcggttttgtcctatttggcgaacgtgtggcaatttagtcagtatttttctttttaaaaaatggtgggggtccacctttcatatatactctctcacctctctcttgagagtgccattgggatcggcgacccagtggccaatgatgggcagtcggtggaggcgggtggagcagcgtagaggctagcaccttggggtggcagtgaagtccaggcggcggcctaggatggtgatacatggagcagcgtgacagcggtagagagtggtccatggcagcgctgtggagacgatccggtggcaggcagaccccaccatatttttaaaagagggggaaaaagagatgcgagagagtatgacaggcaggccccaccatatttttaaaagaaaaatatcaccaatagttgagatttagttcagccacgtcattaaaagttgtaagcagctagattagatcatgatcatataattagccgttcgatcatcctgtttgcatgtccttcccttacgtatgatccagtaagtatagaagcaataatttcacaaagaacattaccctggcaaaagagaaaaaagaaggctagggtgtgttcatatttagaagaaatatggatggggaaagactgcaggtctagaataatacaaggcaaactatgatgccattgaaatccaagagaattgtaaagacaagttgtcatggtgcttgataaaagatggaaaaaaattatgtgaaatccttttatgaggctttcaaattccaatgacaaatttctatcacaaaaaactttggacattcaagattccgttgaaattgaggttttcctttggttcatacataagatagtataataaccaaagacaatctaaaggcctgatagttttcccagtcaaaaaaaaaaaaaccaaagacaatctaattatagaggagaatgggcaaaaatggataaaaggaatgcctgtttggagaagcttccacttctgcagcttcttccataatcagaaacttcctcaaatagtatagcttttggttcagattataagaagctgtagttatagaatctagaaagtgaactaagctgggaaactcagcttttctagattctcataaactagctataacatctagctgtttctcagaatcttaactcccccaaacaggcctagaaaatgtctgtttcttgacaaggaggaaataatacaacatcttttcattcaatgctcaatgacaaagattaatcagcaatgtagtgatctgctcttttaatcgttaactaattccgaacatgtaatacttcttcgggccgtactttctgaatgactttaattatgaaatgaaacaaatatagtgatgatagtgggaccgtgggagtggctatagttattttgcctatctggaaattcagggaaaatttatcctaaaagtcccactgaattaatattgtttgcttgcactagattaaaacttgggctatgttgtagacatcggaggaaaaggccaagaagactactatatgggagcccagtttctaagctgagttcttttgttgtccccaactcatctctacacgtgcacacttttcatactataattgtacgttttcttttgcaaaaatagatatatgaaagttgcttttaaaaaaccctatgaatccatttttcaaaaaaaagctaatacttaattaatcatgtactaataagttgcgccgttttatgttcacaaggaatgagttctcaacaccaagcaacaaactgttgtgttctttagccaaagttctcgactcacttttctcgtttctcatgcgcatgttttccaaattgctaaacgatgtgtttttaaaaaggtttttatgggaaagttactataaaaaattatattaatttatttttaagctattacgtctttaatcatgtattgatccatcactccgttttacatgtggagtggaggggttcctaacccctccaaaagaaaacagggttgagttataagtgaaatctccaacccgaggttaggatggaagaatggcacaagaagactagagtgaaaggaggatgatgaacaaattaagagctggaagttctctaggaaagtccgtgtgcaaacctttttttttatgtgctgttcaatgcttttgtccctgtttttttagtactggacctactggtgatggtggtatgacatgctaaacctcttgccaagtccctgatatgcttcatatgtggtcaagttgagtgtaaggtcgttctgtatacgaagaactatcttatctcattcccgacaatggaaatgggggctctcaagtcgttgataagaaaaaagagtagtagtgattgttgatttgtggcgtagatctccaattaatcgtcttcttccttaccattacagaagattatgttatacatatataatttgataatgacaaattctttccctgcatacttaatgtttgatgagatgcaatcagttctctttcttctctcttccactgaccatctataaaaatcaatttgatagtatcatgtgaatgcatacagagtacggttctgatgtccatccgaacccttctatctaccaattcattgggtcgcaaatgcaattgatacatctgccagccaaaaccttcatggttgctgggtgaaatcacttctatatatgtggccctctaagctctgcactggtcttcacatttctgatatcaaagatcaaactgatctggctctagttccttgatcatctcatacttggatatagccacaaaagaatgccactctgttgtgccaaatgtatttgtccattactattgttctttagtttcttatgttcttcctaggtcaaacttctctcatgtatgggttgcatttagtacttcattccttgggaatgggaagaaccaggaaagccagattttgatgtaaaaaacttgaaagtggtactaccgaagtgccacagtcaagccaggttgtcaaaggtactcctgaggtgtacgctgcagttgcaaatagaatgcctgttagctggtaatttgctatgatcaggattttatctttttattgagtgatcatacagaagatgatggactgccgtcttctctctctactagactcccaggtcatgattattgcgacttgtttccccatgactgtgaaatatatattaatcgcccatgcacccaactaagagtttatgaattttaaatcacaaagtacatgggatgggttagcatgaaagtctttctgtattgtttgctcgtagcctggggaacttgaaaaattcccaccatgagctgctgagtcatactcttgccctgttaaatacaatagtttttctgcaccatgcctgatcacatattcacatgcacattaatgttcgttgatgtgctcattcaccacaaaattgtaattggcaaccagcacatgaaccactgggttttgatttgtgtactgtcagaagctcaaaattgtactacatgaacccctgagtataggccatgccacacttctatggtgcggtggagctaataaatttattttaatatatatcactactaaaaaatgatttttcacagcgtcacccaatcattttcgctggcggctatttgtgaaaacctccagcaaaaatataacgatagtggggggcttcgaaccgccagcgaaaactaatcttcgctggcggccaagttaagcgggccgccagcgaagatgttgcggttttcgtttgcggcgcacctaacagaccgccagcgaagatgaagccattatcactggcggattggtgacgtgggccgtcagtgaagatgaagccattttcgctatcggacctcctaaaaccctaccagaaaaatatattttttgtggcggacctcctaagaccctgccagcgaaaatctatttttgctggtggtaggaatagtgttttcccgtattaaaagcctacctacccacataaatccatgcccgcagaaacccccacccatagaaatccgcgccgctccacctttctcactctctccctccgtgccgtcctccacctctgttcctccctccctccacgctgctccggcactctctccatctgcgccgccgtttgcctctcctccctctccgagccgcgccgcgcacaccaccgtcgcgtactgccacgacccttcctctccctctccttcagttctcggtgagtcggcgatggtgatggcgacgggaggtgggcggcagcggatctgacggcggggtcacagggttgcgtggatccagcggccccaggccccacgatggcgacgtggtcacgggtgggagactgggagagcttcagcgcggggcatagggcgtggatcgacgacagcgtgcccctccctcctggatctggtgtcggcgggtctgggcggtggatccgatggggccctcagcaacaaagcaacggggtcgcaggccaccgctagaagatctccggaggtcattgggtccggccgtgggagcgccgtggtgactctgccctcactcccctcctctcagatccggcgacgacgacccagccttcccctgccctccctctctcagatctgatgccgacgaaactgcatttccgttccctctcggcgacgagttgttgctcatgttgttgttcatcatgctatattgtgacatgttgttcttggattgtgacattgtatttgtcctcatgttgttcttggatttgtattgtgacaagttgttcaacaacgacagattggaacacattaggattgtaattttgacatgtttttggatttgcattgcaatgtggatttggaatgcaggactgctgcatctaggtattttcaaattttcattcaaaaatttctttactggcggttggagagcaggtgcggtgcatattttcaatttttttaaaaccaaaaaacaagcttcgcagacggctggcttaacacaaacgttagagaaaatagatttttcctggcggctcgtgtaaatcaaccgccagtgataattgattatcgctggcggctcgcgtaacataaccgctagcgaaaatcgattattgctagcatttgaagtcccgccaacgaagacctttgattttctctggcctttgattttaggcagctaacctatccgccagagaaatgattttagccgccaggaaaaaccattatttagtagagtattatatagttgacttatttaatatgtttgaaatattcatcttttcatgaaatctttatgtaaatagaaaaatatactgggcatgcttaaagtacttttgatgatatatagatctaatggtgttctttttactttacttattttgaataaatattgttagaccaagtttgagaaaaataataattgtgcatcatatgttaataacagaatagtagaaatacttcagagtccacacagaacccactaagacaggccaccaacgttgtttgataccggcggtacatcatgtctaccctcttaattaattaattgccatccacatgtgagctcaggcagctgagcagggtggccatgtattgggtctacctatggttctctgttgcttatatatgtcagtccttacctttgcctctcttacctttgccttttaattactttctatggcctgtttctccattattcacataccttctttgctacacacgtagcaaatatgagcttgctttaactgatgtacctagctagtgctggccatggaagcattgtgctatttgcttcagatcggaatgggtgtcatcagggagaagacaagcacattgttcttcatcatgatcatttccatatgttggctgtatactggatagggaataccttgatcccaaatacaatgtttcagaatatgtgtagtcggacttttctcattttttgaacatgtcattggtatggatgtcctagctagagagccaataaaaaattaatggaagtagcattttatttgaactcatagctatacataaagctattatttatttcttagaaaatctagtttaagttaatacccactgaatagcaatgtctactaccataaaccaataacttattgcaatgggggtacttgtcactttgctggcccttctctgatatttatatagcacaatttattcgtctttgtctttgtcatcatgcatatatagagatagtttacacctgcagggcaaaggaccagaattaagcaccagaaatagaggtctcacacactttcctcctctcgctaataagaatatatacatagctactctgtttacacggccctgtatctacgaattcctttacaagagaatgggtagggtgtcgtggaaagaacatacaacacttgcaccttttgtgttttgcaaggtttcactcaaggagagagccgcgtaagcgatgctcgaagggcatggaaatcgtgctagccatgtttgcgggatagaacctgtaaattttcattgtggcatgggactgtgacgctatgcacaaagatccccaaactaacccaagcttcctatccattttcatcgtcattctgctgctcaatcaacgcgcttatgatggattatgacgatgacaaacccatccatcttaacgtctagcgaacaaaattgagacatcaaatagacgaagggatggagtattttctctccggaattaatgagatgaaggatttgatggacttctataggaatgtatatcacatgtccatgataagcaccagacatcttattaatgtcctattttgtcccttcgtctcatggtaaaaacaacagcaagtaatcaaaaccaagtaatcagatgatgcatataggtaagaatatgtcatgacattagcaacaaccatatcagctaagaaaattcagcatgatggcaacaaatatagccgtcaacattgaaaaaaatatcataactaaactactactctgtcccaaaaaaacgaattgtgtctaggttactaggtaggattggtcttttcttttttggacggatggggtacaatagtacatagtaacaatgtaacacacaaacttggatctaacaacacaaaatcaaatagcaaaccgacaacaaatacttaacaaatataatcagtgctaatgagagaccctatccagataccttaactatagtactagtccatcaagcaagtagaaaatatattcctatcacctaaaataaaattttgttttaaactactcatccaatctacgatctgattacaccgttatgttcgtaagaattaaatctttataacaagatctcacacgattatattttgataaaaaaatacatattacttttataatatatctaagttatttttagatttcactaaattacttcttagacatataaaagtaaattaaataaagcctaaaagtaatttacatatattaacttaaaaaacgaaagtaacttttaaaagtaaatccgttatggatgtaaaaacacgagtctatctaaaaattaaatttaatcagcataaattatggaattgactaaaaatgataataaaataaataactcacaacattatgaatgtacgagaagtaatttaatctaattaaaaagtaatctatatatagagtcaatatcacaaaacaccggattttcaggcgcatctatcttaaaaccacaggtttagcaatttttatcataaaaccacacctcttggggcatatgtatcagagaacccaaatgccacctgtttcatcccctttcacgtttccgtttctcctgttcactgtttttgttgactagtcccgcaggaacagcttatctgaaatgctaatatgatcaacaatacaattactctcctatatgagtacagatttatgttaggaaccgttcactcagttaacatttggttcatcatgctgtcaagcataacccaatgcaagttctcgcaaaacttacatactcatgtcattctcaacacttttgtgctattaattcagctatcttcatcaaatcaaaacatttacagcatatgaaccaactcctgaacttctatgcatctactccttcccaagcagttctcctttgaggactttgtcctatcaacacataccattcttccaagcagttcatcctcaaggtcctctcttctcatgtgttcttgctgttgtgggtacggaagaggtggtgctatgatgggaaatggcgaacgggagggatgaaaacaacgaagggaaggaaaggaacgggatatgggtgatgtgataccatatgccctaaagggtgtggttttgtgataaaagttgctaaacatgtggtttttgagatagatgtgccctaaagcctagtgttttgtgatatttactcttatatatatatatatatgataaaagtaacttatatatataataaaagtaatttacaatatagatatttcttttatcagaatatagtcatgtaatatcttgctgtaaagattatagatcggataagtaatttaaaagatgtcattgtgccatgtataaatggatggtgaccatgtacatacccatccagctaacaaattgatggtttattttttctctggaacgatcaatctttgacagccgtacgtgcatgtagagtacggtaaaaacaatggcaagtaatcaaaacttgtaaccacagatcgatgatgcatataggtaagagtatatatgtcaggacatcagcaactatcctgcagtgactgtgagctaagaaaattcagcagctacgcaaatagtaaattcaaatgtttagtttcggtataaaatctctgcctagcagcacgcaagcaaatatgattctcaacattgaaagaaaaaaaaatatcagggctaaacaactcagaagcacaccaattaaaactagacttagcgactctaattaaattagagcaaaatgtaggacaccgtagttttgtgacatttgccgtagaactctctaaaaatatgtcgtaaagctttgccatacaacactctggttttgtgacaatttgctaaaaaaaattatagccattattattttcacattttggttacatgaaaaattagaaaggacacttctgctcctgtgccaaattgttaggcagggttctgtacttcgactaaaatttccaaaatttcaactcttttgggcctctggtgtgatataattcgtcctcgatttttttctggtttcaaataatgtttcaactcaatcaatgtctattgccattttagtttttttccaaatgttctaaaattttccgttaggaaaagtttagatatttgcaaatttgtttatatccagagaaaatttattcaagtttcaaattttccagttcacaatttaaaaaaatttcattctattggtccattggaaca

SEQ ID NO: 6310 - DNA, 4636 bp, Oryza sativa
tcctgcagccccccattgttcaccaacaatacatgaacaaaaagagttgaatatcacaggaactcaagccagagaagcaatcaccagccatgctcatttgtctcaaccaactgacggtaataaaaactttgagggaagatgggatcatgccatcgaccatgatgatgtggcagagaaaaaacctctcatagacaacaagtacaccagcaaaagaaaaaacccaatccaataataaggacatactgtaccaaggaaaaagatctttttaacttaaagagagatgtaccaaataatagggacatattacaaaataggtattcacatggaactctcatttggatgggtttcaaacatgttctctaaacttgtcctttacaccagtctgtcacacacctcatgcatgatactaatgcccatgccactacttgtgcagaagtgtcacacctcgacttggcacaatacaaacaatgtttaagagggtgtgccacgtagaacagcgaaccatcctctacagaaccgcgatgatggtaccaatccgaggaaacactattgaaaatttttatacctatatgtaaccacgggtaatcatgggtagcaaccttcatccagaaacagcaacatgtaaaaccaagtgtgattttggtttatttgtgatggaaaattggcaacgaaatatttaaccatgagttggttttgagtgagaaatttggtttggattattggcgattttaggcgtcagtgcttacgactaacgtgggtcaggttgcgataactgtgcctagaatcggatgtttggtttacgtgtgtgcaggtgatcgaagtcaaccgcggtcaatgacgaggaccgggactatgctcagggaggagcagaggtccagcacggtcaagaggccatgtgacaaggttggactgacgtcatgatccctgatggtcaacctgggtagacggcggatcgggtctagactcagggggagttgaggtccagaacgatcgacgaagccgtgtgacaaggttgagatcaagatgacgcgcgatggacgaacaccgtgtcgggaagacttcgcaacgggcttcacaaggtcaagtgtgcaagtgccgtgttcgcgaagaaaatggagaatagaagaggagctacagtacttcgaagtactgtagcatgcaggcatgcactggcgtgtgcatgagatggcaagtgcagctagctgattggctagctagcttacacatggggtcggttggcatggaggccaagccgacgcctgattggctccaggcccgagtgcttggctggcagggaggccaggccgagcaggcccaagacaagacgacggcccacggcatcggcaccatgcgtgggcaagtgcgggagatcgcgcaaggtgcgcgcgcgcggtggacacgcggcggcaaggaattcggcgcgcacgggcgtgggacccaagcggtttccgcgagcgcgcgcggagcggctcggcgagacgcgtggcggctccggactgggcgcgggcgtgcgtgcgcgctgtggaaaaggagacgggacgcgcacggcacgactgggcaacgtggcaagcttcgattcggaaagacggagacgacgcagatcgatctcccgatcggtgcatgctgattggctcggaggagccttctcacggatcatggggcccacgttgaggagcacgcgggcgcgcacatgggaggaatttggtgcggattctttgtgaaaagaggatcccggtgtggcaagagacgtggcttcaatccaggctacttccttaggatgtaaggaacaacgtaaggcctagattgcatctgagttgggggtttcgccctaagggcatttgtgacaatgtcttagggggtcttaggctataaaaagagaggtggatgcaatggtggagttgctccttttgtaatccttttgagatgctcgatgagagagttatggtgtgagtttggagggtgtttgcctgagaggcttttgtattaggattagtttggagtgtgtttgtccgagagattttaaatttgtgttaatgttcctctgaaggtgtatgtttgctcctagttgagcagttattttgcatcacctatgaatgaaatgatttgaaggatttcgttttttccttgttcatttacactccgcaatttaaattctgcttgcaatttgaactttgcgatgacgagtttttgctatctcctcctcacctctcttctagtttcaggaattccttttctcttcctcttctagtttcgggaattccttctctcttcttttctagatgcggcttctcaaatagccgcggttctagtaaggattttaagaaatccgtcttgatgagtattttcgggggcaagttttgaattgctatattcaccccccactctatagccgttcttggtctttcacaacaacaatataagggtgagtactttcaatggcttaggtgtagggacatggcctatccttcattttcttcaacctagactatgtgaaggggagagtgagtacatgataataagagagagagagtacgtacttccatattcccctagtcactagaaaatgtgaatcatgcaagctttgcaaattctttattttaaaaatatttttcaaaatttaagttgggtttttaatataccactgaaggtatcgagggcactaatattggaggttaataacaaagagaagccataaaacaaaataatgcacatggaaaaatattacaaccatgaacggatccaggaatacatgatcttttctgcatcatgcacgatcagctgcattgttcattcataaagtgagcattcatgacaaaattgtaacgagcaaccggcacatgaatccgtgttgttttattggtgtacagtcaaaagctcaaaactatatatgccataccaccttctatctagcagtggaactattgtctctatttttctaatgcatgacacacttgacttttttatttggattattctccttctctaaaaatatttgtacaaacgacaaacatactatacatgcttaaagtacttttgatgacaaatctagtgatgctcttttcagcttacttaactaagtaaatagaataaccatttcagtcaatgcttgaaaagaattttaattgcgcatcatatattaaaaaacagtgatagtacaaatattccagagacgtgcaaaacccactaatactggccaccaacactacttgataccagcctcctcctcaattttactcaatggtgtcctaggaaaaaaaattcaattgcctcagaggtgtaaagcagggagaccctatctctccccttctgcttgtccttactgccgatcttcttcaatctataatcaacaaagctctcaacctgggagtcctctcccttcctattcctcaaattgacataaaattccctataatccaatacgctgatgacacgcttatcattatgaaggcatgtcaaagagaagttttctgtcttaaaggcatcctgcaatcttatgccatatccactggattaaaaatcaacttccacaaatcttctatgatcccagtcattgttaatcaggataaaattgaactcctggcaaggacttttggatgtacaattggagcacttccgtttacatacttaggtcttccggttggaacaacaataccaaaaatctgtgaatttgcacctctcattgatagagtggaaagaagactcccggctataacgatgtttttgaatcagggacagagactaaccatggtcaactcagtcctgtcatccctgccaacattttacatgtgcactcttaaaatccctaaaaaggttctgctgcacatcgacagagcaagaaggcattgtctttggagaaagtctcatgaaattgatgcaagaactcactcactggcagcatgggacaaggtctgcagaccaaaaaaaagaggggggggtgggtgtcatcaatttagaatttcaaaactgtaccctcttgatgaagcatctcgacaaattctttaacaagaaaaatctccgatgggtaaaacttctctggacttcattctataccaatagatctatgccaccgcatgcattacaagactttggatccttttggtggaaagatatcactcgactaatacctctctttagaggtatcagctctattcaagtcaactctggagacacagttctcttctggaaagatctctggtcagataaattatttcaaaactccttgcccgctgtattctcttttgctattaatgaagatctatctgtcagagcttttcttcaaaataatttggctcaaaacttcctcctgcctctatctcctcaagctattcttcaattcaatgaattatcagacctcctggagaatattcttctcattgatcaaaatgatatttggacttactcatggggaccaatctacaagacaagaaaaatgtatgacctcttctttgctcacattacccctcaccctgttttgacatctatttggaaaagcaaatgcagcatgaaagggaaggcattcttctggctccttcttatggatcgattaaacacacgagacatgctacaaagaagacacctttctattcaggatggaccttcttgccgaatctgcaacttagatattttggaggatatg

SEQ ID NO: 6311 - DNA, 5754 bp, Oryza sativa
cttcttcatggaagtggtggggactgcatgctggcaaatttggttgaaaagaaatgccctcatttttgacaatgtccaaccatcacttactatttggaaagctgatttcaaggaggatttcactcttcttttgcatagagtgaaggaggaggacagacctagatatcaatcatggattgacaacattttttaatctttccccctttgtaaatattttttgtaattttgttgtaactcctatttatatttaatataattaccacagtaggagcctctcctactgtttacagtcaaaaaaaaaagtacaacatgtctacccttttagttgacatcgacgtgcgaattcaggtagtggcggagggtggccatatatgtcttgggctgtcggttcctctctgttgtttatatcattccttacctccccaatggctttctgcagcctgtttctctattgacataacttatttgttacaaacatagcaaatatgagttggctttaactgttgtacttagctagtgctggctgtggaagcattgtgttgtttgcctaggatcggaatgggcatcattagagagaagacaagcatactgttctttgtcatgaccatttcgatacatcggctcgatcgtggatagtgcctgtgttgatctcacacacaatgcttcagaacaagtctcgttgaacttttgtcatgatttgagaataacatagatacagatgtcctaattggcgaaaaaaaaaactcgaagtggcatttgatttgtgcacatacctacgtgaagctatattgtgtcgaaaaaagctacattaagctatacccactaaacaaataacaatatgacaaacaagtgctagcttaacaacgtgaatgcataagccctagtacatatagcctcctccccccttagatcatcagcaatacgtgaacaaaaagagttggatcttacaggatctcagcaagagaagcaataaccacccatgatcttttgtctcaaccaatcggcacgtgataggaaaaacttccataggagatgagagcaccatcggccccggcattgtggaagagaaaaaaaaaaggacatatgtcacacaaatgtctagacaagtaaaaaaagaacccaattaaataataaggacatatattgttccaacgaagaatatcttgataattaaaatatacatatccagaaattggaatggattaaaaaaaaccatatatgcacgcatccctcatttggatgggtctaaaacatagcatatacacatgtgtataggcctatagggcaggcattgaaaaaaattccaataaatatggattgacatgtatggccttgtttggatccttcgggctattaaatagccctatggaattttgctatttagaattattaaacgtagattaccgacaaaaccgattccataacccataggctattttgcgagacgaatctaatgatgtatattaatccataattagcagctgattactgtagcatcactgtagcaaatcatggattaatatacctcgttagattcgtctcgcaaaataggctaggggttatggaatgggttttgtcagtaatctacgtttaatactcttaaatagcaaatagccctccggatccaaacagggctatatatatgagccggagaaagcgtatcacattttcattctacaactcatgcaccacatgaacaaggctaactaatggtccttggctccttgccacaacctgtagagaagctagcccacctctaccggcctagcagatcaaaagcctgttaaacagccgaagcccctgttgaaaatatggtcatattcagcatattttaatctaaaatataaagacaatgaacatgacatttttaggaaatgatttgcaagtgttaaacagtagcaacatcatgaacatgcttaatatacagtaagcataggaatagatatggcaatgcaatgctaacattgcaactaacagtaccagtaaacactaaaataagacataaagagaagatgtgaggagattatactccaagaatgaccctccgctggagtttggggcagtattgcctccattggtgttgacgttcccgttcacctccttgtctccaatgttgctgttgtctttggtattgcccgacatgttggagagacgatgcagaggaagccagagcagttgcgtcgagacgctcccaaaaaaccttatcgcctgcctacccgtgcaggcactgaagcggacgggttccggaggctctactcgtcccgtacacctatgcgcacaggtgaacagaaccggggaaggatcttgcagcacaagaggaagaaccgaagcaagagtcaggaagaactgaagaacatctgtacttctgttcattcccattggcggagtatatgtgcacgcgggagtaacgttcgggatcatcaaccgcgcgtgtttaattcagtaaccgacatgctctttaatacagaatcgatttccataaccgacatgctcgttaatacagaatcaatcaccatgtgttattaccgtatgttacaaaaagagagagagagagagccgcccacccgcccctagtccggcacgcgcgcgtgcggctgtctgcccacaatatcaaccggtgagactctccactagctccatgtttaagttgagacctcttcacttagatttctaaggtggtactattacccatagcactaaatgtaggccattggaatatattgggacttaattgggcctagcccattaatctaacagcccctagcaaggcaaagctaaaattaaatcgtcgtcatcatgatttgacagataatgtttaagaacaagtctggtcaaactttaagaaaagagtaattttatggttcttgaggaggtaccatgaggtatcactttttctattgttaatttgatacctttaggtatctaggtaccatgaggtatcaaattttacactaaacttttgtacctcatgctatctactcaagaaccgtagaattgctcgctatatgtaaataacagaggagaatggctatatataaatgaacaaatagtaacttattgtcaggagtacttgtcactttcctagcccttctctgtcatttatatatagcacaatgcattcatcttttgtcattgtaatcacatttatagagttcaaagggatagaactgagtaccaaaaaagccgatcacaaacacttgattttctcatgcctgacaagaatatgtagctactccgccgatctacactgtttttttgcattgcgaatttcataggtggaaatgggtggcgtccgagaaagaacatacaaagtttgaacaattcatgttgcgcgtggcgtcgttcgagcagaagggagaggcctgctagcgatgccgatcagacatgagctggagattttctttacgcatcatgacgctgcgtacagagatcgggtaaatcaccctgtacccccgtctgatcaccatcgcactactactcgtaggtttagtataactccaacttctaaatttaactttaggagcttcaatttctaaatttaactccaagagttagttctagagtggtgttatgaagcagtctaaacccagctctatctttctagtttattttgtgagaacgtttcacatagctccactatcattcattttaggtagaactgaaagttaactgagtctaaataaagtttccattatcttaaaaaaaaggtagaactgaaactatttggccgggctccaactctaaaatagataaagtttaaactgaagccatgccaaacagaccctacatatgtttacattggaatatcaccaagatctgtagcagccaagaacctgtagctaataaacaccaggcgatcagcgagcgtcctaaccatatgtcccattggttcatgacacggcatctgccaagaaattccagcacagctagcgaattactaactccaaatctcttagttcggtcaaaaagctctagcggcaagcaaacaaatatggcggtcctgtcgcactgaaaaaaaattgagaattaaatttattcagcagcacacagaccaggatttaattcaatagcaacaacataaaatgcaggaacagaggaaacgaaccaaccaccagccactctcttgtgtctgaaccgcttgcaggaaccaggttgagcacctcgtgtgcacactgtagcaagtacggcaaaaacaaagcagagtgcaaacagagagatgaggagcagagttcggggcaattttcgttggttttctcttctccgaaagtaaattgcgtgattacaactaatgcatgagctaaactatttatggaccatatgccatcgtcgatcccacgttcaccacgcaaccaactcacgccacatagatcaggtgcacacacacgcagctggtcgacacggtcaccttgcgatcatgaaactttggcttcaataacacattagtttttctccatacttgtctggtttgatggccgtaaaggatgctaatgccttcttacctgagaatcgaaatttgctttcatacggtacgatcttgattcagcaaaatgtcataaaatgccttggctcaattgaccttctgtgtttccatatgttcagaaacttgacaaattcagggtgttattatctttctataataaaatgtaacgtaccacttggttcttcgctatttctcagactcaacaagcacaagcagtttcaggtaaagcttgattcttctcgtaagtgcttcagaacaggtttgccgttcaccatgttgtttgagatgtttgcttgtcaggtatatatagacgtatagtaaaccatgctttggcctgatcctttttcttcgtgaaaatcccactaaggatttcagcctgtgatgcaaaactctgatccaaagtctttgaattgcgtttaatgtatagatgattattatgaatagtagaataggtgctccttgtgcgcttgtgcccccaaatgcttctcggtcatgtttttacctgcatgcacatttttccttcattagcattaaatttctgggttaattaggttcgtgtcattacaaattttctgatatgagaaaataccactactttcgtgaaacctgtcgtgtgccattgaaattttttaaaattcgaaatataccatcaccattccttttttgggaaattttgctacagaacacttgttatatgtgattttagccctaggacactatccaaactcacttttgggggaaaacactccataaatatggtaatttgccagtggacaccgcgctgattaaaataatacttttcggttgggagagggagaaatcgcgtgaaaggtcaaaaatgcccttgggcccacatatcagctctatctcccatctctcttctcatctctcagaggcgcgctcgcacagggcagcgtcggtcgcggcggagatggcgaggacggcgaccggcggagtggagcggggcggcggcggcggtggacgacgagcacgcggccggcagagcggcagcgtcggccgagcggactggcggcggcggcgagcgagcgcgcggtaggagccacagcggagggcggctggcgagagcggtggaccccatggcgacggcgatggcgatgcaagctcccacctcgctcgccagatggtgttcaccgagaagcctcgcggccgtggctccgtcctccccctcctctgtggccacccctccacccacatccgcctcgccgtcggctgccgaccgccaactgccctccgcgcgcagcagccggcggcgg

SEQ ID NO: 6312 - DNA, 6509 bp, Oryza sativa
  unsure (1)..(6509): unsure at all n locations
cctgcacccctgacatgtggtcccaacggtatttttggcatttcacgcgatttctctctccttcccaaccggaaagtattattttaatcagcgtggtgtccactggcaaattaccatgtttatggagtgctttcccccaaaaataagtttggatagtgtcctaaggctaaaaccacacataacacgtgtcatctagcaaaattcccctttttctatcagctccttccatcgtcgggcccacttgtcagggtgtcttgagtctccagctgagctgctgcctcctctctccccagtaaaaacctagctagcctagcgcctcctccagttcacctccctcaaccatccttcccaacgaggccttttacaataccttccactaggagatggtagtagtgtagtaggaataaatccaattgattaaggggaattactcctctcaactccctctgcaatgcccccacaaatcccctttcattagggtcccgaatcgtttgccaatgatagtgccttaacccgtcatcttcatggccaaccattgagttttttttggcgcagccactagttcgggcgcacttcgttgctgttcgtttccaggctcttctccnnnnnnnnnnnnnnnnnnnnnnncatgggaaactgtggtccggtgttggaattgacctggtatatgatggatttcttttagtccatgttcttggatttcttttcatggattttttttacccatgtgtgtttggatttgatcgatgctatggttgaggctttgagcaatccacgaggagaaatcggaatccatcgagatgacgctttagtgaattcaggagcaaaaactggagtagcaattcatgagtagaaactacatagttggtgctttcgctttgcccaggcacgggagatggctttggcagagacgttgctgctggttcgccgaggcatcgcggagtcagtcccttcacacgagcataccgcggctcgaggtggcggctgaagattgaagacacctgacgagtgcatggatccatcgaagacggaagaggatgctaacagaaaagatgacggagatggcatggttcgaattttaaaaaatatatatatagtgacacataacagatttcacaaataatactggtacttttttaaaacggcaaatttctaatggcattgatccaattaacccttaatttttcgttgtagtttaccgcatgggtcttggacacgattcttattttttgttatattaaatgttcatttttccttcatttcaggaataatagtcaaggtgttccaatttgggaaaaacagagcagcagcataatcaattttgaagataaaaaatggaatatgtacattatcttgacttccacacaaatttatataaaatggaacttcacaacgagggtttcatgtgcatggttacaactttagtaatattatctaatgctgtagtttactgtgcatgtcaatctactgtaaaatgaatcctgattcagtctgtgtggattatgctaagcatatgtcatcctatagtgacgcataggtgaataatagtgaagattattaacctagaaccatgaaggatgttaagcatttggtatcaagtttcgttcagttgctggaaatcaagtttctaagcaataggtgatgaatgtttcattataaatttcacacacctggaattgtatatagaaattttatgaatatatagtcaggttatataagtgtcatgtcatgtaatagagagatgaataatgatttccattgcttgttgatactacactttgcagaagtaagaacaatgttgttaaagttagaatgttgctattagatgatattatagttttctgaagttcaaaatcaactaaaacctgaacggttttcttatacaattgactttctttaatatgatctgttgccaggaagtggtatttaatgtttgtgttgtggtcaagcaaggataaaatatgtagcttcaaacggtaatatttagcttctagcattggaaaggccagctgattaaagggttaggttgaattaaaaaaaaattcctttctcccccctacgttcactatttatcctttactcccaagagctttggttatattacctccatccaaaaaaaaacaacctaggaggagatgtgacctctcctagtacaacgaatctagacaaaatgttgtgggacggaaggagtatatgcttgcagggccatctatattgtcattccacagtaaacagcaatatcgttaatgatttggaaacaattgcaaaccttgtgtcgttaatgtgtttcttttcttcttaaatgggaaatgatatgctaattgtccaagagtttaattaaaccatgtgtaattcttgttatggggaatatattgtcaagatattaattagtagtcaacctatgcattgtactgctatttttattgattatttgatgaaggccaagattagattaaaagaacgttcttttccataaaccttgcaacttttttaatgctatatatgttcccttgtcaaaacatatatttttcagatgtcttttagtcatttcatttacaacatcaattattgtcgtagcattagcacggacatattactagtcaaaatagtatatacttcattaattgaggattgtagtatatattgaccaaacaaaaaagatttagtacaaagtacaaactcttttaacgagaaaacattttggttaaaatgtcaaaatagcactaaatttttgtactagtacgtctgtaaaaagaaggacatttaaaatttccatgcagacatgcaagaatcaattatagaataaatatttttttggccaattttcaattgaatagttgtcatattataactagttgataaatcttagaggggtaaatgtgttttttttaagagtaaatgtgtttttttaactatggatgtataacgtcaacgcacggtataagtcgatggcatataagaaaaagagctaatttcatagcatgaaagagctaatttcaagtggaatataaggccaccgataaattttcagtggcatataagaaattccctcgtatattaatttcatcactctaatggaattatccatgtgcctgactacccacagggagaattctactagcctttagttcagttcatggtaattgccatggaattattcatgtcaagtgcaatttatccgataattaattgtatgtaaattgatcacgtaacacagttagtaataataaaaaccaagcatcatatacagaactaataattagggttttacctcgaattgcacgcaatgatagtccgactgaagaccatgcattcctccatcccatgtccatttatcgtgtcgactacaggaataattccatcaacatatgcagataaacattgagcggaagatgtaacagccaaaatggacaaacgagatagaggcatagagctctgcaccaatccagcaacctagcttaaaactcgagacaattttgagatcgaattggcaattatatatctaactataactctaactttaatccctatcacatcagatgttttggacattaattttgagtattaaacataaactacttacaaaaattaattatataaataaatgctaattcacgtgataaattttaatttttaagcctaattaatccataattagcacatgtttagcatcacataggctaatcatggattaattaggctcaataaattagtctcgcaaataagtccagaattatgaaatggattttgtcaataatttacgtttaatacttctaattaatgttcaaacatccgatataacagggactaaaaaatttagtcccaaccaaacagtcccataatgaattaagtagggaattactacaacatatttagtttttcctagcacccccactactacatgatagttttacctggacgccaccccttttgtttccatgcggcccataactagaaccgcacgaaaaattgggggggggggaccggcgctggactgtcgcccgcacgggaaaatgcattttcccatgcgggcgtcttaacccgaccgcacaggataatctttattatcccgtgtggtcgacttaagagggctgtacggaaaaaatcgattttcatgtgcagactttttaagtggaccgtaaaaaaaatatctctcttttccctctcacccacttcaaattttccacactctctctctctcttcctttttcgtttttattctctctccccctttactctcctcgatctcctcccatcccctctctcggcctctttttctcctccccacccctctctctctactctctctctctgcgcgctaccgtgtcatgacgactacttcacctgatccacccaaaggcacggatgatcaaggcgacgaaccaatctcacacaatgggcagagaaggaagtctgcgcgggagagacagcctaatagattgtataactcgagtgtgtggacccagtgatgttgggctgggccacggggagtgagagaggcccattagcgcagtgctataagaggccggcagggaacagattgaagcgaacattgtagaaacacttttctgaaactacttcaaatctctccctgttcttgctattcttccccaaattcctcttcctctgctgctctcgttctcatctcaatcccaaaattcctcctcgctaaaccctaattcttagaagtcgtgacaatttggtatcagagccgctaccctggagaagccacgctacacatctcgattgcaactccaagtcgaagctatggagaagcagaacgtggatttcggcaaggtgctcttggagatccaggagtcgttggtggcgctgaatcatgcacaagccgagactcaagcggcggtcgtcaagttggaacaaggagccagcagttggaaacctcaagtggaagccgcggttcaagagctgcgtggggaggtcgaagagatcaagcagcaattggatctcattggcaaatcacagcaagcttccgcatcggcgtcttccccttgggttccgtcgacagacggggaaaggaaggcgccactgctgcccacgccaccgccaaattctcttatggcctcggtggagggcggaagcaaatcggctcaaagccatcatcagcttcagaatcaccggggaaagacttcaggaggaaacatgaccctaggtccaaccccggtcaagggtacgtatgactcacactccttccagtttccaaaatttgagagttcgggggttgaaggtggagaaattgacttcgaatttggggagagacaatataatcaccgtgttccaaagttggatttccctaaattcgatgggttagatccccaggactggcgcatgaagtgtgagcattatttcgatgtgaataacacgtttcctggtttgtgggtgagggtagcaaccatctactttgtgggaagggctgcatcttggttaagatcttctagagctcatttgcgttttcctatatggggggatttttgtgctgctgtgtcggaaaaatttgatcgcgaccagcatgaaaatttgattaggcaaatggatagtattaagcagtcgggaacggtttgggagttttatgagagatttgctgagctaatgaatcaactattagtttatgaccctggggtgagtgcaaaatatttgactcatcgattcattgaagggctgcgaagagagattcgtaatcctgtacttttacagagaccaaagaccctcgaaactgctctgtctgttgctttgttacgggaagaggtgttggagaatcctcaagtttccagtgttaaggaagtcaagagaatggaaggcaactctggttttcgatcggcaggcaagggaccgtggccgttgccgcaaccaccagggaagagtggaagtttctctttgatgaatcgtcctaaagagaagagaagcactgatactgttcgcagtccaacaaattcgacagataaagtgactactctcaaggcttatcgccgagcccagggattgtgttatatttgtgcagagaaatggtcccctactcataagtgttcagcctcagttcaactcaatgtggttcaggagctgttcagtctctttatggaggagggagctcaggaaagtcgggaaacctcaattatatcagatgctgaaacgggtgaactaatggcaatttcagtgcaggcagtacaaggttctgagccagatggaactatgcgcattttaggacaagttcaaggaaaacaagtgttaattctagtggattcaggcagctcagtgagttttatcagttcacagatagcagctggtctaaaagggatacaatctcttcctcgacaattgtcagtcagagttgctaatggtggtacactctgttgtgatgctatgattcctcagtgtgaatggcaagtgcagggtcacagatttagaaccactttgagaattttgcctcttaacagctatgacatgattttgggaatggatttgctgaaggagcacagtccaatgttagttaattg

SEQ ID NO: 6313 - DNA, 1318 bp, Oryza sativa
  unsure (1)..(1318): unsure at all n locations
ttcagctttgttctctctctcaagatgaggaatctgaagaaataccaaatgaaattcagttattacttcaggagtatgcaactgtttttgctgaaccaaaggggttgcctcccacaagacaattcgatcacacaattcctcnnnnnnnnnnnnnnnnnnnnnnnnatgtcagaccctatcgttatacacccgcccaaaaagatgagatcgaagctcaagtgactgaaatgttacagaatggcatcatacaacacagttctagtccttttgcatctcctgtactgttggttaagaagaaagatggatcatggcgattctgtgttgattatcgccatctcaacgcgattacagttaagaataagtatcccttgccaattattgacgagttacttgacgaattgtcaggtgctcagtggtttacaaagttggatttgcgagcgggatatcatcagattcgaatgaagactgaagatgaacacaaaacagcatttcgcactcataatggtcattttgagtttagggtacttccatttggcttgactagtgcaccagccacttttcaagggatcatgaacaatattctatcctcattacttcgacgctgtgtgcttgtgttcgttgacgacatcttaatctacagtcgcactcttgctgaccatatcaaccatttaagggctgttttccaaattttggttaaacatggtctgaaagttaaacagagcaaatgctcttttgctcaacagaaactgtcttatttgggtcacagaatcagtccaaatggggttgctactgaagaagataaaataaaggctgttaaagattggcccactcctaagtcactaaaggacttgagaagcttccttgggttagcaggttattaccgaaagtttgtgcaaaattttggtattttcagtaaaccattgacaaatctgttgcgcaagggtcagcctttcatttggaatactgtgacagatgcagcttttcaaaccctcaagcaagcactgatgtcagctcctgttcttgcaatgccggatttctccttaccatttgtggttgaaaccgatgcatcagataaagggattggcgctgtgttgatgcagaatgatcaccctatagccttcctcagtaaagctttgggacctcggcattggggtctttctacctatgacaaggagagtttggctatcatgatggcagtggatcactggagatcatatttacaacatgatgaattctttatcaggacagatcatcgcagtctctcatttttggctgaacaacggctgaccacgccttggcagcataaggctcttacaaa

SEQ ID NO: 6314 - DNA, 912 bp, Oryza sativa
caggcatgcaagcttgtccccaagcttcggcctgtggaaagcgttgacgtagttcctgaagattctcccaggtgacggcggcgggatcttggcgggaccaacagacctgaacttgtttcaccagtttagctcctttgcgaacaagcctgtgattcacacctgacaaggcgaaatgtctgcagcttcatcagcaggcaaaacgggtaaatgagactgtacccgttctacgggagccaaagccttcttgagttgggagacgtgaaccaccggatgaattaaactggaatctggcagtgccagacggtaagccacagttcccaccttggccaaaacctgaaagggcccataaaaacgaaaagaaagtttgcgattagtgcgagtgatgaccgactgttgcacaaacggttgaagcttcatatagacccaatcgccaacagagaaggagcgctccgatctctttaaatcagcctgatgtttcattctcatttgagctcgcagcacatgttctcgaatgagagtttgcatcttatccctttcatgcagccaatcaaccaactctggtgctgtacaagcagctgcagctgtcagaccaaaataacgaggtttgtgcccatacaatacctcaaatggtgtggctcccaaagaagaatgaaatgaagtattataccaatactcagccaaggcaagccatttgctccattgagagggacaggagtgcacaaaacaacgtaaaaaggtttcaagacactgattaactcgctctgtttgcccatcggattgagggtgataagaagaactcattcgcaattgagtgccagccaatttgaatagtgtcgtccaaagagtgctagtaaaaattctatcacgatctgaaataagagcctctggtaatccatgtaagcgatgaatgtg

SEQ ID NO: 6315 - DNA, 622 bp, Oryza sativa
ccaaccgggactaaagttacgatctttagtcccggttgggaactaaagattccggggggcctgacatgccctgacagcattcgaaccggggctaaagatcaaatatgcccgttaccctttgaaccgggactaaagatcatctttagccccggtttttattgcatccgtgactactgtggaaatcggccgaccgacgaaagatggtttctccactagtgacagcacctgatttttgcacgcctggatcgggtgcggcacctgatcggtagtctcgtcctataataaaagcaacttttcagcacaaatctagacatacaatttccatactaattgtttttttaaaaaaataatatttgcatttcaaagctcccaaatatatacacgtttctttgctcagaaggaatagcaaggaagtatccttacgaccttacctacatctaagccaacaaacggacggcaaacgtcaatgttaatcgtttgattgttttctgaaactatatcctcaatatgtgaagtgaaagcagccgtatgataaaattgaacggtcatgataataaatttagaagagatcatctgcaaattaacaaaaattactgtatagttaacaacttttaggcggcta

SEQ ID NO: 6316 - DNA, 3275 bp, Oryza sativa
tagaatactcaagctttagagtttagacatacacagttacacacacgtggacacgtcatttcgaggaatacctctgaggcttttttcggtttggaggagattgagggggaataattctatactacaatatcgaggtacggaataaatctcctccctgaattaagtgaacaaggcctaaaggaaaaaggaacagcccttgcaaaagaccacctcctaactagcatctaccaaagcatcaaaccagttactacctccgtcccataaaaattgcatttctagctaatttaggacaaaatagtaggattggaaaatgaccatgataaccttatttaatgaacccactacatgcacacattccatatatacaaatgattaaaaagaatttgagagaattaacacatataattagcatacttaataaaattacaagcattagcagcccaaattatgtgggatggaagaaaacttatatagatgaatcaattggttgggcctcacatggctagaaatacaatttttgtgggacaaagccttggagctagaaatgcaatttttatgggacgaagggagtaccacacacaagtccagacatcatcagtctcaaatagtaggatctaaacaaaagagaactagtagtattagatatctacgggccgcacgtcggcatgtctcaactctcatcttcagcaggattctttttttttttttgaagcaatactttagcaggaattcttcaactagttgttctaacttctaacctgctccggtcttctcctctctgcaaagacttccatcgctgtagaaaagaaatctaatgtatcacttgcataggtggtttaaaaaggatattttcaaagacaaaatcatctcactcagtccacaaatgccaactgatagctgctaaaatcatgatgcaaatgttcagttgttcgatgttcaagttttcaaacccaattgggtttgaaaacttgaacggagtcagctttgtattggcagctttaaacggaaacagagtcagcttgtattgccagctttaaagggaaaccaagtttaggctgggtactccagctaaaaaacgaaaacgctcagcagagaagattactcgaccacctcagtttctacacaactcttaacgaaaggcactggacatcattcctcctgagaactagtaacgctaaactctactaaagccctaactcccagggaggcagggaacaactacttttaaccaacactcagtccttgaggggtgcagatgattaacaatttcttgcacatgttccaggaagacattcaatcatcttccactgcatctgtagagaaaatacacgaaaaaccaaagtcaaaagtttgaaaaggaatttgttgctaaaaaacacatcatttcaaatcaatcattgcgtcaaacagaatatttcgatttgcgtcaaaaaaaatcaatcataagcttcaagtcacgacagctaacaaagcaactacttgacctttaccatatttaacccttgcttgccctataaaaagaataattgaaatcaacaggaataccagcccaacatattatatccctttttctttatcaaaagggcaatacccctccatttctattaaaagaaatgtgaaagtttctacaaggtcactcatgcctggacagttccagggcatcgaacaaaaagcttaaaaacagaaaatcgttcaaactaacacacagctacatcatcaggatctatcagtctatcactaccaggctaaactgacaaacacagaaaacttaaggaaaaaaagaacttctacaactgatatagctccccatccatatgaattcatttccaggatctgttcaaaccaataaaaacttcagaaaccctttccttgaaagctttttcttcgcgctttgtcatacatactccaacctttgcagagtcatcctccaaccatactgagatttgtagcttacagcaacattctgtctttcctccgacatctgtaaaacagaccaagttgaaatccaattacaagcacataaaataatttcagtgggatcaatgggaagtatttggttaaaacaagcaatatttctggccttccaaattgcccaaagaatagcagcaattccaactaacaatagctatgtcattgtatcaccattcagtgcccatcaacccaaagcatatgcttcagatctttaactggttttaaattgaaagcacaaatcaccacatttcaattgaatcttgccataggacattcaaaaaataactgctgtatcgtttcttttttttttccacagaattgacaattatcgtttcctttcttcaatccccttttcctcaagttatctttggtcaggatgctgtttttttatcattaaccaaatgaaagttctaatcttcaatgggaccttaattttccacacctttttatacattcctgttatatcagaggctaccgcctgcattttaatagctttgtaaaaggatttcacgctaaactcccctttttttttgtcaaagtccattctaactaatctttttcctctgctaattttttttttcgccgggccggcgaatagccggccgatgtatattaagagtaagaaagggaatgtattcctctgctaattttatattgtcacagtagctttgttgtctatactgcaacacagtagctttttcctctgttagttttatattaacatacatatccctaatccacatagtgtatacattgagtttgttgcctatactgcaagggtatccctaatccacatatatccctaattacactccaagcaaagcaaaccaaagggtaatcacacaggatgtgattggttgtttctctgattacaaagtttgcaaaactctaattgcatttttgctatcatcttggaaagtagatatataaaccaactcacttttcttgttggacagtggatatataaatcattctatgtcacctacattcatgtatagtgtccaacagaaaatgtatgctcgctttatccccagatgcattagtatatacatacgtatatatataacttgcagaatctaggagcagcaaacagaacaattactggacatgcatgcaaggaaaacaaagaaacaagctgcacttcatacctatgactatgatgggtccaggatttcttcaactgtaaagctttcattgctcttctccttagctggtggcctgtaactgtaagtaagtttcttctccacaacaggtacaatattcgagaatatcacacagagaagtgctgttgcctgtttatcggt

SEQ ID NO: 6317 - DNA, 9554 bp, Oryza sativa
atgaagtccttacaaatgtccaaagaggtgaacaaattcatgtgggccgaacaagatctcagagcactacaatttttgtagaaacctctataattggcactgagaccagtctcatgtgtggggcttctaagatcttaactaatatatcaacaaacattggagagtcaccttggccaggacgaagctcatggatccctgcttccagcgcttcaagcttcctgcggttaaacctgaaccagcagctaattatgctagctacatcacccatgttgagtttgtactcctctctcctgaggttccaccttatttttactcctttcttaaaagctatacaacccagatcagggaggaacaccagatcagctattgtaaacctggaagcaaatctgttggcagcatggataatctccaacaactttaaaagttggcagatgatttttcttgctggttttccaagtatgataagatatgaacagaacccgctcactcgcagatctggtggtatccatatgatttcaaaaagggaatcacctaatgatctgatatgttgttctaaaggaatgcacttgaaaccgccaatcctacattttaaaatttatctatcataagagaacaaaattcaaaagtaaaaaaataattattgcaatagatgaaagaaaatatacttacgtatcattgcatccacccctcatacgtggcattataagaaaagttgaatccctgtctgcttttaaagattcaagagtcaagctcttggcaataactcgcctaccatggtagacatagacatcatgcagagagacgcgatgttttgatagagctaaagctacaatgtcttcagctgaagacttcagtttcattgtcagtggaactatttggaagtccagcactttgacaaggatctgtgaggcatgaaatttagttccctggttagtcactcttttaactgaaatatatgtatgcatcccaaatgaattaaagtaaaaaaaaaatactacataggaaaacagtcccttagttacctggagtgttggagcagaatttttaactatgtcatgctcattgccaggggttgagccactacctgaactatgtcctttaatgcagcagtgtgcatgtgatgcagcaagatgagaataataggccggtgggactgcacagaaagaaaaagaagcactcaatcagcagcgaaaaaaacaagggaaagaaaatatttcttctatagttcatttgctagttccagagagtaatatgggagcatcacaaagacgaggctaggatatgaatgcaatggatttgaaaagcaaatgttgagcaacagctaacatgatgacatcgatggtgcattagcagcgaggaaaacaaagtaaagaaaatatttctgtagttccttaggtcgtgtttccttcagcacctgggctgagctaatgagccgcacgcattggtggcgcataacaagatgacagtagtgcacttctcgttaaaagcatatcacatgatggattgagtgcattaaagtaaacaaagacccaatttcaaacatgctaaataagaatctgtattgttgagaataatatgctaataagattagtccaattcacagtaaaaccattcacagaaactagtgtatacatctgttaaggtagcatatctacgaagatgcagaaataaaaagaaacaaagatgcaagaaaagaagactcacccacagacactgcatgggtgcatcgtgcatagctgcattttgccaacagtaggaattatcagagttgaggcagccgaaagactaagggagctaagcaactaagtggagatagagagaaatgaacttacatatagcaaagattgttggtcagggtctgaagttcatcagctgtaaaatggttctcatcataaaggacatggtaatgagttggcctgctagtaccctgagaaaaggaatgtcaacagcacacattaactgaaaattttgtaggctggaaaaatttgtgcaatctgcaaacagcttccagcatgggtttacctgtatgccagcatggctacacaggtagaaatagaactctgtaggatggcaaatctggcggtccttgacagttcctgcaggaccaaaaagaaacagattacaacaatatatccaattatcaaatgcctgaagaagtagcagacgtatgttctcagtagcaaccaacaagaacactgaccaggaaggatgtttccgctcttgtcagtcatgtctcgcctcccatgaacctctgggaaaagccttgtgtgatgccttttctggactactacaaatgtgacaggtggtagatatccctcctccaaagatgcacaagccttgcaatgtaaaaggattaaactcagaaaaaacaatgaaattggcttgtccagaatagataacacagacagatttatcatgatgcgaagctcacctttctgatggcatccatttcatgaagaagcacacggctgaactgaccttcacttacaccatctctgtagaggagaatgaccactcaacaaatttcatttaactggacatatcactgaacagaacagaatttgcaggacatacctatagaagattatcctctcaggccttctgccagtcttcttgcggaatgcgataaggaactccctgtaaacaagagcataatggtcagttcccagatgaacctacgataatatacaattgcaataccagattaaccacaaattttacctgatcatcccaccatttacaaccttcactggatctttaccaacactaaagagatcttctattatctcctgtctatgtgattgagcagagaccagacctcggtatttggtgatttcaggccaatccattgatgccacaacctacatgatcacaaagaaaataataccagtaaagtttgcatctgcgaagcaataaactttgggaagaaaaagatagttcatctattgcatcaagttatgcacaggatagcccatgatcttatattgtaggacagcatcaaatagaccaagtaatgaattgaagaaccattagctaggaatgtactaaccgcagcaatagatgatgcagagtcctctccaggtggagtgtgtgacatcagcaccaaagatgattgttgggacttctgacacaaatggtatgccattgcggataaaggctcgctcaagaacagtgttgcgccctccgacctggttatggcacagaattgtcatatttctgggggagaacactaaaagcacacaagataaagtccacagaattggtatcttcaaggggaaaaaaatacaagcccagcagatttacagaccttgacattgattttgagtgcaacattttccaaatattgcttgttcggcctgctggcatgccttggcaaacaacattgagatacaatgccaaggtcattctcacatacccttttaattttccctgtaaaaatcatgcatatactacatttaataaaaaaaatcagggaatggaaatttagattacccaaccaacaatatacataccataagaaccactaacttcaagcagaattacaattaaaagctgcaggcctccctttccctctctggctagcagttctgatgttctgctgtgaacatccctcagagcattctctatattgttaggatttgatgaccggacatccacaactggtcttggattgaaagactacaaggtcaagtcaaagttaattgcagcacatataattattaaactgctttaatagcattgtaactatgcaggagttaccattccagtggcattgcacatctgaatcaggtcaccacagaacctttgtacctcctctggacgcattcgtgaaaaactcagacatgtccagttatccacagttcctccattgatcattttctgaaaaaattaacaagtattagagtcttcctttaaacacatcagaaagtaaattatgttggctaagtagttgtatctttacaggttctgaaattatgtttcagtaccggcttgtcaatttcagatactctccaacaaaaaataaagctaatgaacaattcataaagaagttaagcaagtgtacctagaattcactttcaaacaaaggcaatacaaaattaacttgagagagaaattgagttgtaataataaagcaaggcatcaccttgttaatcatgttccactgtccaacactgggtgcacaagttttctcccttccagaatcatgatacttcaactgaaaagcgcaaagattaaggttgttagaaattcccagaagtttaaacaatgcgaacaaaagaaatggaataaaacctatatagtaccatgggtggaggcagcacacgggctggaacagagactaggtcattgcagaccttgatgccgaactcctgagcaaacctatcatctgtatacttgttgtggagaaccatctgatagaagatgaaatggaagtcaatacaaatatatgatattatcttcattatctcatcaagaaaaaaaatagccttatgttctacggatatgttattctaagaaaatgtgcagaaatagaaggtcattcaaatgtgagccaaaatccaaaagcataaaaatttggctctgcatctacatggtattgtacctcatgaattctctgttccctctgctgggggcgttgacaggttgctctaaggatgttggtcacctgtttgttgttaagcttcttggagtacctctgcccttctacaatcttgcacacctgcaaccacatttgcatgaacaaactgcacacagcatgcacaattcaggtagaggtaaatggatgatgaatcaatacctccataggcaagtatacaggacgagaatcactgccagactgtaggcagggccaagaagcatacttcagtctgtaattgtacctatcccagaagtactgaacaacagtcttccttgtcccattatcatcaacaggaaatctaacaacatcaaaccaggcatcagtttggagaaaaacaagttatgttcatgctataaaacagtgaacaagcatgataacaaaatgcaggtcctaaaaaaggatgacaaagcactgctattctcaggacagtgtgcaatcatcctttacacatcaatttagaacattgaaggacatttaacagcatttatagatatcaaaggcacattgaaggacatttaacaacattgacagtatggatatcaaaggcgcataaattgatatctaaggcataaacctttgaaaaggattaaaatgtttctatcacaagtccacaaacaattaatgtactaccatgcccaagatccataaacaaagacatttcaaatattccatcaacaatctacattgatttgctgtatcttacagcatgtaaacaaaaagataattatagcagaagcagaggaaagataagtacatcagctggctcataggaatgggggtaatccctgttattttgtatcttctgatttggtcctcttggtggtttgtttcaatgcgaaccccacgtaatgctttctttatctgaacatcatgaaaaatgagttagtatcagtattgcataattttatgaattccatcagtaggaatattaccttcacacgatcccggtctgacaaaggtcttgaggtgtcacgtatgttcaggaactcctccacaaattggatcactgtcacaggcttaaaaaatgatgttgcagatatatctgaatgaagcataccgaacagtagttagtatctgaaaagatcacttccattcagcgaaaactgataaacaataactgacaggtaagtacctatattcagcgaaaggcccatctgtgttgggcgcaggctctgatagtaacctctccaacactcaagtccctcaccaatgtcaccccggtgaccaaactgggtagagaagaaggatctggacactgtgacataactgcagaacaagtagttgtcaatacagcattattagtaccctagtcagtaaataatcaagcaaaagtcaaaacaaacacaacaaaaaaatcatacttccaagatggcgactacctgaggacaacatcaatgactgacttgaatggtttcttggggcatatccctctgtcttccaagcaaaaactgctggaggtggtagaagtctgttctgccagcaatccgaattgtgatcttgtactccctctccgccctgcagaagacaataaacaataacctgagactacaaaacacataattcataagaacgaaaatatctagctagcatcatacaaacctttctttatccttcttttcgggatcaattagcttaaccacaaactcctccgattcaaaagggagtgaaccagcagtatagagactttttcttccatcataagcaggcaatttgccaccaagagatgtcttcccatgcaacttgatgagctcattgagtacttccctatttgttgctcttgattttgactcaggattgattgaaacctgtaacataatccaaaaggaagataaacagcctttctataggacatgaggggcagattttttttttttacagagaagatcttagggcaaaataagaagaactcgacagatgaacatcacataataacaaagtaattttagatcagagcagttagccatcactaacacaccaaactactcaaaattcagtgtgtttcgttcagatcagagcctattgattgtggaaatcaatgtaggcgaaaaccaccaaaaaaaactgaatgcccaaaagtaacgaaacctaaatcaaggaccaacagaaatcaaacaccaaaaaaaaggtgatagaggttgatcttctccattcaaatcacgatagaggtagaactacgctgctatactacggggtacgacacttacatggggcgggcatccatggcgaacgctagagtctagaggggaatcgccggcgaagcgttgaggaataatggggagggaagaatggatagtgagagttgaagattatagctaggttagaacatgaaggatggatgatatagggtcttctaaggcccacaaaagcccacataaactgggccacagctcagaaatcagaaatcgacatcttcgaaagcccaaaaacatagaaagggactgaaaaacgttattggacaaaaaaaaaatcatcggaacaagtctataactcgatgtcttactgttgaacacgactggttttttttcgcatggaataaaaaagaacgagatcccgacaaagacaacaattaaaattttcaaaaaaaaaatgccaaaaaaaatagatttgctaaaaatatgtcgccataaggcgccgtgacggagagtcgaacccagaccttcgaagtcgcagacagagctcctaaccaaccgagcacggtattgccattcactttattgccaaaacaaattaatattgaattttaaagtacttatacactaattaccacccacttacattcacttacacggcacttacactataattacatatgtaatttattcacttacacggcacttatatagcacttacactataattacatatataatttagggacttacaatgtaaatatatgctgactattttttggtgaaaaatatggtgccataaatatagctactccaaaaaaaaaagcagaaaacacagaaccaaaagccacatatgtattcacagatattttaaaagtggatcaccactctatttctgcaaccattccagcgacaatctttcggatggagtgtttgccgaagatcagaaaaagggaatctaccaggcgttcagtgacgacgacttgatgtaaaagttcacgcaaaggcttcgcttaattacatgaagaacagattagcatgttcttacaagaaagcagctagaagctcgcgcgaacacatccgcttacacaaaaagagcagtctccaaaaaacaacaaaaaaaaaagtcaaaccgagaggtagtgaacgggcacagaggggcttcgtcgtcttcttccatctctcacacacaaaagaaacataataacttgtaaagcagcacaaaacgagatgcaaaagcactgaaccgagcagacctttgcttgcagagggaaagacccgaactagctctcacgagggagagatcaggccgacccttgtacgaaatcagcatttccaaaacacagcaccaacgttctcaagaaaacgacgacatgcatgtaggccgggcgttgagcacatgatatgctttatgcgtagtacatgtgcatgcatgtcaccgaaacgaacacaacggaaggcttcgattcgaagttcgaatggtgagctgcgtgtgctgcggccacgagatttctctcgacatcagccagatctctagcaccaaactagcagcgagcaccgaagtggaaaagaccaaacaaaaagggaaggatcaaaaaacggaccagaaactttatgcaagaaaggaaacgcgacgctccgaccaaacacccacgaactggatgagattggaagccacgctccatacaaaactgcaaatgaaagaatcagagaaacgaacttgcaacgacacaaggaaacaaaaagcatccaaaatccgtgcatacacacacccatacagaggtaaattaaacagatccaaaatccacgggagcacagtagtaaacggcatgcatggagtacacgtagatctgggggtgggaaggagaggaagaggccgggtaatgtgagctcacatcgtagtggaagaggttcactacaccagatcctcacacctttaacggcatatctgtgacggactttagcactcgtcagtgatgagggtcatctttgacggttcttacaggatgccgtcatcagtgaggcatccttctgcaacccgtcacagataactagttacacctctgacggcttccacttctggcccgtgactagttacctgtgacgggttgcatgattataaaccgtcaaaggtgaggttaactcacctcaaacggtccggtcactaggcccgtcacaggtgtgggtggggacttgactaggtcagactaatatgtatatctcctctctccctcacactctctctctctcccttatccacacattttctccaccgcgaaaaaaaatgcctcgggcgacgccgctcttgcgacggcggcggaggacccgacgccctcgggcaaggcggcgctggacggcggctcagcaatacgtggtggcggcggtggtgcggaggcgaagcggcgaggtggtgcggcggcgcgtggcggcaacggctcagcggtgcgtggcagcagcggcggcggtgcggaggtgaagcggcgaggtggtgcggcggcgcgtggctgcgagcggcggcggcagtacccccatcctcctcccccttctttctcccctcctctcccttctcttatttctcaatccggtttttcttgaagtggcagcggcgtggagttctcaacggcgcgcggcggtgctgcggtgcggcggctcgacgcagcggtgaggaggcgaggaggaggtgaacggcggcgccgcggcctccatccccgaccgccgggggccacctccatcccccaactgacgggcgccacctccgaccgcctggctctagatccgtcctccac

SEQ ID NO: 6318 - DNA, 1917 bp, Oryza sativa
ccccgtcggctgcttccgggtgcagaaggcgaagagggcggcgtcgaggagcagtaatagggacgaggtcatccgcaaggaggagagcaaggtcgcctccaggccgagctcaagaaggtctagcgcgccaaggagttcaagcccaccgtggtatgaagaagccctgcccggcaaaacccacaaccatttattcccttcgtttttgttgctcgtcaggtgattgatgaattgcttgcttgccatggctgttttatgtgtgatgaaatgttcgtgaagacttttctgtgtgatgaaatgttgtgtgtgatgaatgcgatggcaactacccagaagcactttttttttgtttttttttatcgaaatctacatcagtgacgggtgttgagctgtggttgtggctcttttttccttttttttctttgggtgatttttctcatatgtgaccacatgacacaacccgtcaaaggtgtctgtcacctctgacggacctacacccgtcaaaggtgagttaagtcatcagtgaccattgatctgtgacgagggggtctatccgtcacagttgagggtttgagcccgtcactgctagcttgttctgctgtagtggttgttgtcggcgacgttgacgaggaagcggttcgcgcggatcatcacctcgttcccggccgttccgaaccccggccgccgcgtagggtgggcgagccccttcttcgacaccggcgcctcgccagcggacgcggacgccgccgctgcgggtggcgctagcgcggtctccgacacgaacagcttctgctcgacctccttggccgacggcgccctgtagacgacggccggctggtgcccgggttgctggtacttcggaggaggccctggcggccgcggcgtcatccccggcagcgaccacacggagccagcagcgggacggtacggcggggctccaacgccgccgccgcctcccccaccgctggggtcgccgcggccaccgcctccgtcgcagtaggccgccatggcataggggtggaggaaggcaagaacgagaggggagggtggtgacgaggctagaattgaaagggaggagggaagggtggtggagtgggtgatgtgatcctatgggaatgcaagggaagggaggggagggggggtgatgcaagtgagaggtgaggcgatgagaaaaccctaaaccggtggaaggatcgagaaggccaggagggggtggtgatcttaccgctcggtgactgtatgctcgtctgtacggaagagtgattaagctaatcaaacttgctactcaagtctaggttttgacaatgtaaattaatgtcccctttttttttttactctccctgtcctgtttttaccatgtactgtactccagtatggtgccacgtgccagacacaggcaaaatggaggtcgatcgaaggcaaccataaccctggggaaaatgaaacgaggcgaggtctacagtctacacgaggcaaaatggaggtcgatcgaaggcaaccatttcccatgttgcttttggcatgcaaatatctgctccctccaacctcgatcgcattcgagaaggaccaaaccgtaccgtatagagacgttgcacaaaagcagcagatgagcagaacacccacttccgcctgacaccgtcgctcgcttcccctcggcccacctcacaaaagcacacaatcccgcacctctctctctctctgtgcaaagcaagccaaaacgaaaagaagagtctgatgcacaagaatgaccaatacatgcatgcacgcatcatgcgcatgtttaatgtttatgcactcgctatagctaatgaggtgtttagaagacatggactaaattccactaatttaaagtattaaaacataaactaataataaaactaattgcataaataagaactaatttgcgagacgaatttttta

SEQ ID NO: 6319 - DNA, 2673 bp, Oryza sativa
tcgcaattagctctcatctatgcaattagtttaattattaatctatgtttaatactccaaattagcgtctaaacatccaatgagactggactaaaacatctaaacacccctaaactaatgatcatatggcgcgtttgaggtttggattcctggattacactagtagtcgcttctctgcaaatagattcgccaagatcgtttcagctgaaagagtcggcgaggtgcagcgagacagaagcaggcacacgacacgaccgcccggtctatcgctcgcagtgccgttccggtgaaaggcgcagcgcgcagccgcgttgccaacatgcttccatgcatgcgtccaaacgggtccacccagcccagacgtcatgcatgaatgcccaaaaggaaaaggaaaaggtgaccggccgatcggatgagagggtggcgtacgtatgcacctatgctgcacgattttaattgttcccatgcgctacacctgcatctctccgattccgaaccagggttctttgacttctttcccctgagttcccaactcatatccttcgtttttcacgtacacgtttttcaaactgttaaattgtatgtgttttacaaaaaatttatatagaaaagtactttaaaaaaatcatattaatctattttttaattttttatagctgatacttaattatcacatggtaatctatcgctccattttccgtgtggagaggaatggtttccaaccttgctccattttccgtgcggaggggagggcattcccaacccctcggaaagaacacaactttaatcttttactattttttataagacaaaattggttctggagcattgaaagttgtccattttgattttatagcatccaaagttcacatctcattttgatagcatcagaagttacatccgttgcttctttttagcattccgtccaaacttccgttagttttattttctaattagtattattcttcaacaaaaaactaaatcaaaccccaatggtggccctcttcctcttgcttgtcacctccaaacagcagtcgtacaggagctcagagcggtcagtcatggtgcgaacacaggatcgatgctggctccacaagctcgtcatgtaatacgtacgtgagcccagcctcacaagctgatcatccgcaagccactgtattcgtccgcgcttgctaggtgtgatctatccactttctaggctctagctttgcccggacagcgccatcgtcgatcgatctcatctgccattccgccatgctagagcttgttcaaatgcggctgtgccgcttccgagttcgtccgcgcgcactgctctcggtctctcccctagatgcgtcatccgatccatgaatgcccgaagcgaagcaacgtcctccagattattgtcggcacccttgagctcgctccgacatgctgctcttgagctcatccatcggcccccgaagcaccaccctcgcgctcgtcgcgggctcgcctgagtaccgacctgctcctccttaccctggatccgttgtctgctgacccaagtcaagagccgccgcctctagcttgccagaaccagccaccatccaaggctccaactcgctcagcgctatactgtcgtggtcgagctcacctgctgccttgaatcgaagagtggtcaaccataggagggagagtgcaggaggaacaagacagatgtaggatggggtgaggagacgaactgctgacggaatgctaaaaatagtaacgttccagttttgagtgctattaaaatgaaccataaacttttagtgctatgtaaccaaaatcgagtactttcgatgccatagaaccaattttgcctttttataatggcataatatcaactagcatggtggcccgcgcagattgcgcggctagcatcattatattttgtctcatataatagcatatatgttttctcattatattattcaaatatattaaaatgacaacataattttaaattttgcattaactttacaaaactactaatatgtaatattcatattacattttatatacgtgttagttattaattatttttaatatcaaattttatttatttgtaaattatatatattcctatatggactctaaactcgtcttttaatatttattttttaaattccgaattttctgtaaattgtattgctatatagactctatgttcttcttccaatattatttatttttatttctaaatttttattatttctaattgtatttctatgtggattctaaactcatctttcaatattctttaatttttaatttcgaatttcagctacttctaaattgtattcctatattgactttaaactcttcttcccatgtttttcttaatttcgaattttagttatttgtaaattgtatttttatacggactctaaactctacttttaattttattatgtttattccaaattttagttagttttaaattcctatatggactctatactctacttctaatattccttattttttaatttcgaatttctatttttttctaattgtatttctatatggactctatactctacttctaatattccttatttttaattccgaatttcagttatttcctaattgtatttctatatggactctatactctacttctaatattctttatttttaattccgaatttcagttatttcctaattgta

SEQ ID NO: 6320 - DNA, 24367 bp, Oryza sativa
ttcgaatttctatttttttctaattgtatttctatatggactctatactctcttctaatattccttatttttaattccgaatttcagttatttcctaattgtatttctatatggactctatactctacttctaatattctttatttttaattccgaatttcagttatttcctaattgtatttctatatggactctatactcctcttataatatttatttttagttccgaatttcagttatttcctaattgtatttctatatggactctagtctccactttttttaattttattatgtttattccaaattttagttagttttaaatttctatatgactctatactctacttctaatatttcttattttttaattccgaatttctattttttttcttaattgtatttctatatgaactctatactctatttctaatattccttatttttaattccaaatttctattttttcctaattgtatttctatatggactctatactctacttctaatattctttatttttaattccgaatttcagttattttctaattgtatttctatatggactctatactctacctctaatattccttatttttaattccaattttcagttatttcctaattgtatttctatatagactctatactctacttctaatattccttatttttaattccgaatttcagttatttcctaattgtatttctatatggactctggtccccccttctaatattccttattttttaatttcgaatttcagctatttctaaattgtatttctatatggactctagtcccctcttctaatattccttattttttaattccgaatttcagctatttctaaattgtatttctatatggactctgctttttctttttatttctaaattgtatttctatatggactctgttttttctttttctccgattaatttgagaatttctaggctatgagagcgaacgtggaggctcatttttctattcctttaattatataatagatagatagaagatagatttcctcaagcatctggcatgcatgtatttctaggagtaaaagggcatcttgtcggatacagcgtcggcggtcgatttaactctgtttaacgtccaagaagaatgagaatttgcatggaataatgtacgaaacgctatgcattttcacgtcagatggcatgaaggaaacgattttgctaaatcttcgcctgacagatttttcgttggaaatcactcgttgtttcaaccctccaattcatagtgagattcgtgctaacaacatccaaaaaaactaacgcagcttaccaccaaacctcgggcggtaggattcaatctcacgatcagatgcttaccatgtgcagctcttggctaattgagcatgaggagaatttgactgtatatataagacactattaacgttgtaatataaaattgcattttatataaaattacagtcatatataactaaaattgtatttgtaaattcagttgatatgacatgtaaatgcactataattttgataaaaaaatctgtaagtaatatatatttgttattttatttaaaatataaaattgcagtcatatataattaaaattacatttataaattcagttatataacatgtaagtgcactgtaattttgataaaaataatgtgcaagtaaatatgtatttgttattttctttaaaatataaaattacagttcaatataactaatattacatttgtaaatttaattgatatggcatgtaagtgcactgtaattttgataaaaaataatatgtaagtaaatatgtatttgttattttttttagtccgttgaatgcaaatataataatagaaaaaaatcttagtgatttgtgttgttaaaaatcacctgacaaatggatagacaattccgataaggaaacacacgattcatgccgggtgagcctagcgggtggaaaacaatgagaaagcccacgtgtgcctataacgtgtggattcagagcaggtacaatagcagactatagccaaagcccacgtgtggctataacgtgtggatttagagcgggtacaatagcagactattagccagctataaacatattttaatgagataaaagatgagagagaaaaacagtggactacaaatttatagccagctgcagcacggacttaaagacgcaatgtgtgtataacaggtgagatcatatattaataatatagtaagcaactattgtataaattagctattatatcgggtatagatgaattggagatagtagtgggctctactattaaacttgctcttagcctacccagagttgcagtctacgttcctcgatccaaaacaagtttatattgacccatgtgatattcctctcatcactcagcccataggtgcatcagtaccgtatttataggcctgcattaggcttgtttgagtttgggtcaactcgttttttagctcaggagatttgtatttgaaaactttatacgtatagggttcgttcgttttagaggaattgtaaaggaaaagtataggcatatacagcttttaggaatggacactaaattgtcattcttttcagagaaacgtcccgttgtcttccggctagcttcacaagatggtggactagccggtctaaattcaaagcctcacttctatatttgatattaggtacttccctaatatctacgtttttttaattgtcattcgtttcaaagaaatcaaaggaaaatttcatatccctccactccaatctaatgtttttaatcctttgatcgtttagtacgcaactgtagaaaagtttcatatggttattaatccttaagtttacacatgtattcccattctatttctatgttttccctattactatgttttaaaaatattgcaaaccaaacgagaccctaaactttgaaatacatagagtcatagatagcatgtgcgtatgaactgtacatgtataaaccctgtatgcataaactttgcacatataaattcgagaataaattttaaatacaatttcaaaaacaaccgaaaacgtatatgtgacccgcgaggcccatgtgcatggcttctcctctttcttgtatttgggctgctaaaaaaagatgggcttaacccaaaatagaagcaaccgtgggccaaaaaaagaaacagcaaccgtgggctttcattagctttctcggtacaaacgagccgtcgcgtcgtttccttccgtgtcaacgcgaagggagcaccgagcacgagcgatctgtttggtctctgtagggtcagaaaaactcccttccggttttcaaaaaaaaaaaaaaaagagagaaaaactcccttccacagttccactgaaaaatcgtgtgtctttttatcgttatctgtcacggcataggtaaattcgctctaattcccccaccttttcgccgcaaaaaattcccttccacgatttccacgggtagtggccgcgcacgtagaatcataacccccacccacgcacacaacccaactagtattactacaccttttgcgccccccctaatcccgggcccaccaagcttaatcaaaacggatcgtaacagccgctgtttcaatctcaccgagcctttcgcttccaaggacacacacatacataaacagtttgtttatccaaccacgacgtggaaagctcaccaatctaatgccaaattaatcgagtacgacacaaattcaattgttatttgattagtttattaaaatttagtttgatccggttcgcgtcaaattccaacctggctcgactcgcttccaaccagacgccactgcctttccccttccgagcagcagcggccgcttcgcttcgcttcgtttgcttcgttcgccggcggcagcggcggtggcggcggcggcggtgagggtggggttggggattgggggatcgaacctcgctggatatatagatgcctccatggatccaatcggcgacccatcgccgtcgtcccggcggtcggtgaagcggcggcctcccgcgcgatcgccggagctgtcgccgaaggcgtggggaggggaggcgccggagctgatccggcggctggaggagctggaggaggcggcggcgcggctgcggggcgagaaggaggccgcggagaggcggcgcgggagctgcaggccgagttggatgcggagcgggcgtcggcggagacggcgaccagcgaggccatgctcatgatcgagcggctgcagcgggagaaggcggccgcgcagatggaggcccgccagttccggcggtacgccgagggccgcgaggatcgcgagcgtgaggtacaggaagagctcgcctcgctctccgacctcgccgcctcctaccactcccgcctccagtcccacgggatcgaccctgattccttctccgacgacggcgaggaggagcagcacgacgaggaagatggcgaagaggtagaacagatcgacacggccgcgctacagacagatggaagcagcggcggcgactcaatcggtggcatgcaggtgaaagccatggtcgacgatgatgaggaagagcaattcacccctgtggagaaggagttcgagtacacggtggatgtgaggtgcgcgagctcgacgacgaaggtatccggggcggtggttgttggggagttcatgggggagggcaatgcagctgcagggggattgtacgccagggtggaggctctggaggcggacagggcggcaatgcggagggaaatcgcagcattgcgagcagagagagctcagctggtgatggcgagggcgatggcgcggcggctgtgccgggaggtggttgctgaacagaaagccaagaaagtggctgcctcaccacgaagcttctcggtgctaggggtttgcaaggtataattaagtttgctcacattggtcactgttagtaagttgttcacatttgacacatttatgctaaatttagagagtagcacatccagagaacttgtagtttcattagtttagattgatgaatttagttggagcatttctactactgcctaaaaccaaatgaaatgtcaccaaatcaatgacggttgggatataaaattgcattcttacatttgtaagacaattgcttgtggtagctgtagatgaaatcaacctatatggtgggtagaataactgcattgttatagattaaagcagtaacacaacaatttgtagttggtacttttggtacaacaatggaaatttaagttgtggttatcaaagtttttccttatgttgtacacttgagttgagtagatctaattgtcagtcattttagtcctttggcatatctagatttactgtcgctggactcatttgtagacttgcttatgtgctatatgtggtcaactgctaaaaacttgagccccagttttgtatgggagttatgaccacagtaacatgtgttgcatgctacctcaattccatatctggaattctataatgtgtgcttgccaacatgtgaagttgtaattggaaggaaatctataaaatatttcagattgtttctttccaacgtaacgtgcagttaataattgatccttttcgatttgtctaaagttctctctctctgtgttccataccaatagcattggctatgtttatctatcagaaactaacagtcttgtatctctttgccgcagtgggtgctctcgataatcttttggagaaacagaagttccacagccaggtagatttgatatgatggcttggttatgaatatatcattatcctttttgttctgaatcgagaccaaatctgttcccatggatatttcgcaggtataccttcggtctgtcaactacgttccttggcttcctactgctgctcgacagatccaccatgttgagtccctggcgtcgtctgcctagcccacggcaatgaaacgaccttcccgggcatattgtctataaatcagaacctggaatcattgtttacagcttcattgtaagtgtgtgtattgcattctttgacatgttcttcctcttcttttttttttcttttttgcccaagcacagtttttgagctgtatgtttttatttggaagctttgagcttgtcttatagtgtgtttattcaaacctaggcgtgaatagcttgtaatcaggagctaactgacatgctctgtgtagagtgtacatcatagtaagctatggaatctgatcttgtttgcgcggttgccgaaatgctggagtgttgcatctggtttgcacgtctgctctgtctaaatggtgtgtattttgaatggcaacttctacctgtgagtctgaatacagtggcatatgctttggagaaaatcccctgtgtacccttgaaagttcacctaatcccttctatacccctgaattttgctcaatcccttacatacccctgaattttagtttggatcccttctatgccctttccgctagttgaccgttagttgaccgttaaattcttataaaaaagtccattttgccctttggtataaagaagcatataaattaatagagtatattgttggagcatagaaatttgttatatgagactattatgtttatgagatagttatgcaccatattatttgccataaatatacttttagatatgacataaaaaattaatacttatttattagttattaaaaaaattttagcttatgtgttctgaagtaataaacaaatatgttgtattactatgaaaacacatatgctacataaaagaacttttaataactaataaataagtatcaactttttatatcatatgtaaaagtaaatttgtcacaaataatatggtgcatcacatactcataaatataatagtctcatccaataaatttttacattccaacaatatacttcattaatttattatgtttcttcatagcaaagggcaaaatggactttttcaaaagaatttaacggtcaactaacggtcaactagcggaaagggtatggaagggatccaaactaaaattcaggggtatgtaagggattgagcaaaattcaggggtatagaaggaattagatgaactttcatgggtacataggggattttctctatgctttgtgattgtgtgatatgatcaatgcactcagaataggaatgttgctgaactgcagactgcacttcttatgtttcgtttgtcattgttttccctcgtagctgctccattgttatcctgaaatagcctgtcaaatttgcaccgaaattcacagccaggcctatttctcaaatgataacatttctacaaaaaaaaaattcagtttcagttttgtttggtcatgatgaacgcattactatcagcaatgtgcaactggattgaatacttccgaaatctgcttcaagaagtcaaaacatatataaatgccagggaggaagacaacgatgcttacagccggtgccaaagcttgtaatcaatattttttcaagatttcctcgtagggccggcaacgccattcactggtgtgatctcaaatagccatgagcatttgggagcaggtcaaacaaaatgagtctgtttcataaagcggaaaaaaaaaagaacactgtattttacttgtttgccactgaaaatttcgcagggccccacatgtcagttagacagcaggcggtgaatgataaattggtaaatgttaggggcatatatgaaatttattatacactgtctacatactatggttgtgtttagattttttggcgtgtcacatcggatatacggatacacatttgaagtattaaacgtagactaaaaataaaacaaattagagatttcgcctgtaaattgtgagacgaatttattaagcctaattaatatgtcattaacaaatatttattgtagcaccacattgtcaaatcatggagcaattaggctcaaaatatccgtctcgcaatttacacgcaatatgtgtaactagttatttttttcgtttatatttaatactccatgcatgtgtacaaacattttatatgacagggtaaaaaattttgtcagggatctaaacagccctatatatgaacttgtatcaggaagctcccatgcatggtaacagaaatttacaagtgctctactgcttatacagaatgatgaaaatttacaaagctttgtaccaccatgcaaaccgctgtgcgtgcaaaatttcaatttcgcttgcaaaattttgcacgaacagcacggataattaactggcttacactctcccttcagtttaatctgctgtgagctgtgcactatacaattataccatcgtacattctagatgaattctacgtgaactcacggtttgatttagaacaaggggctgagctcctggatggactgcatggtgttcggggagaagacgaagcccggcgacagcagcatgccggcggccatcatcggcgacggcaccgccggaggctgcgccggcgccgacgccgcggcctggcgctggccgagggtgaggagcagcgggtcgccgccggcgccgcatgctgccgccgcgccctgctcgaccatcgccggcgcgtcgtacgccggcatcatcaccggcggcgccgccggtggcttgcccgtcagccgctgcacgacggtcatgaactcctgcggccgcgcgtgcaccaccttgggcgtgtgctcgtacacgatcaccggcgccgccgccgacttcttggatgccccctttgacgccgacgacgacggcgacgaccccctcgacgacgacgacgacaccttcagcggcagcggcctcggccctcgcagcccacctctcctcgacgacgacgacgacggcatggccactgtcatggtcatggcagctacctagctctccttgctcaactcgctacgagtaaagagtagcttcttgtaaagttgcaatgctttgacaactataatggattgcactttgcacaatgcttttatagatagagagtagcaaacactttcacatgctactagtagcaaagacatggatatagtagcaatacaatgtcaaaagtcgtcggtcaagtacggcagattcatgactgctgactttttttttcgatcgattacgattattagttagctagcgaaaaagtcagacgcgttacacacttccatttggaaggcaagccaaggtaggttagaagtggttagcgatagttttcacttattggcttgatgataactagtattactttcggctgcagcccaacgttgaccaaatcggtatggattatcagctcgcgtccacagttgatcagtcaaggcgttcaaacgccaaacctacctagctatactttactacgatgtcaaacacttttgtctgatgcgtaatgtggtaatctcaagctgtggggttgcaagtttgcagcgacaagaatgaacttttctccattgtttgaacgggacaagaatgaacttttaatcgagtgttcagatatagctctggtttaattttatcttcaatctctgacagttcttcagaaagaacccaagccgaccacaagaatccctagctaagactctgaattctctgcacgtcctttgattgatcgtttacttggaaatttaacctagaaccccaattgcaatcccacttgggatatgaagctgaaaaaggcgtcctgttgatcgatttggctagctgcttgtcctaactaaccactcaatttgacaaaattcaagggcttaattacgtacgacttcaatccgagcagaattcgactatgggactgcatatatttccacggcacagttgagtccaccgtcgacgtatcgtctcttaattaatcgggaggtcgagaagatcatgacatccgatatccatatatatgtaccagtaagaccgtttaagtttcttaattagtgacatcatgtaacatgaattttgatgtttcttaattaattaactggaagatcgagaacaccatgtactactagtaccattttaccaggcctgtttgaagttgaaggagcaggtcaactgacgagtagaaatgcctctgttcgttttcagtccttgagaaattcagactttcagagtaggaaacgcattgattacgcggccaaatgaaatacggcgcccctataaacgagggatgcatacagtagtacagtactcgggatctgattgcaccgtcaaaatcaaaatcaaagcagttgaattctactcggggttaaaactaagttgacgattcacggatttgtttaagcaggcatcgtggtcgccatgacgcatgagcctttgaccctgcaatgcaaccaccgttttgaacacaagaattttgcgtgtcactacggtttctcgtgaaaggctttgtgtaccgcgtaggattgctacactcgtcggctgtgaagaaacatgcatggtagagcaacactactcctagcatgtttgtggtagagctccaacttctaaatttagtttcaggagttgagtctagagtggagttgcggaactgtctaaagtctaaattcagcttcaactctttagtttattttgtaagagcactctacctaactccgctcttattttaggtagagatgaaactgtttggctgagcttcagttacagaagaggtggagctggagctcctgtgccaattgccaaacaggcccaataatctcatccagaatgttaatgtagagagtggagttgtgagtgcatgatttttgtttggaggagctttagattacgagaaacatgggtaggaattcaactggtgagaatatggagaagttgtaaaaaccaatttttctttcctagtttattttttattctacaatcacaacttctcataatctgaaaaaaaaaagtttatggagctttggattcaaaggagaaaacgcaacccaaaagttcctctaacagaaaagcccataaatattgtgcacacacgatacttcataggaatctagtgacatcaaggtacttcactcttcggttgtgttaggggggtggagtggtggacacaaacatatgtgtgcgcatatattttctgcgtaataaaaaaatctagtaataaagtttgggagtacctatgcatctttcgaaagatttttatgatcatatcacacagatttttaatctttagattaaaatctaatgggcacagtaaaatgcaaaaaagcaactaaaaaacaccataatggacactaaattaccatatcttcaagaaaaaaaccaaatctaatatatatttcaaaacttacatgcaaagattcaaaaattacactgtaacttacaaaagttacactgtaaatttcataaattacactataatttacaagaaaacacactgtaaatttgagtgagaaaatcaagtgagagataagaagaaatctttcgagtgagatatagcaaaatcgataaagttttgcattgaaaccaaacaatctcatgctccaatggaagggaactatggaagtcctatgtaaatgggccaaagcccaaagtaatacacaaaggcattccaaattcgggcctgcacaagtaaaccgggcgatccagaccgtccgatttggcgcgcagaaacccgatccgcatcccgcgccgtcgcctcaccgctatccctcatcacccactgacaagttgccccacacgggaggatggcccacacgtcagtgatagagggtccgttccagggggcccacctcatttggtcccaggaaggtccttcctcgctctcctctctgtcttcctccgatccacccaaccaaccaagcgcccgccggcctcgtcgcgcgccgcccctccaccgcccgtctccaatgccaccgccgccgcagccgcagccgccgccgccgtcgtccgcgtagggtaggggcatcccgccggcgatgggcaacaactgcgtcggccccagcgccgccggccagaacgggttcttcgccaacgtcgccctctggcgacccaggcccgccgacgcggctccccccgccctcccgccgccctcctccgcgccgtccgaccaggcgcccgagcccgtcacaatccccccatcggagcactcctccaccactcctcccgctccaccgacccgtcgacccccacctccgccgcggagcagccggcgaacaaggcggcgcccaaggtcaagcgcgtccagagcgccgggctgctcgccgattccgtcctcaagcgcgacgtcaacaccgcccgcctcaaggatctatacacgatcgggaagaagctagggcaggggcagttcggcaccacctacctctgcgtcgagaaggccacaggtcgggagttcgcctgcaagtccatcgccaagaggaagctgctcacgcaggaggacgtcgaggacgtgcgccgcgagatccagatcatgcaccacctcgcgggccacgccaacgtcgtctccatcgtcggggcctacgaggacgccgtcgcggtgcagctcgtcatggagctctgcgccggcggggagctgttcgacaggatcatccagagggggcattactccgagaaggccgcggcgcagctcgcgcgggtgatcgtcggcgtcatcgaggcgtgccactccctcggcgtgatgcacagggatctcaagccggagaatttcctcttcatccaccagaaggaggattcgcctctcaaggccatcgatttcggcctctccatcttcttcaagccaggtatggcgccctcccccttctgggactcttaacaatgcaattttctgcaaaaatatatactttagtttcagactttaataataatgtgagcatttgtggtgactgcaaaatgggagactgtatatgtgatgatagcattagcattggtgctatgattaatctaatcagaagattttttaaaaaatgtatttatactttgagatggctgtggggattagttccatttccatgggttaatcttgttgtgcacctcattgcacacatttgttatagtctcgatgctaagtcctaaacaatctggtgccaattagagtatatcttactgattgttgacgttgattgtaggtagaccatgtcattgtggtttgctcataaaaattgctccagaacttaattttttaggtgccaactaatactcatgagcatatatacgtgaagttgagagcttacacctggatatttaagtcaaattttctccacagctatatgtgaactggcggatgtatgtacaagctgtggggacagctgacctcacagctttttaaaaaatacccctgattttcatgtataaatccaaaaaagttagaaaattgacatctcttaaatacaagctattagtaattgaccccacaggtttatatttctagctccgcttacacaaactcctagctatataaaatatgaaacagaaccgtctatatgttggcccaaaatgacagtcttaaagtagctatagacaaccaagcatgggaggtactatgtgtttgacataatcctgtatatgccgcacatgtaattataaataccattcttcatgtgtcatattaattggaaaaaaaaatgctttgacaggtgagacatttacggatgttgttggaagcccgtactatgttgcacctgaggttcttatgaaacattatggtcgtgaggttgacgtctggagtgctggtgtgataatctacattttgttgagtggggttcctccattttgggatggtgagatcatatgtattttagtgaaatatattttccttgtaatatttgcaatactaatgcaattgataaattggcttctggagcagaaagtgagcaagggatatttgaacaagttttgaaaggtgatctggacttctcatctgagccttggcctaatatctcagagagcgcaaaggatttggtcagaaaaatgcttattcgtgatccaaaaaagagattgactgcccatgaagccctatgtgagtagtttggaagtatgcaatgatttgtaaataatttgttgctagtcatctagttttacttccaaccaaatttatccaattattttctaggtcatccttgggtctgtgttgatggagttgctcctgacaagcctcttgattccgctgtcttgagtcggttaaaacaattttctgcaatgaacaaactaaagaaaatggcgcttagggtgagcagcatatttttctaattagtaatatataggctgctttcatgttgatgttttaatatgaactggtatgtgactgcaggttattgctgagagtttatcagaagaagaaattgcaggattaaaagagatgttcaaaatgctagacactgacaacagcggtcatattacactggaagaactaaaaacaggcttgcagagagttggtgctaatttgatggactcggaaattgatgctctaatggaggcagtaagtattctaagaaggtttctgcgcatctattcatcatttatactgaaattagtaaacaagattttgttctgatctgtaattgtatcttgcaaacaaatttccattttattaagtttttttaatcaatttttacaagtacccaccggctccttttcttggttgtaaagtgttgaccacgaaagtactggcatacacttcttttttgaaacgtgagcttgcttcatgttgaatttttatcagcatttgtaatatatggtaattttgttgagtgaaaatagcttgtagtgaggaggattaactgtttcctaaatgcggaacattctgggaagtttggatatcagtgtcgctttacatttatgatgaatatccactggacttttggattgtttctcaaatgaagctccttttcttgaatatgtcaggcagatattgacaacagcggaacaattgattatggagaattcattgctgcaactttgcatataaacaaagtagagaaggaggataagctgtttgcagctttctcatactttgataaagatggcagcggttacattactcaagatgagcttcaaaaggcatgtgaggaattcggtataggtgatacccgtattgaggatattattggagacattgatcaggacaatgtgagtagaaaatgctaagtatttcatgataaattgacaaacaacaattttgtctcatttgactatcatttgtgcaggatggacggatcgactacaatgagtttgtcgaaatgatgcagaagggaaataatgcaatgggtaaaatgggtcagcatagtaccggaaactttggcctcggggaagcgctaaaacttcggtaaaaggtaattgttgttttctctaccttttctttcctatcctttgacaatattagatattctttcaaaagtgtatgatttcggttgccttacttggaaccaggattatttgtttcagtctataatcatttatcttatgataaaaattgggcaacgaactacttatgacggtaattgtgaatttaaaataagaatttcctctatagagtaccatctgcagtagcccaaaacttcaaattttgtgaaataggcctgaaaacaaacttttgcgcttcttctaaactaaaacatttgtagtagctagtaaaaaaaaaaacatttgcagtacttatgtaatgcagtttaaagtaactcctgatttggatcatgcatgctctgaatgagaaaaatcaccacgatcttctgttagaactttggtcattctcatcagggtaactgattgaacacgctcattaagatagtgtaaactcactggttgttctggtttctttataggtgctgctaagtgaagttgccatttcagacaatggctataacccaacatcagaatatcacgatgtcaaactaccatcgcaccgcaagctaagttttggatctctcaagcaaagctaccacatgcctgagcatcaacatttcctaggcttcaatctcacagttaactgtcaatagaccgaacaatgcagcaatttttgacttgcctccattaagtatggagtccatctttgtagcccatcttcattggcaaaatacgctgtagctcatcttctttgtatatgcatttgtaagtagcgaaagcacatgagagcaggcaaggttcgtttcttgctgctcctttcccaacctgaagtctgagaccacagcgacaggaaggcatcagcgttcctgagtagaattccagttaatttgttacattttattcttcttgtttaattggttagcagttttagctgttgtcatgcgtgtaagaataggctttgtactataggtctgaccaatgaaacgaatcttctccgttaattttgtccggtctattggtgtatgtaagaagaatggaagagaccaaattaattgatcttgatgatgacgattgtttgaagtttcatgttgccggctgcgtcttgtgccggcggcgtgccggccgtttactgttgctgccaccgccgccgccggctggtgctgaatttttcacgacattgacagggaagttaaaagcaaccaagcatccaaaaagactatttgtgtggtgaaaccgagtggtggatttggtggatggtgcgtagcgctgataccttcttacagttttgtctcgctatttttttttaatgaatcgacgagcgccaatttcattgaatagagaatgagaactttataaagcgaaaggaaaaaaaatagctaggacctttggtccgagctaactaaaaaaagccagctattaacacttctcgcctcctgctaaggcccaagttttggcctcttccttgatcttggataaaagggaggtagctgaaagctccttctgttggaaggttatgtgattcctttcgttacatatctcgctattttaaagataaataaaggcaattgtgcaaaaggaagaaaaaacaaaattattttttaggatcatattttatgtatgaaaagtgaaaactcaaaggctttttacctttacgtcaaaaaaaaataaaatcaagaggcatccttttcaggatcatgtatcaaaactcaaaagatgtttcctgaccactcaaaagggtcaccgataaatgattgtaggagtcaactcaaaagcattggtaaaattaaagcaggagtattgatccaattcaattttcaaatgtttttaaaaaatgtgaaataatgtaggagtactaatccatttcggtcttcaaaaacaataatccaattcagttgtttttccaacaaattttaaaaatgtgaaattatgtagcagtattaatccaattcggtcttcaaaaacaataatccatttcagttttaaaaatgaaataaataattcagtcttcaaaaacagtaatccaattcagtttttttaaaatgaaatgaataattcggtcttcaaaaacagttatccaattcaaataaattatattcggtcttaaatagcaacccaattcagttttttaaaaaaataaataaataagggcccaaccgggttcgaaccggtgacctattgatctgcagtcaattgctctaccactgagctatggaccctttgttgtgattacaaaagtacgttcatttataaccaaatttaattcatattccttgcgaattctacccgctacagccaatgaacagcgtaaagaaagtgttttttaaaaggagacagcgtgagattgtgctttatctttcgttagatagagaggaaaaaaatacacccctggtaacgaaaaaaaaaaagaagggaaaagcccgtctttacagattatacgctcttaggaattaactgtggtttagctcctcctagggttaaattttggcttcttccttaatttttgctaggagggtgattgtcatgctctcgttgtgctcaaaaattcgttggttccacttcttctgtatctcccagacgacgagaaggattagggagcgcaatccctactttggcacacatgtcatgtttgtaaggtttttccaccaagcttgtacattttctatagcttcccaccaggagatagagggttgtttcgttttctttacgtcagagaggacaatgtatattgttttgccaccctctcgtcgtcaggcagtccgaggttcaagaccctattctagatgattagtcatgtataggacttacattctcccggcgctcaagctttccaaatcaattggatgaagcatgtgtttgttgtacgaaggcatttgtgtctggtaggcataacatcgtaaaaatgagttcgcactttatagtgatttcagcttccgtcgacaaatacgcactacatttaaccttttgtgattagaggcactaaccacaatttatgactattgtctgtaactttatataagtgttgatgcaaagtagatgtatcacataattgtactaactgtactaagtctttgaagtagtagatacgctactccgtaaaaataaaacacaaatattgttctcgtcataaataacactcactctctctattctcgaataaataaatccagtataacatgtgacatgtaacactaactaaaaaaagagagagtatattttaatcaacaattagtagtatgtcatagattaatcatgctcaccacatttactcgtacccaatcatgttttggtagtagtattttttaagagctctagccatcatcgttttcttttatcaaactgaagatgggcatattttctctctcagtcccataaaaaatcaatataatactggatttgacatattctaatactacgaatttggacgtacctttgttcagatacgttgcattacaatgtcatatcattcattttttttggacggaagaagtacacaatatcacacatgtatcacttgaatacttttcttaacacacgcttaaatgaaagaaaaacaacaatgatatattaatgatctcacaattctcactattttttattaatttaaaatacaattatagacgtgggccactttgtgtacatgaacggatcgaaccggaaaagtaaaacttatcgcaaagttttccaaccactctgctcatcaacccctgtttgatcttgaacgccaattcttggtcagacgtttggacgacaccgtactttctttgagacgagacgatcagccattggaggcccatagagcaggtacaatagtaggctataagccagctgtaaacatattttaaggagataataaggagagagaagagcagcgggctacagatttgtagccagctgtagcatagactctaagacacaatatgtttatgacatgtgggaccaaatattaatagtgtagtatgtaaatattgtatgaataagctattagattgactatagataaattggagctagtaattgactatattattgaacttgctcttacacacgcatttatcgcacccttgaccgaaatgcgggtctaaaaataatatctcggaacccgaggcgaggggaggggccccgaaatgcacgtctcactcgcaggtgggcccccgaaatcgcgagtggggcccacgccgcagtgggacgtttcgtgcgcacccactccccctccccctacgcgcgccggtcgattttagcaacgcgccaatgcccccacacccccgcaatagcctcactagataagggggacccaccgctctccggccccacccgtcattggcgtgaggggaagggagagagcgggaggggggatttttatttaggattttcttttatctgtatttttttttattaagagaaagccttcccgactccgtctcctcctcccctcgtcgtcgtcgtcgtcgtcgtctcgccttcgccgccgaggcggaacaattccgcggggagttcgctgattaatccggccgaatcctgaaattccccttgagcaatcgggataaggtagcctcgcaatccatccgcctttcctttctggatagttttttttggtgtttttcttttgatttatccgtatcgttttggttggattggggacatgggggcggggcgatttcgtggtgtgtttatggtcatttcggtggatttcgtatcgtggatggggggattattgagcaagagactcctgtttcgatcgttgattggcttggtttggcttaatccgtggaattttttgctcatagaattcgttttttctttggtcatcaggcgtaggaatcttgcgcgggaagggctaatcgaatcggttgggctgtacggagatggatgagaaggtgaagatggagagcaagctgtcctccgcggcggcgttcgtggagggaggtgtgcaggacgcctgcgacgacgcctgcagcatctgcctcgaggccttctgcgacaacgacccctccacggtctgcatccgccgaggcgaaaattttggattcgatatgattgtgatcgagtcgctcatttgttttcttggtgtggatgttggcgttttctcttgcaggtgacgagttgcaagcatgagtaccatctgcagtgcattcttgaatggtaatgtttcctttctggcctattggaacgatattgttgtgtggtatttttctttttctgtacttctttgtggagctggtgatgcattgcaatcgatatagatgtaaattacggtaattgaatcatgcatattgcataatttattctaaatttaaggttgctcttgtttccacaaagcaaactatccgatatcaccatgactagtttgcttgtgtacctcagttttatatgatgcaatccctgattgtttgttttgtttctgtatcttcttttccacctagataaagtaaaataaacggccgtgcttttagctgcaaggtgataaaggaagttagtgtttgtctggcaattgtgactacacatcgatggttcaatttaactgtgctgtgggaactacatctaatttgctagggttgcaaaaaatatttgtttttaaggtgatggtgattatctgcttacactatttgaatctatgcttgttgtcgtgctgaaatgctgtcagtaaagtggaactaccacatgatttataagacgaaaatgggatcttacattccagaaacagatcatgtgttaggcatcgcaatgctcttcaaccatgatcgacttgtatatgaaggttaatgatgatcacctgcactttaagcagtgaataaccatacagaaattctccagcatatgagactcaataagccattaaggagcatatgatccacagactttcattatttcagcaataccagcctccatcaggtggggcaggggttgtaaggcttctgagctgcccagctggaagatttccttcatctgtgcaagcagtctagaacgatagctttgtcgtagtagttgtgagcgtgcagttcttctgcagtatgctcataaaactatcgttgcccttctggtgtctattatggactgatggggacatattctaaatatttattctatacgagcttgcagatactagagatgtacaaaaaaataatttatgtgcgatcaatctgaaatggaggatataatatattctcatgctttctttttatgaatacgaacgattttgagggtgagctcatgtgatcaaggataatgctgtatataaagtcaatatccaatcgatatgtagtgaaaatttgtcaaaatactgtactgtcctcgacaatattaatttttgatgtgtgcttctcactgtttgatatctaggtgccagagaagctctcagtgtcccatgtgttggcagcctatcagcatgaaggatcctatgaggtagaacttgcatcctgtgtatctccctagtgaaccaatttagtggttctcattttatatttgaactgtgcagccaagaactacttgaggctgttgagcaagagaggaacattcgagctaaccgtttgaacactgccgctgtttttcaccatccagtattgggtgattttgaggtgcagcacgttttattgctatcatttggatatttgcgatgattcctctttgcaccctggaggtaggcttaattcatacaactatattgatgtaccgttttctgatttcaggtccctgtaggagctgatgatgctgaacttgaggagcgcattatacaacacttggctgctgctgctgcaatgcgtaggtcacacagacatggtagaagagatggacatcgtagccgatctggatctcatagccgcccacaaatcgtggtgttttcaaggaatgaggctattcctggtggctccctgcatgcaagttcaggccaagatgaagaccatgaacaatcttctgacttaggttctgctcatccttttgctgctcttgctgctgtagaccaaggacatatgagtggtggttcgcagctatacgtgggtcattctgaccagggtgcttcaaatccatctctgcatgatgagagagcaatgagcaggtatttcctacaacttacggtatatatttgcatgctattcctatccaaattcaagaggtttactctctttgtatcttgatgttaatcaggacatctgaaaatcaatctgcacctgtcaatcaagatacagcaggaccatctgatttgcagtcattctctgacacgctgagatctcgcctacagtcagcttcgatgaagtaatatctcaaactcctgaaaatgccttacacattgaacgtatgcatcagtgtcttacttgtgggcattctttacaatgccaggtataaagattctataacaaagagtacgcgtggatggaaggaaagatggttttctcggagtaacactatatcaggtcttggcactgaagtaaggagggaggtcaacgctgggattgctgcggtatctcgcatgatggaacggctagaaacaaaggacgatactggaccatctgctgttcctgcagctagtgcttgctctccttcagacgcaaataatcaaaggacggtatcccccaaccatgctgctgttgtaaatgaaacttcttccacgacttgtgcgtcaggatctggctctcaatgagcccactccatgttcgttgaagaattggatacactgtgaagacaggtatatatgctcttcttgtgcacgagaaagctttaaaatttttaaggttttggggtggcaaaatgtcacaagaaacattttcctttagtagtttctgaaaccgctgtcaaattcacttggatcaggtccagagagaaacgccgtttgttcggagccacctgagatccagcgatgcttcatgatctttggtaggtctgtgtgcttcaggaagttcgctgaagcatttgcatccagatcgcgggacataagacttgtgcttgcggatgaacctttacatttttttaccttgtgtaatatatatgcaaggttgttatgaaatcataatcgctgtaaattgcaacataaagaatgtcggttgtgaaattcttgttgatatccctataaatgtagtgcaccaagggcgtcatgagtcatcagttcgtcgcttgacttgtgagtactcaatcttcacactcataatctcacccttagtttatctgatacaactttgctggggtaatttctgatatcagaaaactttcagttatttgctccactcttcaaaaaatacattttctcaaaattccatttctactgtattgtttagactaattgttctaagatatttgttaagtttgtttttaaaatactaaatttattctcagaatttagtagatactccatcccataatacaagggattttggatggatgtgacacatcctaatataatgaatctgaacaggtcgtctgttcagatttattgtactaggatgtgttatatccactcaaaattccttatatcatgggacggagggattaatccttaacaatagtgagctcaatattctaagcacataagctgtcctgcaagctaaacattgggctgcatatgaggcccacattcttgggctggagccagctatgcatgcctctctcagggccttgctagagtcggcccacggtttctgcagcgaaaccaaacaacgcgtcgtcttcttcctgcgggaaactaggcgcccccagtgtgagtcgagtcggtgctgtgctggagtgctggcaacgcaggcatggcgggggccaaaacgaaaccggcggcgttcccgcgatccctgcggcgaggccttgcctttcctcgcttacggcgtgccgaccttgtgtgcgcactgcgcggcggcgcgggcgcacgacgctggcacgacaaccccacctccactactccatttactttgctactcccttctccttccccgagtccatcgccggagtagtagtgccgcagaaggatccctcgccgacgagggcgcggtagcagcagcacaagcaattcgcgcaggagagaagtggccgcaggccgcagcgatgggcgcgccggtttgtggcgcactcgtgtgcttcttcgttctcctcgttgcccgtgcggccgcggagacggcgccggtggaacgtcccacattgccctcagccgacgtcgccatcgacggtaatggcaacggcgctcgtgctggtgcgggcaaagctgccggcgccggcgccgtgggaggagggatcgtgtcaaactcggtgctggtggcg

SEQ ID NO: 6321 - DNA, 19556 bp, Oryza sativa
cgccgacggccgcgcccgaggtggatccgaggacggatcgcctcaagaagccggcgccacccggcgattctcctgtgctcccgatctccgacgcgactgttcccgatccctccgtcgcgctggcgtcggagcccagtgaccactacgacggcgacagccaggtgaaggacttcattcagaccctgctcaagtacggcggctacaacgagctcgccgacatcttcgtcaacctcacctcgctcgccaccgagttagcccagctcgtctccgaagggtacgcgctcaccgtgctcgcgcccaacgacgaggccatggcgcggctcaccgccgaccagctcagcgagcccggctcgccggagaacatcctgtactaccacatgatcccggagtaccagaccgaggagagcatgtacaacgcggtgcggcggttcggcaaggtgcgctacgacacgctgcggctgccgcacaaggtggtggcgcgcgaggccgacggctcagtcaagtttggccatggcgagggctcggcgtatctcttcgacccggacatcttcgccgacggcaggatctcagtgcagggcattgacgccgtgctgttcccgccggctgagacgaagacgaagacgaagccggccaccgcccggatcaggacggcgcccgctatcaccggcgtcagcaagattaaacaccggagaggtcagccaatgtctttagatctgaacttgaatttcctaatcgtacaaaaatttcctcagaaatttacagttcacatcctagattcgggaggttagtcgatgtttttttgttctttctgaaattgtttaagtccatgcatgttgatgctacgaatagtggcgatgaagctggatttggatactaggaatagccaagtaaagtgcagtagtgggtaaatcaaagctgtccaatctatagggaacgaacaagagtgctcgttacaagattggatgatagtgagcagcaagcatatagtattccttgtgcaattgttagctgaccatggattgtgaatcttgctcccttggtgattccttttcttgattaatcaattttaggattgcaacaatgctgattacaaacttatataagttctttggatatttatggcctatgttttcagttgtgactgcaattttgtgacataggatgtgcctttgtggcatagataaattatttgggctttacccttttactgcttgtacggttttacatttgagtttaagttacctcaagccattgtcgtatctcatactacaacaaaaatgccaagattttcctgacacccgttgctgttctttttgacagggtgtctgttaaatgtaatatgacaataatcttctgactccctagactcatattcttaaatcattttgttaaccattccatagtattcttatactttgttccttttaaaatactgcaggcaaattgctagaagcagcatgccaaatggttggcatccttggccagcgatcgcaattcacacgctgccagtagacaggaaagattgatctcatgatactgaaacacggtctagaggtgatagactctgctggggccatccacatatggttgttttattttgtttaaaaatgagtagtaaatcaggtgggcaatataagcaggtgtgtataggtgtgtcttacggcaggaaaaaaaatcatacttgaacaccaaaatcttctgtgtataggagggtttgttttgttcgttgttcttgctactgtttctgacagaatcttaatcttgagtaaagatcgcagcatcccatgggttaaaagcttcatcatttgtgtgtgcatcttttatggatttaataattttgcaaatccttgtaagtttttctctgaagattctggtaaatgcttgccttttcttatctaaagactagtgattgtctttgcctgcattacttggtagagacaccggatgaatcggtgtgagaacatgaatacatgatgtaccttttctgcatctccttagtgagctgatgtaccttttggcaatgtttggctaattggaaatggaaatgatttcccgctcaccaaaagacatctttaaatcctaaccattcattcttcctctttcatttaatcctaacccttcattcatttcccaatctcaatctcacactccatttcccattatccaaacacaccctttaggtggttctcgttttgttttgtttttttttaatgtatgcagccaagaactactgagactgaacaagagagaggaatatgcaagctaaccgcttcaaacctcctgataatttttcatcatccagcagttggtgatttggcgattatattgctaccatttgatattttcataatctttgcgactttgtgcagtggcctgtttgcaccctggaggtagcccttgtaccatgcagttctattgacgcattcccttctgatttcaggtacctgtaggagctgatgatgctgaacttggcgagcgcattatacagcagttggccgcttgcgcattatctcttctaccatgctgaacttcgcaccctcaatttcccatcatggtagaagagatggccattgtaggctcacagctaccgatccatctctacgtggtgaattggtgatagagcaatgaacatgaacaggtactatttcctactacctatggtactatgtttacatgattttcctttcaagagatttactgtcgttgtatgtcgattttaatcaggacctctgaaaaccaatctacacctgtaataaagatacagtaggaccatctgatttgtagcttttctctgacgtgttgagatcttgttagctatcagcttcaacgaagtaatctccaactcctgaaagcaccttcacattgaatatatgcattttatgggcattcattagaatgccaggtctaaaacaacgagtacgcacaagatggaatgaaaggtattttcccacagtagttcttagctttgaagtaaggaggggaggtccgggattgttgcgttatcctacagtagttcttggccgtgaagactgaagacaggaattggggcaaaatgctacacgggtagatgatgtatgtaatggcgtccagtcaattctttttagaggagtgttcgatcctgtagaggatgaaacaaacatttttcctttgggtgtgtttattccgtaaaattggaagtttggttgaaattgaaatgatgtgacggaaaagttagaagtttgtgtgtaggaaagttttgatgtgatggaaaagttgaaagtttgaaaaaaaaagtttggaactaaactcagccttcataagtttctctaaccgccgccaatttcactttcgtcaggtccagagagaaaagccgcttgttcggagcacctgagatatccagcgatgcttcatgccttcatcatctttgtgtgcttcaaaagtcgttggaagctcttgcgttcagatcacgggacgttacgaattgtaatcgttatcattcacaacagaacgaatgtcgattgtgaaattcttgttggtatccctataaatcaagggtacggtcattcatcagttcgtcacttatcacccctgttgtgctttgcctatgcttgtgagtaatcaagcttatatgcaaatttggcctatgaggaaatttgccatgtacacaggagttcgcagtaatcacaagcatagaagtgatacgtttctgtatgagacacataaattttcacggaagttcgcagtgatcacacataagtttgtgagtaatcacacagaagtgcatcccttgtactgcatctacctaccttttccctgcgctggacatgcttgtttcattttcttcccctctcctttttttactgttgaacaccctggaaatatttaaggtctctacaagctggggtagtccacaatacaaaaaacagtactagcacgtgaacattctgaaaagaaaaatctgccatccaaatgccctcgctttcatgatgatcagagttcctcagaattgtcccatgcgtgattcgtgattctttaactttggcatcaagcatttcgcggagattagcccctcacatgacaatgatctccccagatcaaaacctcaacccagtgaactccactccatgtgcgtccgcagcgcagcgcaggtggtggtctcgctagcaaaaaccaacaaaaccaagaatgcgtcatgtgtgcgctgcccgtaggccgtagccagcttattgctcacgagaaccaggtgcgcacgcacgcacgcacggtgttcgctcgctcccgtctcggcaaccgcagcggacgaaaccaccgaccgacaccgagtcaccgacgaatccaccctctctcgtctctcgctcgcgcgcgcgcgcgaggacgacgcgaccccgcaccacacgcggacgccccccgcgaaatcaacgcggcagctggcgcatccgcgcaacgaaacgactcggcgcctttctttcttccgttattccgaattccttcccgtgccgtgctcgtggcggggtcagtactttggaccggctggtttatcatgtatagtaatttttttaagtttttaaaatcacagtatatcaatcttactataaccaccaaactataaagtgatagtaacacacttaaaacggtttggtgaaccctacgactggatctccggtggtgcagcgaccggccgggggagacgagatgtcacagaaaacttggcttcaaaggtgattgacaccacggcattcgtatgtgtatacgtgtatggctcacgagctaccgttgtagacgaaaggggtaaaaagggttacaggctaccggtgaaagtgccaggtagagggaacatgcacgtcaatctggcgcgtacatccggtgctgtgcttccggatgcagcttaattaacgacgggaaggagaatagccgcccaagtgataaacgagcccaccagcgtcgaactattggaggaatcagaaatcggaaaaaacattgtcataaatctggagggtttattccattatcttaaaaaaaaaaactgcagggttgaactgtagatcgtccggtagcttagcgtggagactaacccacgtcatacaaaaaaaggcgacgcgtcaggccaaatccaccagaagttggacggctcactttacgtgttattgcccggacattaacacaataaaatccgacgattgaaacgaccaaaagtgagtgactaccgataatcgattgctggatgtactcctaataccttgtgatacaaagtgacactaccacatgagaaaaatggaggctgatcgtattaattaaacgatgatttcaagaagtggattaaagcaacaatgatatctgattgtgtgaaagctaatgaagcggccgtacggtgatatctgtacgtcttacttttttcagggcgttggctcattgacgaattgaagcacgatttggcgacggtgaccatccaacgatctatcattaaatcacgatcaatgctgcgaagctacatgttagcataacaccgaaagtcatggtcataccaccgtgggacaatacaccatccaactcaccatgatagtgttctttttcatgaattgggttgtacgataaaaatgccaagaagaagatatgtttggaaaggagaaaagaaaaaggaagatcgatactgtatatcattagtcctttgtaaacacaatgcaagatcacgagatgctagtatagctgtctccgaatggattttccgggggaggccatttgattatgcataacctaacctgttgatacacctgacaggataaataatccctatggttctatattaattgacgtttggataaggttgatgttaaacttttataattttgaccatcaataactttaaaaatatatagtttaaagaaactagaaaaacatatatagatttgtctttcaaaacactataataaaagtaaacatgcatttatttattatatatattataataaaaaataaggtcaaaggtatatcttgtagagcgtgttattgtcacagcgttaattaaaatgaaaggggagggagtataacatttggatctgtgaacgcactatgctctgcattgactggcagcatgcaagcctgcaagtattaagcacgagtgcactcgagggagctgttagtgcgtcttaattacatcgcgaacgcacatggcggctcctgtttgacctcagaaataaaagattaactccgttctccaagttcttaaaaaaaaaaaaactccattctccaacacgataacaccccgtttagagttaggtgcatccgtatacgatccggttccggtggcatatggacctaaccgacgcacttggccactttcattagtgagctccttaacctctcctttcggactcaccctgtaggcctgtaccctgtactcaactcctgtatccaccacaggatttactccatttcacccgagtacgattgtacgaatccatcacgcggatctcaccggctttaactcatcactgtccggtccccagaccggcacgccggcctggatttttcacatttaagtccttttaaaaaaattatttcgcaaaatagacctctaaaaaaatttatcctacaaatggtttcttttagggcaccagagtggctggcaccgtcctctaactgaacggcgccaggcactctggcaccgtcctcctgccaacgtggcggggtggtgctgaggtggcagggggaggcgccaccatggctcccccccaacacctcgtttccaatcttgaccctttttatttatttatttttttgatatttttttacacttagaatcacgatacatacatgcaaaccacaaaaaaaaattaaactcgaatggaatatgtaataaatccttcaacttagctaaaagtctggaaacaacataccaaattttggaccttcaccaaattataccataactcttttagcaaaacccttcggtcagcatgttaaacataatgcactctaccactagatgaaattgcttaatctaactcaaaatataaccacatgaaaatgatagccataagttacttaaacagtctagagatgcaactttttttatttttcttttattttttgattttttttccacgattaggagcatacaagaaccaacgatatacaaaccaaactcaaatagataaaatatgtgacctgcagaatttttctcttctatcctctctagtgtagaggagagagatgtgcaactttttttttatttttcttttatttttttgatatttttttcacagttaggaacccacaagaacgaaccctaaaaaaataaactcaaacggacgaaatatgtggcatgtagaattttccaaagctccgtcgaaaagcttatcgcctcgaaaacacaatcttgcaagaaaaatttggatattttaatttcgccgaacccagcaaaacgggggagaatcggatgtaactttttctgtagatttttgtggttatattatttgcctgattccgagttcgtatgagaaagttacgtctattttaagaaatgacacacaaatgacacctattttcggtagagatttagaaaattctacaaatcacattgtcggtgacatgggaccgggagtatcatgacttagagacttgaggcagacacgatcacccacgtggcctaaccccctcggggggggggggggcgggctcgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccgcatttattgcggtttggacgagcgcgtcacgccacatgtagcgcagtatggcacgctcatttatccggtctgtgaccggtcacagatcggtcagattgcgggttaggaggcaacaggcgatctgacacacgcctcgccccgtcccatcaggatgagagtctctaggcactcgtccctagccggagccagcgtgctagctcctggagatggcacgttggtcctggtcagatgtatgccaggctttatcccaaccattataagcaagacgttgtatgaagaagggcgaacatgcagattgctaaactgacacgtggtggacaaaggtgaccggtctgacactggttatgtcgccggaagacaaccgtgttcccacgttgcacctgcttccggcggagtggacgtaggtatgggccgtcccatcagaagggtcactcgggcagcagccgttgcaaatctccgcccatttatgaagggatgacagggtgatccccgaggtcagacgaacgaggacgcgtggccacactcaaaaacaggcagtgtttcagcttccaagagaaggcaagccaagttttactatagataggatgggcccccacccaaaaagagagagagggagaagtggtgcatgtggtatccccttgagatataaaaggaggaccttgcccacttaagaggagaggctggaaggggggatgatctggagaggagatcccacgagaaaaaaaaaagaaaaggagaagagggtttttagaataagagctctctgactctccagctcttggtagcttcttcatacacagatccaccagaacacaggagtagggtattacgcttctcagcggcccgaacctgtatacatcgcccgtgtcttgtgctttttccattctcgcgaactttccacagactaggagcttagaatctcacccagggcccccggccgaaccggcaaaggggggcctgcgcggtctcccggtgaggagccccacgctccgtcatctggcgcgccaggtagggggctctgcgtgtgtttttctaagctctcgcattctttcgtgtgcgccaagcttttcctgttcagcccaatggccgaacaagcaaaggcgcacaacctctctccgagtgttagcggtgacgacggggagccgaacccacgccgtcgagctcgtactccaccgccccctccacgccaaagtcctagcgggaggaggcgctcgagagggtcgaaggatccgcgacttcgacatccacgggtgatggggaagggcggcgagatggggagcgtcgcctcctcgtctacggcgacggcagcacgccccagggcgcgctcctacgtcacccgcccattgtccctgacccggagtctccagcccaacgttggctggacgacatggccaacttggtcatgacggcgcagcagcgcctagatgctggtgggcggtcctccgccaccaagacctctggtactgctaccaccggctccgcgtcgtcaagacggagggcgcggcgagcagcggccgctgttcgctattcggccgtcactccttcgtcagcgcctccgacccgggaagatcttcgtggggggccggatgcccgcatcagtatcgagcgccggcataatggccgacgtgctgcccacgcaacggagggcgcctcctcgtccggagtgtcacctcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcgcggggttggctaatgaacttgccacccgcgtccgtccactcttgggaggacttgtgccaacagttcaccatgaactttcaaggcacatatccgcgtccaggtgaggaagcggacttgcacgcagtacagcgaagggatgatgagtcacttcgctcatatattcagcggttctgtcaagtccgcaacaccataccatgcatccctgcacacgcggtgatctacgcgtttagggggggtgtgcggcacaaccgcatgctcgaaaagatcgcctccaaggagccccagactaccgcagagctttttcagctcgcggaccgagtggctcgtaaggaggagtcatggacctggaacccctccggttccggtgtggcagcttcggccgcccccggatccgctgctcggacagggcggcgtgacaggaggaggaagaaaaggtcagcccattccgacgacgagggtcatgtcctcgccgtcgagggtgcttcgcgggccacccgaaaggggaggcctgcgagcgacaaaaaggaggccagcgctcccagcagggagcgcccaaccggcaagtggtgcaccgtccacaacacctcccttcacgacctcgcggactgccgtgtagtcaaaagtttggctgagcggacgaggaagtgggaggaggagaggaggcaggagcgccgagagggcaagtcctcggcggttccttccggcaatcggcgaagagaggccaaacagaaggcccccgccgaggacatcgatgacggcgatgatgacctgggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccatcgtgcgttgcccggggaggacaggtcgcaatggtggtttcccccactgtttgcaacgtgaagctggggcgtgtcctcattgatgggggagcagccctcaacatcctttcccccgcagcctttgatgccatcaaggccccggggatggtgctccggccgtcccagccgattatcggtgtgacgccggggcacacttggccgctaggtcatatcgacctcccggtcaccttcggtggatccgccaacttccgcacggaacgggtgaactttgatgtggcggacctcagtctgccctacaacgcggtcctagggaggcccgcgttggtgaagttcatggcggcagtccattacgcctacctccagatgaagatgccgggccccggtggccccatctctgtccatggcgacctcaaagtcgcgctcgcttgtatggagcagcgcgcggaccacctcgccgctgcgtccaagcccgaggatggcgacgagaggcttggcacctccgtccccgccgccctgaggcagcggatagtcacgtgcgatgaggtcccggtcaaggaggttgccctgggcgacggcccgtccaagaccacacgaatcggtggtcttctggatggcaaataggaagacgcgctcgtctccttcctgcgggcaaacgctgacgtcttcacatggagaccggcggatatgcccggggtccccagggaggtgattgagcaccgtctcgccgtgcggccgggcgcaaagccggtccggcagaaagtgcgccggcaggccccggaacgtcaagctttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttacccccttcctcgcatagatcagattgtcgactccacagcggggtgtgaccttttgtgttttctagatgcatactctggttaccatcagattcgcatggctagggaggatgaggaaaaaactgcgttcattacccccataggaacttattgttatacgacaatgccattcgggttaaagaatgcaggtcctacttttcaacgtactactcgaatttctttgggtagccaaataggacgtaatgttgaggcttatgtcgatgacttggttgtgaagacccgcgaccgagaaactttactttcagatctggcggaaactttcgagagtctccgctccacccgcataaagctgaaccccgataagtgcgtgttcggtgtacctgcgggcaagcttctcgggttcttggtctctgcccgaggcattgaggccaaccccgagaagatacgagctatagaacggatgcgccccccccagcaagcttagggatgtgcaatgcgtcaccggttgcatggccgccctaagtctgttcatatcgaggctgggagagaaggcgctacccttatttaagctcctcaaacgctccgggccgtttacctggacggaggaagctgaacgtgccctcactcagttgaaggcgtatcttagctctcccccagttctggtcgccccggagccaggtgaacccttgctactctacttagcggcgaccccgcaggtagttagtgcggcgttagttgtggagcgcgatgaggacaaccctcattccgcgcatccccaccctgtgttggcttggcccgggagagagcagggaggagaggctcccgagccgaacggtggcccaaggcccccgacgaccggagctggccctctgcccgcttgtcagacggtgccaggtgcccccgacccccaggatggcccgggggccactgcgggaaggccgcacctatcgccctctgaccccgaggttaaccctgtgccgactcgacccgggagagagcagggagaagaggcccccgagccgaacggtggcctaaggctcccgatgaccggggttgaccctttgcccgcttgtccgacgacgccaggagcccccgacccccaggacggccctgaggccactgtgggaaggccgcacctgtcgtcctccgaccccgaggtcgtcagcacagaagacaagtgcgccccgcgaggccgcttggacgaagagcgccccagggatgcggcccctggcgaagaggatcgaccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcgcccaaatcttgcataatcgagagggtacaggacgggtggtgaaatggacaattgaactttctgagttcgatttgcactttgaaccacgtcacgctatcaagagccaggccctcgccgattttgtggcagaatggaccccggctcccgagcccgtctcagtccccgaggccagctcgggcccctcgcagctgcctcacaccgcccactgggtgatgcagttcgacggctccctgactcttcagggcgccggtgcgggggtcatattgacctcgccgagcggagacgtcctcagatacctggttcgccttgactttcgggcgaccaataatatggcagagtacgagggactccttgcgggactcagggtggcagctggactggggatccgccgcctcctggtgttaggcgactcccagctagtggttaaccagatctgtaaggaataccggtgctctgacccacagatggatgcttacgtacgccaagtacggcgtatggagcgccatttcgacgggatagagcttcggcacgtgcccagacgggataacacgattgccgacgaactctcacggctcgcttcctcgcgagcccagaccccaccgggcgcctttgaagaaaggcttgcccagccgtcggcgcgacctgaccccttaggggagacggacgcgcctgaccggcccccgaggcccgtcggagtccaggcctcgggacccgaggggagcgctcccagctcccttagattgattgcttggatcattgagatccaagcatacctcacagataagactctacccgaggaccgcgaaggaagtgaacgcgtccagcgcatctccaaacgctacgtgctgatagaagggaccctctatcggcgcgcggctaacggaatcctcctgaagtgcattcctcgggaacaaggcgtcgagcttcttgctgatatccatgaaggcgaatgcggagcccactccgcctcgcgcgccttggttggcaaagcctttcgtcaaggtttctattggccaacagctctcaatgatgcggttgacctggtccggcgatgcagagcgtgtcagttccacgccaagcaaatccatcagctggcccaggcactgcagatcataccactttcatggccgtttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggggtgcctaaccgtattattacggataacggcacccaattcactagtgagcttttcggtgactactgcgaagacatgggcattaaactctgcttcgcctcacccgcccaccccagaagcaatggccaagtggagcgcgccaatgcggaaatcctcaaaggccttaaaaccaagaccttcaacatcctcaagaagcacggcgattcgtggatcgaggagttgccagtagtgctctgggcaaaccgaaccacaccaagccgagcaaccggggaaacgccttttttcctcgtctacggcgcggaggcggttctcccatccgagctcaccctgaagtcccctcgggccaccatgtactgcgaggctgatcaagatcagcttcgcagagatgacctcgactacttggaagaggcggcgcgcggccctccgagccgcacgctaccagcagagcctgcggcgctaccatcagcgccacgtccgggcacgatcactctgcgtcgacgacctcgtcctacgccgcgtccaaacacgtgctggattgagcaagctctcaccaatgtgggagggtccgtatcgagtgatcggcgtcccccgaccgggctccgttcggctggccacgggcgacggcacagagctgcctaacccgtggaacatcgaacaccttcgtcgcttctacccctaatggagttcgggtgtcaggtttcgggctcgggccaaccacgcacccccttcaggcgtgcagggttggccgggggctaccacatatgcatattttttcttctatctgtatttcaataaaagcattttcgatttcctaaaggctgtatttgtgctgttgtttccttttgaagaatcttgacttgaaatatgtcacttgtgctcaatcctgccctcgggggctcgggtcggctaaaatcgccaaaaggggccagaaccgagccgtgccccggggcgtggtgaactccggggggaaatcggcaaaaacccacaatcgggtcacccataaccctcggtcaccacgctcccggcctggccagtctcgacacgtggatctccccaggcactagccccgacccgcgccttttgaggactgggacctgggcacgagcccttaatcaagttaagacataaaaggaccacggcacagatcatcctcatctcatacacatagcaaaatgaaattgacacagaaatttctttattttgattgcagattaagttaatctatacaaaaaggaggcccgaaggccttgaaagaaagaaaagaagaaaaaactgaggattggcgggggcctgggggctcactccgatgcacccgggtcgccagcctcgtcgccactgtcgcccacaccgccgtcatcgccctcctcgtcggagttgagggcgaacgcgagccgaggggccgaaccctcgaagctgtggacgatatggtcggcggcatcccggacctgcgcgcgcgcgccgtcctcggtcccgggagggaactcgtccagcgccgtccatggggagaaatcggggtccctggcctggtaactcgccagtacgagctccaccgctcctcgggcgaggtccctcgaggatgacttaatcgtcccctcgagctcctcggggagccgctggagagtcccggccatctccgagaggcgctgggcgaggcccccctggttggcggcgtacttcacagtccgcccgccccagagacccgcctgccgcccggcgcggtctaaacgggacacggcgtcgcgaagcatgctgggccctatctcgcctgccaggtgaagggcctcgacctccccggtggacgaatccagcgcgccctgcagatccgcgatggtgtgttcggcaactgcgaggcgggcggctaagtcgctgtcgcccgtggccgccccgccgctacgcgcccttgcatccagctcccttgcctgcgcctcgagttcagcggcccgctggttcaatgcggccctctcggcgcgggcactttccagattgcgacgcgcttgttcctcttgcgcagcttcgcggagggacgcgctctccgctagcctctgtgctgcggcctcggcctcctcgagggctcgctcccgctcggtgagcgtatcctcgcggaggcggagtgcggactcttcttcggcacaggcagcttcgtgcaccgccagtgtgacctcccgaatagcaacggcggcctcgcggtccgccaggtccctctccacgacgcaggcacgctcttccagcgccatggcacgggcctcaagggtttcttcgcgccgccgggatgccacctcggtctccgccgcccgccgttctcgggcagcggcagcatcaaggaccccccgggcggcattgagcttcttccctagctccgcctcccagctcccgtattgaaggcggaggtcgtcttgcgcctcgttcatcacggtagtagcgatgagggcagcccccctctcctcctccacctccctggcgatctcccccagcatcttccgacgggcttcgagctctgagacgtgccggcggtgtgccttgcggcccacctccaccatggcctccaccgagcgacgcccctcttcgacacgtgcccatgcggcgtcgagctccacccgctctgcttgcaaggcctccatctgggcacttaacccgtccaacaccgtggtgttagcaacggccaaggcctgcagaagaggctctgcgctcagtggggcagcagaaggcgtgggggagagccgcctcggtgaggatgccgcgcggctcggcccgccgatggacgtgccggactcagggatgtcccccggacctggcttgtcctgagcgtcgcccgagggagtgggcccaagcgatgcgcccgcggcctcgtcgcgagctgcctcggaagtcgtcgccgcctcggcctggcgaagtttggcctcctcccgagcggcttcttcagcttggcgagctcggatggccacctgggcggcctcctcggcttcccgtaggcgatccgcggcttctcgccggtcagattcccgcctccgagcctccgtggtcgccgcattctcggcctcagattggccggacttgaattggcaagaaggacgcgacgggatctcgctgaagcagaagaaaagccagaagacaaacaagatgggtgaatgaaaacttgtgttggaagaatgaatatagccacaatgggcgtgggacgaacctgcgagggggtcggttaaacgaccaccttggaggggaaatgaggtttccccgggatggttctgtccccccatcttgcggagccgtttcttcttccgctccccctcgggctgcggcgtcggcgcggccccctccgggcgcctgctgctgacacgtgccgccccgccccctcggggaggagatggggaggaagtaccctcttgctttctcttccctcgggcgtcggcagggcggctgccccccgagcccccatcacggggaccggaagcacaaccccctcctggggtagattgatctcccttgcggctcccgctcgcactgtcatggcccttaggagctcgttcctctgaggccccgaccgccatcatgatggacaggatgttggcgcgatctggatcgctgcagagggggaggactccttgggggatgagggatgcctccgcggagctgagattcagcacccgttggatcattaccttgaagtcttcggggacccagtcccatttgaccccccggtgggtcctcatacagtcctcggacccggtgtactcccaggcgccccgggcgcgccgctggagtggcgcgatccggcgacgaagatagtcaccgaacaccatggcccctgtgagcccctgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcaaccaccaaccaccgatggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggtgccgggcatccctcgcccagcgagactatctcccggccggtggcaaattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatatcgtgcgcgcgttaattacgctcgccgaccgaagcgccatcaccatatctccaggaaaaatgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccgcatttattgcggtttggacgagcgcgtcacgccacatgtagcgcagtatgacacgctcatttatccgg

SEQ ID NO: 6322 - DNA, 7856 bp, Oryza sativa
gaggggggcgccacccgccctcccccaccactttagcaccgtcccaccacgtcggcaggaggacggcgctagagtggctggcgctgtccagttggatcacggcgccagccattctgacgccaaaaaggaccattttaagtttttttaggtctatttacgaaataagttttttaaaaggactaaattatgaaaaatccaggcacgcctgcactgtgtctccgtgcaaggcagcgcgcgcggcagaaagcgggcgaaacccgcggaaatattcgcggctcggcttcgcgctgcgctgctgggcgtctgggcggggcacggcgaaatgttgcatacgccgcgcgcgcgcgcgcgagccgcgagacaaggcgcgagcggcgggcgaccgaatgcccccactgcccacactttccttgcttacggcaggcgaaccttgtgcgcgcgcacgcacgcacagctgcacaccgacacttgttgctgctggcccctctccacggctccacccgccagcctgtgccgccgctgcacgctgcccccaccaaccacggactctgcgtcgtcttctcctctccttcctcgtctcgcggtctcgcctcggcctcgcatccactattccacttcgacaacccttctcactctctctctcttcacttataagcaagctcacacacacctcactctctctctctctctctctctctctctcttccgttggagtaaaaaaggaggggaaagtgagaaaaagaggagaaaagctcacaccacccacctcctccattactagtttacttctcttctcctcctttctcccccattcccccaattcattccttcgccgaaccaccagagtggtggagagtagctagcagagtagcagagcggtgggagcagcagcagccgtagccgcatccggagagattcgggcaggagaagccgccgcagcgatgggcgcgccggtgcgcggcgccctcgtcttcttgcttcttctcgccggcgcggccgcggagacggcgccggaggaacccacattgccctccgccgccgccgatggggcggctagtagcgggacaacatctggcgctggtgctggaacgggaatcaactcgaactcggtgctggtggcgctgctggactcgcattacacggagctggcggagctggtggagaaggccctgctgctccagacgctggaggacgccgtcggcaagcacaacgtcaccatcttcgcgccgcggaacgaggcgctggagcgtgacctcgacccggagttcaagcgcttcctgctcgagccgaggaacctcaagtcgctccagtcgctgctcctcttccacgtcctccccgcccgcctcccctccgggtcctggtccgccgtctcccaccccacgctctccggcgaggaggttgagctcgccgccgccgccaacgacggcgcgatgcgcgtcgcccacgccgccgtcacccgcccggacgccgtgctcaggccggacggtgtcatccacgggatcgagcgcctcctcgtgccgcgctctgtccaggaggacttcaaccgccgccgcagcctcgccgacatctccgccgtgctgccaactggcgcgcccgaggttgacccgaggacgcaccgcctcaagaagccggcgccgcccgtgccacccggcgcgcccccggtgcttccgatctgggacgccatggcccccggcccatccatcgcgccggcgcctgcccctggaccgggctccgggaagcaccacttcgacggccacagccaggtgaaggacttcatccagaccctcctcctgtacggcggctacaacgagctcgccgacatcctcgtcaacctcacctcgctcgccaccgagatgggccggctcgtctccgaggggtacgtgctcaccgtgctcgcgcccaacgacgaggccatggcgcgcctcaccaccgaccagctcagcgagcccggctcgccggagaacatcctgtactaccacatgatcccggagtaccagaccgaggagagcatgtacaacgcggtgcggcggttcggcaaggtgcgctacgacacgctgcggctgccgcacaaggtggtggcgcgcgaggccgacggctcagtcaagttcggccatggcgagggctcggcgtatctcttcgacccggacatctacacggatggcaggatcgcagtgcagggcattgacgccgtgctgttcccgccggatgacaccaagacggcgccggacacggcgccggtcaggagggcgcccgccgtcaccggcactcgcaagaagaacaaactccggagaggtcagccattctcttcagatctgaacttgcattttctactcaattattaatcgtgcaaatccgccatagaaatttacagttcacaacctagattggggaggttaggagatgattttgtttatgcaattgcttaagtcaatgcgggttgatgctagtaatgttgccagtgtgagggtttactcttcaccggtaggaacaggtaagtgctaccggtaagtgttctgatcgtagcggcggggattaattaattaatcgattggtgggtggtgtgtactgggcggaataaagacgaaggcttaggcataaaatagaagcaattagggttattgccgttctgaatggcatatggcctgtcggtgcccgtttgggcacttgctactatgtggtcagtaatactaccaaagttgcagtcattctctttggtgtctatgcacttatacattttattcaggccattacacatagctggctggtctgtgatattagcactggattgtgtactgaaacattagaattgtgcgtgtgctggtgggttactgtctttaccatctcttgatactgtacctgggactgcaagcaagaattgtgctctgcccgtgacacatgagcaacagcttttctttcccccaaagcatcaaaaggctcatgcttaagcctttgccacatcttgttactagagtttggtggaatggtagtagcctgattggattggttatgggttgagggatggcaattgctaaactgtgtgcctttgtatgcgaatgctgctgatgttagagcgagctatttttggactatgattggtgaaaacaaagacagaagtagaaaacctacatatgtatgttaaagataaaattttgtcttagatgtatttttctatgatctaggtcatatatagatagttaagatcaatctaaatcccctcgattttcctagacctgtgctcaaaaagtatgccaagcatctataagttgtcatgatctgaagaaaacttatgttgattttaatctcaagaattagatgatagtgagcagcaatatatatactgctccatagaaatggttgggtggccacggattgtggattcgtgagtaagataaactaccctggtgcctgtgaaccttgatcacttggtgatattccttttgttgattagttcatttaggtgtgcaacgtggtgtgatgctgattatagaactatatggcagtatatttcttgggtattcatgacctaaattttcagttgtcttgtgatttcgacattagatattgctattgcctggtctagattatttgagcttattgcttactacttgtatcctttgagtccaagctacatgaagccattgccacatcttgagaacaacaaaaatgccaaaaattttataggcacccaatgttgaattgacagggtatctaatgatacataatctaacattaatcgtctgactccccagcctcatattcttctagctttttttcccttcagtataacaccagtgtcgttatgtgttaatcacacattgataataataatcttatgctttgttcattttaaaatactgcaggcaagttgttagaagcaacgtgccaaatggctggcatccttggtcagcgattgcgattcgcaagctgccagtagacggcgaaagattgatctcatgataccgaaacacgaactagaatgaggtgatggactgtgctggagccgtccacattaccatttgtttttttttatttttatttttgtttattattacgaataataaatcaggtggggaatgtaatctggtggctgttggtgtctgaaaaaaaaaaaggcaggaaaatgttcatacttgaagaccgagatcttctgtgtataggagcgtttttttttatatttttttccgtcattttttcttctttttctgttttgacagaatgccgagtaaacaattaaacatcacagcatccttggtgttaaagctagtagtaatcaattctgcatcttctatagatctaatcatttatgcgaatcttattctctgaagattattaggctatgatttgtcatttggacgtacaggcctgcattattcgttcgggacagcggactaatcagcgtgagaacatgaatacacgatgtacctgctgaactataaactatagatgctccaactaagaagcaacgacgtcgttattaatgaaataaagtgacagctaatgtgaatcgtcttcgcctaagagcacccgcaatgataaagtaaggtgctctctataaaatataaaacatgtacatctcagcaatagactagattaatagtaaaccacctcaatagtatgtctacatgggtatctatagctctctaatctattgcttcgtttttctctatagactatctccagtttagtagatagctttgctctctctcttcatttaatctttttcaagtaggaaaatatgctgacatatatatcttatacagagcctatagataaccattgcgggtgtcctattaccacagcatctctactactccctccgtccaaaagaaaaagacaaaccctgggtttccgtatccaatgtttgacaaaagaaaaagacaaaccctgtgtttctgtatccaatgtttgaatgtccgtcttatatggaatttttttataattagtattttcattatttaatactttatacgtgttgtctttttaatttttttcataattttttaaataaaacggacggacaaacgttggacacggaaactcaggttttgttttttttggacggagggagtagtggcctactacaacttatatgaggttgcaggttgctataatactgtactagcaaggaagcataacttgcccaccactgcatcaggtgatcgccttgtagtggtagattcatcttcagagagttacagtaaacgctaaacactactacaacgtgcagaaggtcagagtctggtggtggtcccggcaggacgtgcagcgcaacgggtactagtcgtagcagtccagtagtatctctgcatctgcgcccgtgggcgggcggattgatgggcaaagcgacagtgccacggcctccgaaaccaacgtgccgctccgctgggagaaagaagtggaagtaataacccaggaaggacaaaaaacggcttcatttcacgtgtctgcccttgtcccccacacggcgtttgccctcgcgatcggagctccgttttattacgagcgattgcgcgctttgcagcacacgccgcgcggttggacggtacagcgcgttcgtccgctccgcccgccgaaaacacggtagcacacggcgaaatcacgcaccagaatggcatcgcgcgcaggggatcgagggggccaaggattatcacatgaacgacggtggcggcgaggaacgaaaaacctctcttgtatttttaacgtcagaagaaaacaatcgaaccaatgacccaagagtgacccacccccctctacgcctgtacgtacacgcacatctcctccagccatttttttccccgtttcgaaattaccagccctatggaagacaacatatcgatctcgttgtcgtcgcctctacaagtgtgtgactgactctagtggctgtttctcaagacatcctcaaggcctccctgaagccgatgctgaaactgttctgcagcccgccggacttcttcgccgggagccccatcgtcggcttctgcatcatcgccacgaactcgttgtaatctatgcgaccatcctgcaaacacaaggcacgaaaaagaacagcgaaagttccgtcagatcaagcatttcaggcaatgtgattagctagcttcgatcagaatggaatggaaaagtaggttcttttttttttttactgacgttgtcttcgtcgacttctctgatcatctcctcgagctgaacgtctcccaagccgaactcctcgcaggcgagctgcagctcatcggccgtgatgtagccgctgccgtccttgtcgaagtattggaacgccgcgaacaggtgatcctcccgctcgatcttgttcatatgcagagttgcagcgatgaactcaccgtaatctatcgtgccgctgttatctacatctgcctgtaataataccatttcagaattcagatacaaatgcaattttgatgttttcgaccagtagagaccaccgtaaaagtactcgacggaattggtagattgcttaagaacttacggcttgcatgagtgcgtagatctcggattcttggaggttagcaccgacttttttcagaccaaccttgagttcttcgaaggtgatctgtccactgttgtctgtgtcgatcatcttgaacatttctttcaggccggcgatttcgtcttcagataggttctctgcaatgacctggaatcaacaaaggtatcaggacatgcaggtaagtatgattgaaccattcaagatgaacaacattctccaactaatacaacattggatacttattttttaaaatgattatgtactgtatcttgcatgagctaaactccaaacagattttcctttggtgcatgaggacaaaaggccaacgacaagatggtgctatcctaatattgggaaaatatttcatagagaaatcagaaatatagtaacaatttgtgtccaagtcatacttaccctaagagccatctttttcagcttattcatagctgagaattgcttcatacgagatagaacagcagaatccaggggcttgtcaggagccaaaccaccaacctggacccatggatgccctgaaaagatgataatgccaagtaaatcagactgcactgttcatggcctgcagccctgcactactaaaatagctagaaaaatacatttaggaatatatcatgaaaattaatcaagtaacttacttaaaacttcatgagctgtcaatctcttcttcgggtccctaacaagcattctccttacgagatctttggcaccttcagagatgctaggccatggttctgactgaaagtcaagtctaccatgcaaaacctcttcaaatataccctgctcgttctctgattcacaacaatggagagcttaattagtacaagagttcggatcaaaatacatcacattttgtcacgaaagttagtataattgttttgtgattgactgaaaaatcagcaaaattcttacctgcccaaaatggcggcacaccacacaacaagatgtaaattatcacaccagcgctccagacatctgcctcttgaccatatttctttttcagaacttctggcgcgacatagtaagggctaccaacaacatcagtgaatacttgacctggaataagaatggcatatgagtagaaacccaatggagaatgaattcatctgaatgatatggtagcagactgcagaatggtaaagatatgcagccaaactttttgcagaacttatgcagaaacaaatggtgttgaaaactttgaaatgtaggtaaaggaaattaagttctgaagcataaaatctcacagcagtattagtactatcataagcacaataatgcagttgtcccaaaaacaaatgctgaaactcaagaacttcagattcactagggctgcaggaat

SEQ ID NO: 6323 - DNA, 7771 bp, Oryza sativa
gatcgcgaaaaaagaaatggcaaatgcgagagcgtacaaggggaaagcgcgtgtggcatggtggccgaccaggtcgtgctcctgtgcaaaagtccaaatcgcatcatcaccaccatccaagaagcagtgtaggtagagagggagagagcatcacttcacacgcggcaggtggccggtaacgtcccagtcacacaacggcctgcgacatgcaacgctgattctactagttgattatggtttgtaaattcaacgtttgtgttgataggttttctgaaagaactggtcaggcacattggataaaaagaagtcgtttctaatggagacaagacagcgtggagttagatatcacggaacagctcatataataccacactaaacaatagaagaaaactaaactacattgaaatgtaaagcacgcaggatgtaaaactcagtgggattcgaagattgataaactagggagattctatactagggagttctgggcatgtcggatgtaaacaaaaagaacaaatacaacagtgtacattacactccgagccaaatatatcggaggcaaataagacagcagatgcgcagggaaaagagaacaaaattacacctcgggatacacttcttttttgttctattttacactccaatagcacaggcatacaacaacatgcaatccggctttgccaatgaaaggaataattgagtggtaatacactactgaccttggggtttacaagccagccgggtgatgctgcgaaaactgtgctgacgctggaaaatttgtatgaccatacgaaccatggtcgtagtcccgctctgatgatcacgacatgttgccaggcagatccaaaatggcaccatgaaatgcacatttgaacagagcgtcttatcttttctttgggttccttttgaccttgatcacccttctgctagatttgtcgccgcctccgccaccacttcccaaagagaagttcccaccctgaaactctaggctaccaccggcaggcgggaatgccgcattctgctgcatggaaccttgttggcccccgaactggaaaactccggcggacgggactgctggagcaccaaatactggagcagcgggtgaactagcaggctgcccaaatggtgaggaaccaaatatcggtgctggtgctggtgctgcttggttagtgtcatctgccatgctgtcttcgacattcatctgatcatttccaggagatcccatgccgaaggatgtgttggcatttgtcatcccaaaagcaggctgcggagtagatgaattcatgcttgctgaggtaaatgaaaaaactggagcttgtgaggagaaagctggagatgactgtgctccaaatgaaaaacctcctcctgaagaagccgattggccaaatgtaaacatgctgggaggtgatgaacttgaaccgaatgggttactgaaagcaggggatgatgaagccgtagaactggtgctgaacatacttgtgctggccatagttaaagatgacccagcagaagagctaggagatgaaaatgcgaatccacttccagggccagagaaagtagttcctgatccaaatggtgaattaccaaacaaagacccggatgaggaagttgtcactccaaaagacacagttccaggcccagacgaggttccagctccaaaagacacagttccaggcccagatgaggaggttcctgctcctgctccaaaagataaagccccagttccagatgaggaagctcccgctccgaaaggcagagccccagttccagatgaggaagcccccgctccaaataacagagcaccagttccagatgaggaagctcctaatccgaaagacactgtgctaggccaagatgaggatgctccggttccaaaagatgtgatcccagaaccagttgaggctgttcctactccgaaagctacagatccagacccagacgaggaagctcctgtggtagtggtcacagtttgaaacggtgaactaaactgaacaggtgaactcttcgatggctgcgacattgtgccctctgactgtggcagtttgctaccaaagatcgtgctggtggcagatggttgggtggtactgccatcaacagatgtactgaaaccagcaggttgagctggggaattgaacccaaaagtgttgtttcctgagctcgaaaatgtaaaaggtgctgttgaggcagaagtagttgaggcaattccatcatttgaagctgcaaccatagaagatgaaaatgttgctatgcttgagaaagcagaagaggatgtgactggagaacttgaaatatttgaagaaataggagtggtacttagatttgatgatgccttgttggctgtatcctgggcagtagatttggcttcagctatagcatccccagtaccgaacaataaactgctagctggctttgccactgtatttgtactatctgatttagttgctgccaccattgaagtgcttgaaccaaaattgaatgtcggaattgcagggattggagatgaaacaggtgggctggtactggatggagcaaatgtggtcgatacagtggatggagccaagctaacttcaggcttatcaattggtgttacatttgataactttgatgatgatggcagtgagaaaccattgctcaggcttgctgtagttgatgcagcagatgcaaagtggaaaggagcagccgagggtaataccttatctgatgatttatggacatcttctgttctttctctttcattacctccctccaaattagtgatgtccaatgttgtgggcttggtgacactagaaacataaatagcagaaaacataagcggttactccatagatagaaagcaattctacactacaaaagggatatcctattttaaagccctgttatgttattttccaaaaaattcctccaaacagcaaataagtaatcaaagattgaaaaaaaaaaggaatatcctgataggctgtacatgcatttcaattacatatttacgatccatcctactaaaataacccttggaataaaatgtaccatctcttaacatgtatatacaaattatgaccgagttaaacaagagtactgtacaggatcttcagcctttacatacatgtcatgtcattgtgagaaaaaaaaccataagggacttctcaagtcaatagctagaatgaacattctttttagtaggttatgtgttagtaacaaatgaatttgcaagcacttgaagaaaaacgaatttgcaaatactgggttgtctttgttttatagtttttactcttcctccttccagaagatgaccagtgcaaacaattaataaggagaaaaagggaaatagggagtgccaagaaaatcacctctccccaagtcttgcttctgtttttacatcagcagtgtttgtttgttctgaatctggtgtactggactgcttgagaccaaatatagaagatgatgcactgatcagcttatcgtctttatttgaagcaagtggcaattgtgacacagaactctccagaagggtgccagaaggtacatgtggaaatttgaaaccattgttgttgtctgaaggaacatcatgagtagccctgttttcagggtcattaggtgaaaataagcctaatggacgggcatctttcaatgcggatgctataggcttttcactaactggagaactgacagccttctgcactgaatttgactcaactttttgtttgaataaaattggttcaactttctgctccttcttcagatcaatttttttatcagttgtcttcacctcagtcttgcccattgaatttttcgatgggataggagcctcctggtcatcatcaaactctggtagatcctgcaacaaaaaaaggtgataaagaataatctcaggacatgagtgagcgtttaatataattcgaggaaccaagagtaaactttccccatacctcaaaaacagccattttaaagcccggtttgcttgatgtagtagcggcaactgaagatagagcaacattatcagacctaatgtctttgttgcctaaatccttaaatgaatgtgacagaagttttgatgatccatcttttctcagcttgtctttactcgatggtgaaccattcagttctggatcaagggaatgcttaacactatccataggttgaaatttctgggaactactagggtcactcgtcccgtttggctcattgccttgcctaacaggttgttttgacatggagcaacttgcattcccagcagcaaattgtggaagagacagcttctcttttggtgatgggactattatattaagctgctcaaatatcttttcagccatcttgtttgattgaggtgacgcagcaagaacattatcacttgaaattttaccatcttcatcattcctacgtgcttctgcaggttccacagattgacccgtccccagcaatagtcttttcgaactaggtgaatcccgaatgggtgaaccgccatcggtcaaatctgaaccaattgtacggctgggaagaaagtttcctcgcgggctcgagcgagcatctctaaaagtagacatcatatttgacttttggcgaatcctgcgtatgggaccaatagatccaagctcattctccaattcggcacctcttcgtttcaagacctgttagggagacataggaataagagaagctctggtatgtctagtttagatcatatatcatggagaatgttctcagtggtgcaaaccctgcaagtctaaagatgttgccacgacacaacacactatcaagtccatgatgaccagcactttataccacatatatgctttgcatttgcaacgatacagacatatataagaaaaagaaaagaacctcaatagctagacagtttattcaaccgtaacaccttctcagtaacatgaacttgttcaactaagtgtatagcaaatttaaaatatatactgtatataatgcagtatatgtttccataaagtgctaataaattacctgcctgcagccagaaaccaaactattagcccgtgtctgagatgatgaaaatggtgacatatttatatcattggaagagcttggtccctgtgagatcattgttagagcatcattatactgaacaagaaaaaaattcgagcgccagtaatcagtatggcatgttgagaacacatgaaaacatggctgagaatgatttgacattatgtgcagtaaacacaataccttaaagaatggggaacaggacattctatatattgctgaccgcccatgtaatcctggagttacatagccattcacaggaagctcagagttttcattgctaaattgactcagttcttgcacaaatggtcctccaggtctccttctatcataggcaatgttgcttgcttctgccttgttcttcaggagtacttggctccgcaaactgtttggtcggttttctttcgaataacgggaattcatatattgctttgcgagctctgcgggtgaactagcaccacaaaccggatcctacaaaataaacagaaataaaattaaacacagactaaagttccaaaggaagttgaataaaaggacacacttgcttgcttttttcctaaataaaaacactgaaaaacctaagtagcaaagctgcaatatggtagttggatggagcatggaaacgaaaggtaaaatccactgccttttatgcatgtaacatgggaatttgtaggaattgaatccaacaatcatatggcataccaacactgcaaaaagggccgtttagctgcacatatcctatatagctagcacttaaacatattaaaaggtcagtaaagagctttgatgcacaatcaagcctaaaaaaaatgacagatccaacaaatccaaatcagcatttctcagcaattaatgcagcatctaacatgtgtgcacccgaaaaatatttttgcactcacgagttcaagtaacaagaaggctactttaggaactacagcctaccttgcattaaaagaatcagacaataaaaggattaaaagaatcagacaataaaaggagcttccataatgggaagatggcaaaaagggtaatacagtatatcagttggcattagaaacaaaccaaaccagcagactacagatgcctcagtaccaacaacataaactttcagtgtttgccaggtatgattaaattttctttgttggctcgaggagatttatccaatatccagaattcatggactagcatttagaataaaaaatattcatgaccaaaagaactacttacatcagcagcaatagaatgatctgcagccatcccatgtgatgtggagcctcctataccatccattgtattccttgcttcattcttattatcaaggttatctgccggtgcagacaaatcagactccacagttcttgcacgcagtaagtctgtaaggcggtcaaactcaaccctgctgatacaaaatcacattgtcattggcagcttaaaaagcacgggacagaagagatgctgtcgtttagaattttaagaggacccccaaaaagttgacaccagcaaaaaaggaaagagaacaacaatgtttgatcctccaacgattgtcaacagaagagttgaacatcacaaaaccaatatagccattacactgggggtaaatcaacattgtttgatacctcactggttaactaaaaaatcagttatcatggaagtaccacttcaagaagattaatatgaaaaatactttccttgtgaatgttttcctcattaacaagtgctctacttcagacaatgccttattgtccgatgcaccagtggggttcttccctttctcgaggattggttttgaaccctgcatcagattttgttatataaatataaaggaataaagggtaaaaaaacaccaagcggaatataataggttaaccaaaagtataaagcacaatttgccaaacaatacaaccgattttttttttttgcaagcacttggttataacttacagtttgtgttgactcaggtaagccttggtttggctcattattgcttcctgcatgcatgaagcgactataaaattagtaacgtactgcagcaccaagcacaaaattatcaataggtaatactacaggcagacaaaataagaccatatcatactgtattctttccatatggttttaaataaaaataaaaagaccggatattacactgaattaagattgttttaagtggcataaatacattcatcatactacacttgatgtttttaccttggagcatcaaatccttctagtctttgggacagacaagcaaatagtacactgctatggttttaaataagagaatgggacactctggtatgatttaaagttaaaacacacaaataggaggtgatgaaactccacactaaacttccattgtagaacagcgtcattttcatcacgagtctactgctccatatcaaggaggatagcaattttatagctaaaatcaatcagactagaagtaggaaccagctaatctgagctaaaccctagaacgccctggatgattgaaaccctagcgcaaagctaacgagcacgaaccgcgggagcaagcacgagtcttcccagatgggagcgtacaggaaccacaggctcaccgggaggcgtggacttcggcggggccggagccggcgcagggtcgaggcgcttgcggaacaccgtcgagaacagccgcgccgcgccaccggcgatgaggcgggacgccgggtccaccagcctcgacacccacccaccaccaccaccaccaccctgcggcgggtacgcgtcctccgcctccgccgccgccgcg

SEQ ID NO: 6324 - DNA, 16506 bp, Oryza sativa
ttcctgcagcccttcccttttggtgctagccgtaggcgcggggcgcgtgctgacaacgaatacgtatttcgtacgcccgccttcggtttcctcaagcttaactaaccgccgcccccggttaacgttcgagttcgagtcggggccggctaggctagagccgttacgccccaccaggattttagcgggaaattatgtgttactattaagtcgtctcatttaagacggagaaatttgaagaaattttatgtacgaaaatcctgtaaaattcatatgttcgagaaaaacactatatttgtagcatgtgtaacactccatccgtcctaaaatataaacaattttgtattttttatggtgattaagatggtcttgattggtcaagttaaaaaaagtgcgtgtaagatggttataattggttaagataataagactggtggagaagttatattttaagataaattttagagattaagatggctagttgttgtactttaggataaatttttaaaaatagaaccggttttaccttatcgattacaattattagctattagctagtaggagttattgttacgcgttgagaaccgttatcgacaatttttgaagaaatttgttataggtgcccattgataacaccgggtatcgcgataacgcaaaaaccctgataagaacacataagtctcataagattccaagcatgtatgcactcgcattcacaaatagtgtctgtgttatatccgacgtccttacatgtataaaaaacaggtcaaatatccagaggtgacctgtaaatgccgagttgcatgaaacaaaaaccattcgacgcacgcggagcggtctacctaaaatttgcttggtagagctaataagcatgggcaagtgcatgctccacaacaaccgcatgtccgcatccaccatgatcaaacggctgccggttttgtgcttgtgcattagggtgataatggctagtcagcaagcaataaccttgtctagctgattgggtttagtcccaaccatgacaggtgatcgacgctgacaagccatcaaggaaatgaagcaatggtcccatttcaattcttccatgaaagcgaccggactccacagccagagcagagagacagatcaacgacagggcaatgtccaatcaagtatactgaacataagcggcaattgactatagttattgcataacaccagaagtagtaagatgttcaactcagggagattaaaccggctttagtggaacatgttgtggtaggactatgggagttctgcaagtacattgctgtgactccagctgaatttagatgagagcaagaggtgaaatgaacccgatgctgaacccaaacgagatgcaggtcagttccttgttgccgtcatctagtagcctcatggtgagagtgtaagaaccctgcaacacaatattatgttagaatgtcatacagaaagttagaagtcatataaggacatgttctctatcccctcttcttgggtagttaggaaattcattaacaaaagaatatcttcttcaccaacagaactaaaagcatgctgcagctatgcttactggtggggtgattgatggtaaagtctgttcgtgcgcaagcacgaattcaccagttactgggcaagaggtctcctcacaaaggttgtgactttctgaatggacatggaaaaagaagtacttgacatctatcacgagcttccccttagtgatgcttttatctggcagcagtcatgaaaaagtccccagtcagtactcaaaggcaagaatctactggcgtaaaactttatagtagtagcttttaaaaatcaaatatcatcataagaaaagtgagctaggaagcatatatttgtaatgtatctttgtattaattgaatactcatcattaacttcaaattatatgctatgtttgctttcctcaaacaaattactgaatgaatacagcctcaacaactcctcaattttgtttggcacataatgtcatgaaatatgagcaaaactcaaatattccctataaagaaagaatccacgcatctaccgaaatatagaaacaacacatgggaaaagacagtgacagcagctgtgctgccagagcttcatacattcaaatatccaagcctatgtactgtagtcatgcttaagccatacacacacttgacaaccataccaagaacttttgatgaatcagtacttcactgagtgttaagtgagcagtgccatgatacttgtcatgcaacaaacaaagttagtaaaatacacaaaagtaaccgacatgtcaagtggaaagaatgcacacaactttatcgacttattgttggttgatctttttcaactataaacggaggtattctagctttcctcacaagttatctaaattaagtagacagaataacaactagaaacttctaatgtgtcaaatagtcccagaatattaacggttaatgctacactatgtctaatgagatgaataagtattatgatgtttacagaaaacacgtgttaatacttttgttttacttagtatgaagtgagaggccgcatcatatttgtattgagcaggatgttggacaaacaatataaagctaattaaactaagctaattaaactaggtggacggaaattcccttgttctgttgctgaatttagacttgtagctcaaatgtactctacagaaagggatgcttcttgaataaaatcgaaacagttagcttatccttatttgtagaaattctctcccctttgctatcagagcaatttaagcgggatcacaatgaacacgtgtcataacagtgcacagatgatgaactccagggcacccagtcatagtaagctcaaacacgggcatcaacaaacaaggaatgggcatgaaactatggcaaactacactaaatccagcatgcatatacagatgcacgcattgtcacaatttgcaagttgcaaccaacaaacattaggtgctccatctgcaagtagcatcgcaatgaaaaatgccttgtgaagggcagtcttaacagaaacacctgcaggctgcagcgcaatatttccatgttctaagtttctaacagccagcagtttgttctttacttccttacaacaaaaattccatcgcatggttgtactgttctgcaaattggaccaattcaataatgccagtgaatggacagcgctacaaaacccacactaatttgactcccgatccgactactgcatatgcccagtaaatcccccaaccgcatgaccgcactaaactgcaacccgccgcagtaacagatcggtgcttggtgcttacccgtggatgcggagatcttgaaggtggccggctgcccgctgacgacggggtcagggacgatctccactccgctcaccttcacaggataatcccgcccctgccctgcagcaacaaaccccaccccaccaaaagcggaaacgtaagcttgacacgagacgggaggcgagcgaagctgcggacgggaagggcctcgaagcactcactgcagtactcgacgtcggtggcctcgccgcaggccgggaggaggaggagggtgagcagcgccgcggcgaggaagacggggaagcggcggtggtcggtcgccatcgctgcaggtgccaaagctccgcgtgtcgcgactcgcgaggactagaggattcgcaggtggacacgacgcgacgcgacgcgacgaggactcaaatcatcaggtctcaggtgcgtgctgaaatgctgatggatgcggccttctcatgcctgcctagggccttttaatgggcctagttgctcaggtctactccttgcctattaattcctagtatatacttatgaaattttatcagatgtaaatacagtacaatcatattataactgtatcgtaacttgcatgtaaatgcagtacaattcgtaatttgcaaagcggacgccgtgggactaaatatcctcactcgtgtgtgcactatgattttttttcttcccaacttgcaactattattttttttcttcccaacttgcatagaaattgaagtaatcaaactaatggttcaagattatgtaaaggtaacatataagttatagttatacaagttcgaatgtaattgtactgtaattatacagtatttacattttcttcatggaacatcgggggggaagaccccacctgaattggattaaaacagtatttacatttgataaatatttggaagaaaatttgtcaatatatatagcaaaatagtgttcccgacttacaaaaaaaaaagttttgttttagttcttggctgctagtttcttgttgatctcttttattttatgattacatggaagatacatatgcttatattggtgactcgtgagtgtcttcaatacacatgtaagaaatggagaccactgatgaatctgtgatctcactggaatttactaaactgtatctacatgtccgtaattcttcgtgatctctttcatttttccttggatgaaaactaaatcccctgagctagattttaatttactaatatttcctattagtttcttgtttgagttagttcgatcataaagaatggaagagaagactgtacaccaacgttcaattgtttaatgtgatgttacttgtatttttgtatacactgggctaactagattttccttccttcagactgattgctatttttttaatatgttagatcttgggatcagttggtcattgtgagggaactttggagtaaatggagttagttttgtatttctcttctcttgcttgattggccagcttgaagctgaattggatcccgaagtcacatggacctgtactagaataatacaatgcgagtgcactagtgctactgtgctagattatttgttaattatgttttactcttaactcacatgtcatgaaagcttgaaagggactaaatgatcattatcaaccaaagcccggtgccattgatgcaggaattgacaccgacgaagattgtaagggcgactaggtgcttttttggaatacgcaaggagcgcattttgtattaagagaaataaaagttatttacagtcaaaaacaaagcagcaggggagcgactaggtgcttcatgaatcatgaacaaaaataagatggcttctgcagagagctgtatgaattatgcattctgaaccactctgtctgacataaccaggctgcaatatttttcctacagggaatggcaggatttccacctgatgcttcgatttttttttagaatttatttcgtttgcaaagatttagtttgtaatctgcatcacaacgtgcagacattcctttaagctcttgttctccatgtgatcagagatgaacctgaaaatgatcacaatcacattctaatttattcagatattcacaatatatattcgactattccggtcttccggaccaaatctttgcaaatagatctgtctgttcaaatgatgtcatggagtttggtgtccagatttttgcccatgcctaattgtctatcataccaaagagcggcacagtgagtcttttatatcatagaaagactctgcagtgtgcaacatagctgaaaatgattccatagcttctgtggcaggacactgcagatgtgaaggtaatttgcctaattaagttctccttttcttttcctagaaattgtaaaagaaacatctgttgttgtcacttgttagcagaaaaaggcttgatgtagatacgtcttgcactcttgccttgtttaggccaaattagcatttttcacttttgctctcttttcttgaagagcatgcatcatgattggtatatccgttacttcaaagcacaaagtaatgattttggcgtaaactgattgacccagcaaaaacctgggggaaggagcaatgtatctaggggacggccgtatataggttgctgatgtcatcatttgatatgcacctagtagatctttgaattaattcatcaagagtacaatgcatgagtgtttgaactgaggttaatctgtttactgcattccatatcctcatcaacctcaatttctagataatatgcaagagcattaattaaaaggatctattccttttgaaatgtgcatcttcaattttacagatattcatgatagaattttacatatataaagcattctgcaaatatgttcctacttcttactttgtttacactcatcttcgttcttctgcactaagcttgatgatataaaaattagatctctagaaggttcatccaaatttgtaatccatacataatctccctccaaaaatccaaagtgaatcctaattccaaagagaatcctatgccaaactttgtttatatcagaaaagaaaatctactctgaacccaaatttacacccaattaccaagaggaaatttctagtccctatcttgaggaattcttttatgcattccattttgcagaatacacaaatttcatcctcaagtttagttttatatgaataagaaaaaaattttaaaaaatgaaaaccaagcaaagaacctccacgtgtcatgacggcctcgccattgccagcggcgtgacctcggcgagcggcgtcggcaaggggctcggcagcggcgacgtccggcagacggggcaggtcggatgctgccggagccacgggtcgacgcactcccggtggaacaggtggccgcactccggcagcatccggagcacgtcgccgtcgccgtagttgtcgaggcagatcgagcagcagctgcacgtggttgcgccgcccttcttcgtcgccgccgccgacgccgccttcgccgcctccttcctcggctggccgtacaccacctccgggtaccccttgagcgtcgcctcgtcgatgccgagctcgacgtcgtcgtgttcgtgcccggccccgccgccgccgccgccgccgcccccacccccaccgcggtgccgccgcgacgatcccgccgccgccgctgcatcggccgcggtgacgggcgcgcgcgtgcagaagtaggacgcgagcgtgatggtggtgatgaggaggaggatcccgacggacacgccgacgccgtagccgaacccgccgatgcggtcggagctgaacatgccgacggagttgccgtcgcccggcgtcatcatccccggcgccccaggcggcgcgccgccgccgctcatcgcgatcgagcttgatcaagcaatggcgatcgacgccgagccagcgagttggtggtgtcgccgcgcgcgcgccgcggctgagctcgatggtttggtgcggtttttgtttggatccaaagcgagggagggggaggttgcgagtgcgacgtcaacgcttttgcatgttgcaaacacacaacttggacagagagagaaggagacgatgaggttgtgcaatggtttcgaggtcaatggcatatgggcatatggccatggttttttttatttttgaaaaaaagattcaaatatgtttaaaataagatgagtttgtgtgtgatttgctgtggctttgtttgtccttgcgtagcttactatctgtcgaattgtttggtttgtaatggtcaatgcaatcatgtgtgtgtttgggatttgactttgcttcgacaggttgtatttctcttacggtttttattatattccaaagtcgtgtgaagcataccggccattttgaggagtttcgagtccagtttctgcattgcaagccaaggttttatttcagttgcaattatagtagtcctttcagtgccttgagaacaaggaatttctcaaggtggcatgtgaagtactattttcacttttttttttggtgaacggtactactcctgcttcacattacaacgactttgatctaaggcttggccttgatcgccctcgacatccttcacgtcgatgtaacaaactccgtaattggctatttattttttcccctctcttaatgaaattggtcaatcatcctttggccggcccagaaaaaaaaaaagagacaactttgatctaaggcctggccttgatcgccctcgacatccttcatgtcgatgtaacaaacttcgtaattggctatttatttttttcccctctcttaatgaaattggtcggccatcctttggccggcccagcaaaaaaaaaaaagaagagattttcttgcttgacctgtttgcaaatcgttgcttcctttgcattctagaagaatagaagtcacctcttgtattgtccaaaaaatagtttgtttacttatgaatactatagcgagcacttctttacaactgaatatctgattcatcgctaaataacatctttttcgccgggttgagtgaaaccacagatgcttataaatggttttgatcagatacagcgtaaacatgggcaaagataccgacttcaaatttagcaggtttcagaagtgaagttcaatgacagctacatatatacaaagtcatccaaattgacacgaggttttgcttcacacctactcaaatcaagatcaagagaaatggactgctactgcagcaaccttattccatctgaccaaccgactggtacttgagagccgaacaatggttgctcagagacagatgtgttacatccttcttctttttcttttttctgaatctttctcctctgttctgtctcgatgcagattctgaaaaataagttgaaccgccggctagtcaggatggaaggtcaactgccagaagtatataggcatcattttattttgggttaggtttggttgggttgaatcgaatatggataatgcattacttgagcagcctgcctccagtgatgccttccctaaatgcgcccccgtgttttggatcaagcaaagaacactcatgaaaaggtaaaaagaaaaaaaatagtagtcactctctctcatgagtcatgacacagaggcactgcatttccatggatagtttgcttgatggtacaagagtgctttactcggggggtgtttagatctagggttgtaaagttttggcgtgtcacatcaggtattatatagggtgtcgcatagagtgttcgggcactaataaaaaaaactaattacagaatccgtcattaaaccgcgagacgaatttattaagcctaattaatctgttattagcaaatgtttactttagtaccacattgtcaaatcatggagtaattaggcttaaaagattcgtctcgtaaattagtcgcaaagtatttaatacttcatgcatgtgttcaaatgttcaatgtgacagggtgaaaaattttagggagggatctaaacagggcctcagtagattttcagcaaatttaatttaaaattatttatcgattttacaagaacaatagcactaaaaaattatgtaaaccatccaaattaattatcgctcttgttttgatattccaccacataacctattttgttgcaaaagcccactcactcagcactgccaagtccatccccttcacaaacatttgattcaacccatttcttctgacatggattcgcagcggaccatatcagtgtggatagttatatggctagctatgaggttagtttgactcaagctcgtccttaggttagttgactctaacccgatttcacctcacaaccacattttatgagacgatatggctgataagtaccactataaatccacgtatgaagaaaaagccgaatagatattcatgtatgtagagaggcagagataattttgacgtggcaatgttggttggataggcttttacaataaaataggtattttgggatgggggagtaatttgctatggcaaaattgtttcaagcattgaaacgatgtttagctgtctcccaagtcccaacttgtacactacaaagaaaactcacgatagggcagcagcatatcagaaaccatttgattgtttaagcagcattatatatagaaaccattttattgtttactcatatcgcccgtcatcttgttgcagattcatagccgcatatatcaaaaaccatatgattgtttaagcatattttagaaaccattttattgtttactcatatcgcctgtcatcttgttgcagattcattcaaggctgtcaacgacgatcgagggcgtgccgatgtaccagcggccattcatgaaggggaagctagctagctctacatccacttctccttggaaatccctgactcgttgaaacaaaatctctttctgctcttcctcctgtgtggtggtgctgcgttcttgactgctgtgtgagacattgttgcttccttgagatgacgagccgtatgccgtagcagatggcaccacgaatggagctgtcaatgcgcaattgactcggccgtgtaagcatcgcgtcttggccccccggtgtcgcgatcagaatagcaaaagcgttaaattagacttggcaagtgaacttattcctgttctatatatactccaatcggagcagctagtcggccgggacgggtggggagaactagggttttactgttcctcttcgatcgatcatcactcgcctcgcccatgtcaacggcggcgctggtggcgcggctcgcccgcgacgtatcggccgcgcgagacgccgcccgcttggccgcggccgccgcatcccgcgccgcgcgctcctcggcggtcgcgtcgtccagtccttgcgcacgctcggcggccgtcgtcgcagcacgtcgcgcggcacgctcagccgccgccgccgcatctcgcgccgcgcgcgcggtgtcacgcatcccgtcttataacctcgacgactacagcgactacgagccaactcctgctcctcccagcccattgccatcatgtaagccaatcctcccccatcttattacgggccttctgatccgattgccataatcaggttaggggcatattaggcaggataactttaaggaaccaaattgaaacttgcaagccaattcgctgttcttgacagtattaatgttgtgctgttgtgatagatggtcctgagccagctgacgatgagacggacaaggattttgagactgatctagttgacagtgtgacggacaaggattttgaatctgatgaagccatttgggccttctatgagcgctggtgcaaggcttacgataaggagcgtgaccatgctgagatggctcaccggttcaagatattcaaggaaactgcagagcttgttcatagatccaacaaggatgctccagaagaagagaaactatgttttggcccatactgcgatgggttcgatgagcaacagagggctgaatttctgcttaagtttggccattttcacgggattcacgaatttgtagagcagtggaagatcgacttcccaaagccgcggaagattgactccccaaatcaatccccatgaatcaccaaatctatcctaatacgggtagacggaccaagttctacttctctatctttatctttatctcaactattataaaaaataaagatgtttttgtcggtattttggcacgtgatccgtatttgagtcggtttttaagttcgtttgcttttggaaatacagttctgtgtttgagtcagtttttaagttcgtttatacttctaaaaatacaaaagaagtcgtataagaaatttcttttaaaaaaatgctaacttgaaatgaaagtcaaactcctagaaaaatgctaacttgagatgctcgacgccttcgccaccgccaaacccgctggcacgagcaggagcacgggctaaggattggagagaggggaggaagaagaaagaggaggagaatgacaggcggaatccattggttaatagagtggaatgtgaatagtatgttggaatagaagataaatttgactctctaaatttttatcagcctggcaatatagatatttagagagtcaaaaataaccactccgttagaggcatctctaacagcccacaaacagctagggttgagttgagggagcctggagcgcttccacctccagcatctattcccttcgtgcccgatgcccgcttccacgccgccactgaccgctgtccgcgccggcgccacgccgcgtccgctgttagcgccggcgcagcccagtgccgagccacaccacagcgccgacgcccgtgggtccgccgtccgcgccatcgcggcgccgagctgggggccgacgacgttacaacttctccttgtatcgccagtcgccgccttgctgcgggacgtcggccggttgccgtcttgtcgcagagccgccgcccgctgtctcccgtctggcgtggcgtctaccggtgcccgtctccagctctccgctcccggctgcttcataaatcgatttgtgattcatgaatctgagaatgattgagtatgcactttgtaaattgtggttgttgaatgttgatttttatcgcatttatattaaatttgtacttgtgtatcggttttttggtgttagaaaattttagcatgtgttgtgaacctacgaactgaacttacccaaggaaaaaaattcatggctactacactggcagtcaagaacgcagcatcaccacataagaggaagagcagaaagagattttgtttcatggaccagtcggcgcagaaagattgctatatatccactgctccaattttgttcatctactggtcctcttcgatgaagcagtagtatccatgaaacaaaatcggagcagcagaaagattgttatatatccactgttccgtctcggccgatactactgcatattaatgatatatatatatatatactccaatcggatcagtcggccgggacgggtggggagaactagggtttaccgttcctcttcaatcgattatccctcgcccatgtcaacggcggcgctggtggcgtcgctcgcccgcgacgtatcggccgcgcgagccgccgcccgcttagctgcggccgccgcatcccgtgccgcgcgctcctcggcggtcgcgtcgtctagtccttgtgcacgctcggtgtcgaaacaagatttcggcaataataaaagggggtggctatcaagctaggaaagtgaatgggtttggagaaaaagaattttatacaggtttaggccttcttattcaagaagtaataccttactcctgtccggggatgattccgccgagtatgttattgattgtatgattgggagaaaaaagaaatcgtcccgagaggaacccggacccctccttatataggggaagggatccgtaatacaaaatacagtccatatcctaacggaatatgggattacagataaaatacaatcgtaaccgactagaatcctgggtattttcttgacatacaagtttagaatctaacccgagtcctcataaagatattctatctatatttggtaccatatatccagctggaatataaccgccatgtagatatggggtaaccataatctccacagtagcccccgagaccttcgcagttgaccaaaatagtcttctcgaaacaaaaaacaataatctgagtgcttcaattcaacttgctccggcttaccgagtgctagaagactgtgaagggcgaaaataaaacatggtgcatcgagtagatgcacctaattaggtgtaacccccgactatgtgattagttgaaaaattaaacatatagtcaagaaccgagtgatcttatatcgaagcatgcatggtactcaataaaatacccagccgactgcttctcacttgaatatatcaaggacaaaaaatatgaaaagggccgagtgataaacactcaaaggtccaaaaatagacatgtttgataggaatccgagtaagaatctcataaaatgacccatcaaacatgatagaaaatcatggtaattaatgagtctaatagcctaggctgtgacccttaccataaccaaaataagcatataacatgctgggagaatgactactaacaaaccagtcatctcaaattaacccaacagctttcgtagcctaaaaaagcttacaaaaatggtataatacctttatgttgggcaccttttcatgtgcatcataataattccaaagaattattgaatcgcgttaaaaaggatttcaacagcatcgggccgcatcattgtgagcacatattgccaaagcaaaaagcgcctaagtccctagggatcacaacgggccacgctgaaaacataattgggctgaagtactgtacaggccagggcccattagtactcccgataccctaaaaacaccgaagtccaaacgtcgtttcgtcttccccgctgagactctcgccattttccccatttcctgctacagtacaaaattgcgccgggcaaactagggttcatcaatccgctccaatccacccttaaaaaacttcacgaaatctcttcccgcatccaccgctccgattccccatccctttccagccgtatctcgaactaaatcaaatcatcagttctcattcatggcggaagaaagagaaagcttcgagagtcagtgggcgccctccgatgtgacggaagacaatctgaaggagatggtggcgcacgacgttcttccagcaaaagagatcatcgggtggcgaccggcatttggtgaggcattcccgacccccgatacacacgaaatcgtggtatttgctcatttcttctatggcggattttctcttccaacctcaagatttttccggggtattctgaacttctacgggattagcttgcatcatctgaatccaaattccatagtgcatattgccaattttatccatgcctgcgaagcttttctgggcattaggcctcatttcgccttattccgccgcattttcttcctcaagccccagccaaataagagcaaaccatgcgtcgttgggggtgctggtttccaactcaggggaacactaagccaaaaatacttctccatgcccttcaagacctcaaataaaggctggcacgcaaactggttttatgttcaaaaccccgagcctgttcttcccgagtactcctgtcttcctccagtttatcgggatacttggaactcactgctaatgggagacgaagctgcacaagcagtagaactgatggagaggatgataaagctaaaagaacagggccttcaaggagaacagatcacccggcactttatcaaatgtcggttagctccaatcaaagaaagatctcgcacagccttcgaatttgacggcaagcatgacccaaaccgtgaagatccagattctcttgacttcaaggtcatgaaggaaaggatgtataagctcttctcaaacgccatcgttgtcagctactcacacttgctgccagtcgtaccgttcaatgcattcaatcctcctccaccagtacgtattcatacacttcaatctttctcaaaatatgatcttgttttcttgttgaatcagctaacaatgaaggatattacatccaggaatttgctttgatgcagtcggatcccccaatcgctcaacgccgatctccccaccaccaaactgggcaagggagcggaggaccaagaattcggtctgaaactcaacctagtgcttctgatccagtcggccagtcagattatcgaaagaggaagttggttctaagtgacgacgaagccgatgataccaccaggaggcctgaagaccgagagacgaccaagaaactaccaaaacaagctactccaaggaagaaaacatccagtcgccatgtgccaaagatcaggaagtcttctaggtgcaactcatataacgatctctcttgtattgatacgcacccattgcggcaataatactgataatcaaatttgcaggaaaccatctgatatagacccgtctggaaaagactctgacccgactaacatgggcacgaattcttccaaagaaaccgggccaactgttggggatcacccgagtgacaatcatccggcaactgataatgtagaattcggtgatcaacccccaactggaaaccagtcggccgaagccgaagccggagttaatcaggagcccccgactggaaaccagtcggacgcagggccaagccaagagattctagaagtcgaaacccaagcagacagccctcgcagacaaaacgcggacaataaccagagatctggatctcctttaaaggcatccgaatccgctcgtcctcgtccagaaatcatcacgggtaaacactttgtctgaaaccatgttgacccaaataactctgatcgattgtctaacctttgtcagtgaatacattaggaccaatgattggtgatgaagaagaaatcccccgtatacaagcagctgaggattcatgccctccgattctggtcaagtggtgggatgacaacatgcagcctcaagggatcgtgataaataagcaaaaagaggacgaagagttatgcctactgaagaaggcacttggtcaggcaacccgcattgtaaatgtaagccctctggtacctgatttcaaccatcttgtttgccatttaattcacgcgctaattaaactatcttgcagaggattcatcttaggaacgaagccaaaacagtaaccttagagaggttagtccctcatctcggaaccctcgaagccaccaggaatcaactgcacgaagtgaaagaacttgctaggaagaatgaacatgatctgagggatcggatcgctgagctccaggaatcaaattttacagggctgcaggaa

SEQ ID NO: 6325 - DNA, 6175 bp, Oryza sativa
acaaagagacctggctttaaaggaagttgaaggtatcaacaatgaatacctcaaaagccattatcctccatatgctaacttattaatgtgaatctgttgatgcagaccgcaagatcaatctcaagctcaattcgacgtcctggttggcaagatcaaaaaactcgaaggaacccgggatgaggttgctaacgctgctgccccaattgttcaagcgatgttcttcaataacaacggcccgagtgtacttgatgcttctgaaattttcgacaagctgagagttgctccggatacatatttcaagaacatcaaagaagctggaagtatgggagcaagtctggcgttggcgatgaccaaatctctttattcgagggttgacgttgatgccattgatggctttgcagacgggacgagcgaagaagctgctcttgacctcatcagcaatgcacaaaaagccgctgacaagattgctgctgatgtagttgagagatttcaggacaccgatcttcgaccgactggtcctgataattctgatgatgaaaagactgatactgattactgtaccaatgattttgatgattaatgatgatggaggcacaatttgtacaatactgatgaatttatgctatgcttgatatcttaacttagttcctgatttcttaaaagtttttgccaaaccttgttgagcctaaaacccgcaaaagttgttaaaaaactttcagtcctcattgactaagccaagaaatcaaacagggcaatgatacatcaagtaagcaaattgaattgataaaaatcacactccattattattatagtagccccctgactgaaaacttcaaggaaaaacttgaagttagcagtcaaagaggagagatacaaacgaaatgcctaagcgtaaaatcgacgaaggtgttcaatattccaagaattgttgataagagtaccgtcttcgcgcttgagtcgataggaacccggccgagtgacttcagcaattatgaacggtccttcccataagggagataatttatgccgatcctgtattgtttgaattttcctcataaccaggtcaccgactaaaaaggctcgcgatcgaacattccgattatgataacggcgcaacccttgcaaatatcgagtcgactgaattaaagctgcttctcgggcttcttctagtcgattgatgtcgtctactcggccctcttcatagccctcctcgttgaagttccgaaatcgtagcgattcaaattccacttcactcggcaacattgcttctgcaccgtaaaccaaaaagaacggcgactggccggtagcccgactaggagtagtgcgtaaagaccagagtacggacgacagctgatctacccacttaccagcatagggacgtagccggtcaaaaactcgtgctttgatcccttgaagtatcatgccgttagcgcgctcgacttgtccgttactcatagggtgtgccacggaggcgtaacaaattttaatactgaagtcttcacaaaagtcttgaaatgctccgccagtgaattgagtgccattatcagtgatgatccgattaggtaccccaaaccgatgcacaatgttgatgaaaaaatctctagctttatctgctgtgatcgtgatgactggtttagcctcaatccacttggagaatttgtcgatagccacaaagagatgcgtgtaaccgccgactgcccttttaaacgggccgaccatgtcaagcccacagaccgcaaacggctaggacaacgggatggtttgtaactcttgggctggcaaatgagtttgtctggcaaagaattgacaaccttcgcatgtccgcacaatcttgtccgcatcggacacagctgtaggccagaaaaaaccttgccggtaagctttgccgacaatggtccgtgcagcagcatgattaccacaaataccagaatgaatatccttcaacaactgtctcccttcttccaaagacacacagcgctgcagtattcctgatggacttttcttgtacagctcagtctcatgaataatgtaaagcctgctgcgcctggaaatcctctcggcttcatttttgtcttgagggagttcttgtttgctcaaaaattttataaacggttctctccagtcagcttcaatcatgcttacgccttgagcatccatggcttcgactgtctcttttctgggcacggtcggtttataaagatgttcgacgaacacatctgaaggagctgcttcccgttttgaaccaaaattggccagtctgtcggctgcctcattgttatgtcggaggacatgggtgagctcgagtccatcgaatttattttccaacttgcgtacctcttgtcgataagcagtcatattatcatctagacatgaccactctttcatgacttgattaacaactaactgagagtctccacggacgattaatcggcgaatgcctaaagagattgcaatccttaatccatggagtagcgcctcgtattccgccacgttatgggacgcagaaaaatgtatccacaatacgtagctcaatctttctccagtcggggaaatcaagacgaccccagctccagtgcctgtaagcctcttcgacccatcgaaatgcatagtccaatattccatcttttcctctggcatgttttcttggcactcggtccactcggcaaggaaatcagctaaagcttgtgacttgatcgaagttcgtggcttgaatgatatgttcaaagacatcaactctaaggcccacttcgcaatccgtccatttgcttcgtgattgtgaagtatatctccgagtggaaacgatgtgactaccgtgaccgagtgactttgaaaatagtgagataattttctgacggtaattaagacaccatataataacttttgaacctgaggataccttgtcttggagtcggctaaaacctcactgacaaaataaattggtcgttggactttgtgaatatggcttcctcttcacgctcaacaaccaggaccgtgctcacaacctgagaggtcaccgacacatataacagtagcggctcttgtggatgcggcgaggccaaaactggtggagtagtgagaagtctcttgaacttttcaaaggctttttatgcttcgggtccccactgaaaattgtcagtctttttcagcagcttgaagaagggcatcccccgttcgccgagtcgtgagacgaaccggctgagcgccgccatgcaaccagtcagcttttggacgtctttttggaagcttggcggtttcatgttgaggatggcgttgattttctccgggttggcctatatgcctctttgagataccataaatccgagcaactttcctgacggtactctgaagatgcacttttccgggtttagtttcatcctgaaagcacgaatgcttgtaaaagtttcttctaaatccgcgatcaggtcatccttctgcttggtcttgacaactacatcatcaacataagcttcaacattgcgaccgatctgagttgaaaaacatcaatgaatcatgcgttgataggttgctcctgcgttcttcaatccaaagggcatggtgatgtagcattaggctccaaagggcgtaataaacgaggtcttcaagcagtcggattcttttagtcggatctaatgatatcccaagtaacagtccaagaagctgagtaactcgcagccggctgttgagtcaaccacctggtcaatgcgaggtaacccaaaagggtctttgggacaagatttgttgaggtcggtataatcgacacacatacgccattgccccgtctttttccgaaccaggactgggttagccagccagtcgggatgaaggacttccttaatgaagcctgctgctaacagcttggttaattcctccttgatcgcatcctttctgtcctgtgcaaaacggcggagtcgttgcttgatgggtttggcgtcttccttaacatgtaaagagtgctcaatcacctctctggggataccaggcatatcggatggtttccacgcaaaaatatctttattattttgaagaaaggtgatgagcgcgctttcctatttacaatctaactcagcgcctattacagcagtcttatcaggatcggagggatctaagggaatctttttcgtcttggcatcgctttcttcggtcttcgtcagcttggttgcaggcacttctccctcgcttgtcgtggtcgcagccagtcggatctcttcgcgggcgagaatagtctcgtgggtttgggcgatctcgcaactttctttgtcgcatgtgacggcctgcttgatgtcacttcgtagtgatatgactcctcgaggaccaggcatcttcatcatcatgtaggtgtagtgtgggacggccataaatttagctaaagctggtcgtccaagtatagcatgatatgctgtctcgaaatcagcaacttcgaaacagacattttttgtgcgaaaattttcccccgtgccgaaggtaactagaagagtgatctggccgagtggtgtagctgacagtcctgggataacaccgtggaagggtgcattactcggctttaactccgtgcgaggaatctgcatatcgtccagggtcttacgaaaaggatgttgagtgcgttgccaccgtcgatgagagttcgtcggagcttgacattgcgaaccactgggtctagtaccagggggtaccgcccctggtggaccactcagtcgggatgatccgagcggtcgaacttaattgctatctccgaccaccgaagatattggggcgtgttaggctgaaccgcattgatctcccgttctgttagcttctgttttctcttagactcataagccaggggtccgccgaagatgtggttaagttctttgcgatgatcttggaaaccagtcggggcatcgtcttcatcatctttgttctttgatgtgccttgatctccgtctgaaggtttacgtgcgttcttgacgtattgctccgcgaactgtttgtagacgaagcaatctttggccacgtggttggagttgggatgatgcggacattgggagttctttatcttgtcgaaggtgttgacgcgggaacgttgtcaggatgatggagaggtggtcgccacaagttcttcaggcttacgcttgcgatccttgtggttgttacttccactccctcctgcggtcggcgtgtccttctttggcttccaagtggtgcccgactgtttggacgcggtaatagcatcttcggctttggcatactcgttggctttttcaaacatctgcttaaccgtcctggggggtttacatccgaacttgccgactaggtcctcgtggcgaatgcctttagtgaaggcggcgatgatgacgtcgtcggtgatgtcggagatcttgttgcgttgttcggagaagcgccggatgtaatctcgaagggattctccagacttctgaacaacgttgtagagatcaaattgtgtgccggggcgttcaaaggtgccctggaagttggcaatgaagtgatcacgaagttccgcccatgatccgatcgtgccacggggtagtccgttgagccaggattgggcggagtccgctagggccacaggtagatagtttgccatggccttgctgtctcctcctgctgcgcggattgcgagtccgtagacggtgagccaagactccggattagtggtgccgtcatacttctcaattccagtcggcttaaagctggctggccaatccactcgacgcaggtcattagtgaaggcagctactccatccacgtcgtcgtcgtagcgatttggtgaatggcggtgacctcgcgctgcacggcgctggttgatcatgtcgcgaaggtcgacgggacgctggtgaggtggagagtgaggccgtttagctcggcgctccctgtgacgttcgggaggcgagtgaaaagatcgttcgtcgtgacccctgctcctgcgactagatcctgtgccgatgatgctgaggcttggctgatgataatcatgagatcggaagtgagggactcggctactagtcggggtacgggtgcttgcggagttggctggaaccgaggcagcgatcatggtcttcgtctgattcaagatgttgacaacatgatcagcttggttgagtgtgtcttccttgaggagggtgtcgaggagagtgattgccgcaaccgcgttctgctggggggtgcgaaagaccgctgt

SEQ ID NO: 6326 - DNA, 3005 bp, Oryza sativa
gtgtagttatcctcagagctgtcatcgaagttgtcgaggtcgccatggtcatagtggtagccgaaatcgttgtagtcgaggatctcggttggtcgagaactgacgccgggggagctaaggtaaccatccaactcttccgtcgagactgtcccaagaggttggagtataacgccaacctctctggatctagattggatcggggccgaagccggagctctcctagatcttcgagtgggagatgtcttgacagtgaaaacagcggccaaatcatcaggaagtttcatcaggattgagggataggacccgtcgtcttgatctggtcgcggaagagtagattggatctcgtccgagtggtttgaagccgacttgggagagatgatcttggagtaggcctcggccgagttcggaataccgaatggcacgaggacctggtctctccccaactggtttgaatccgagtcaaggagagagatcttgccgaagtcgttggtgatgaagttgaggctgccgaaccggaacgcctgcccaggaaggaaggcgcagtcgtcgatgccagaaacgaaacccatcgcacttagtcggcgagaacttgacgcaacccctacctggcgcgccaactgtcaaaacaagatttcggcaataataaaagggggtggctatcaagctaggaaagtggatgggtttggagaaaaagaattttatacaggttcaggccttcttattcaagaagtaataccctactcctatccggggatgattccgccgagtatgttattgattgtatgattgagagaaaaaagaaatcgtcccgagaggaacccggacccctccttatataggggaagggatccgtaatacaaaatacagtccatatcctaacggaatatgggattacagataaaatacaatcgtaaccgactagaatcctgggtattttcttgacatacaagtttagaatctaacccgagtcctcataaagatattctatctatatttggtaccatatatccagctggaatataaccgctatgtagatatggggtaaccataatctccacactcggcggccatcgcagcacgtcgcgcagcacgccaagccgccgtcgccgcatgtcacgctgcacgcgcggtatgttacctcgacgattacgatccatcaggtaagctaatccccccaatcttattagagcaagtttaatagtatagccaactactaactacaaatcatctatagctaatgtaatagccaattcatataatagttgcttactatactattaatactcggttctacctgtcatacgcacattacgtcttggagtccgtgctgcagctggctacagatctatagcccgctgctcttctctctcttcgtttatctctttaaaatatgtttatagctggcttatagcctgctattgtacctgctcttacgggccttctgattgccatcatcagggcatgggcatattaggcaggatagttttctttagactagaaaaagtgtgcgttgtaacaggtgaagctattttaatcttattattgttcattgaaattcaccgtgagaattgtttagatatatatttttctagaaaatcatatcaagttagcatgcgaatcttttttttaaagaatttcttatacgactcattttgtatttccaaaagtgaacgagattaaaaccgaacttaaatatggatatgtatttccaaaagtgaacgaacttaaaatccaactcatacacggataacgtaccaaagtaccgacaaaaacatctttaatgtttacaatagtagacatttatgctcgcaaattaggaaccaaattgaaacttgcaagccaactcgctgttcttgacagtattaatgttgttccattgtgatagatgatggtcatgagccaggtgcctttttgacgaattttgatgagtctgctgacgattttacggacaaggattttgagtctgatgaagccataggggccatgtatgagcgctggtgcaaggcttacgataagaagcgtgaccttgctgagatgactcaccggttcaagatattcaagaaaaatgcagaggctcttcacagatccaacgagggtgcttcaaaatatgagaaaatatattgtggcccatactgcgatgggttcgatgagcaagagaaggctgaagctctgcttaagtttcgccattttcccagggtttgcgaatatgtagagtcgtttaagatcgacttcccaaagtcgcgggagattgactccccaaatcaatccccatgaatatcctaataagggtagacggacggaccaagttctacttctctagctatctttatctatatctctattattactagaaaaatgcccgtgcgttgcaacggaatgaaaaaaaagaagaaaattgaattaaaacatattaaattctaatttaatgaaatataaattttctgcaatattaattacactatttgaaattatagcaaaattggtcgtgcgttgaaacgaaaagaaaaaaataaaattgaattagaaaaatattaaattataattaaatgaaacacaaaatttctgaaatatttgggtattttttaagtaggtaggtatataattaaattaatttataagtaaagtaagtgtgagaaataaaatgttatggttggatttattttttattaaattttctatattaattacactcattgaaattttcttgaaatttacatagcttaattgctatttttataatacaaacatcatttcagcatttattgaaataaaaatctaaataaaaatccctttatctctatgggcctttttcagcccactttcttcttcagccctcaagcgaccaaagtctaattaatatccccatactcctcctctcgcttgctggaccaccggcccgcgtacggcccaagtggtttggcccaacgctcgatcgatctgagccgttcgttttaatggacggctcggataagttccaaattgatgagaaccctaaccctccccct

SEQ ID NO: 6327 - DNA, 8562 bp, Oryza sativa
ggcagaccgctccctctccccctctccctcccgtctcacggcgtggcgcggcgacggcggagacggcggagatggccgtccctccccctcttcctcttcctctccctgtcggcctcgacggccatccctccctccctacctctcggtgacggtgccctcccaacggcggcatccgcgctccctcggcgacggccgtccctaaggcaagcgtcgacggcgacgatggcgtctgcagcgtccgcgggtggatccgttagcagtggcggcgaccgcgggcggatccggcagcggcggcttcctccggcggcggcatctgcggccaccatttttttcttttgcaatttttttccatcgttattgctaaccaaatcggattgcatacagatgaaaacacggacgaaaattagatgtgacgaaaggaaaaatacgaatatttatattagttattagttatagatatagattaaatgataaaatatgaataatactttatgcgtaacttattttttaaaattttttcatatatattttaaataaaacggattgtcaaagattgtacacggaaacccatgaatcaacttattttgggacagcatgtgtgtgtatttttttttaagaaaaaattgaagctcctactttaataagaagggaaaatatcgtgagttcgtgacttgttgcctggtggccctggtcacagtcacagagctagccttatctctatcttcttctcttttttttttggtgagaacagccttatctctatcgctttactctctctgtccctggctttcttcgtctctcttcatgtcgccggcacatatccaccaccggctccaaccctccccaaccgtggcggagccccctccctctaccccggcgcccgtccctccgggctccggcatcctcctgcctatgccgctcggcccgtgcttcgtcgcaccgctgccagggctctcctcctcctgctcagaggcagttcggtgacgagcgggttggagcagcctcgcccctcctcgtctggatccagccgcaggcatggccacatcgccggctcctctactgctcctctcctccatctccctgcgctcaccgttcctgatgagggcacggcgactcgaggcgacggctgcggcgactcggtcttccagactcgtcccgccaccggctacggcctcaacgggcgatgacgggcgacctagccgacggatccatcggcgtggaggtctggggccgtcagatttagccgcatccgacctccatggtgacgggctgacggcgacagcgggttgcaggtgcgacaaatgcccctcctctcctctactttccctcggtggcttggccggtggatccatcggtgtggaggtcggagacaggcggatctgggagatgcgatggtgacgccaccccgtcccgttcttcctcccacaccagaagaaggagcagtgatgataatgaattactcttgtgctttgttgatgtttattcatgcttttttttctaatcttgaggatctgggttgttcatatgttaaaataaggatatggggattattgtttgttgttaatattttcaccttcaatttgaggatctggggcattgtattgggggattggggcattgaggagtcaatgaagagaatcgggctcaataaaatggctcaattcgagccagtcaaggttttttctgtgtgatttttatttttattattcttcctgtttgtagttttctcttcctctgtgttctgtgtccgattggattttgtaccgatctttaaacttgtgcaatatcgcttgtgttcatggcgcgtgggaacacaggcctcgctcgatcggacatacgaacgagaaattaatgtgacgaaaggaaaaatccaaatcttttaattagttaagataaaaagaaatgaagaggtttttgtcggtattttggttcgccaccgctagccaatgaataaaatgaataatatgttttggtggtccattagtctagcacacgcgtgcgtacgtcgtctatcatccgcattccacgcgcgtcgtcgtccgagcgaaaccagataggtttccacttcccaatcggctgcctgtagcacacgatcgcaaatttgattcagatcagaattctcccacgcacgtttgtgccgttaccacgtcagcaggccagcacgcgcgcgatcgtagttttggttggaatcacgatggatttttctcgatcacctaatcccatatattaggagaagtgtaatgccggtctttgtcgtccatcggctctggacacggcccacgtacgggtgctgatcgcgtcggggccgtctggctcgacgtcaatggcgattggcgagatcggcagctgactaggctgtgttcggataccccttctcctaacctatcgtttttcgcgtgcacgtttttcaaactactaaacgacatgtttttttaaaaaaagtttctatacgaaagttacttaaacaaaattaaattcattcatttttttaaaaaaactaatactttattaataacgtgctaatagatcactccgttttctgtacgtagttgcgaacaacccaccccgccacaccggtctcgacaggatgtaccgcgttgttgttcacgacatgctcgtgttctcctttgacccgtccgtaccgtttcccccgcagatgctgatgtgcctaaggatgtgtttggataatgagaaatggggggtgggattgggattgaaaaattaatgaagagttaggattaaatgaaacatggagaataaatggttaggatttaaagataggtgggaaatcatttctctttctcatttgccaaacacttctaagtgtaatgattaacagttcgatgcatggatatgtccatgtgaacatcggagaggacgaagtttatccacgaggaggtgtcgcccgagctgcaagcacgagctagcagcctttgttctgcagaagtttcagccgcggtggcgagaggatggtgccgatcgattctaactttctaggattacctggtgtgtgcagtgtccgtctaggagcctaagcgctctctctctctctctctctctgtctgtgtgcaaacggttggcatgctcatagttcgcgtgcagggcaataccgatggacatgaagaggcaacagaattcacttagaaaaatgctttgcatgcagcatcaaaactggagcagctaacatccagggtctgtttgcatttcgatattttctcctggaaaaatttgatctaggctacgatcacatcttacatttatcgttaattaggatcaaatttaaattaaaaaaaatgtccattggctataaaaagttgtagataattccatgttaatctaaatccattggctatatgctaaaatccttacaatccacaattatatgctaattttgtaccaagtcttactctgcttctatttccgctttcctcacctccccacactacataagccaggccaaccaatagcaaaaagattcacctctgtctctttaaaatccccacagccacgctagctttcgccgttacaattacttttgtcttctcgtggtagggtctaactatatccgtcttcctacatagttggtacccactacatcattaattcctataaaacttgctccaggttggtccacgtcatcagtttttttgaagccgtccgatcaaatccaatgttccagcatcaaatgctatttgctcccaagcaagacctaggcggctaggcccatgccgtttggccttccaccttccccttccgtctccacacggaccacacaacatccaacaagaatacaagtgatcgcgcgacccatcgtcgtctatcccctaacctagccaaatgatagatacgcaagcacctgacaaccgcagcatgacaagctttcccatgatcacccgatgcgacatgcccatgcaagccaatgcgaggaactgatgagacatgaccgagcactctgtttcgcctcaatatatactgacttcatgcgtgagccctagatgattagtttaatgtagatgggtaaaagagttagagtatggtctcataaaggtaagatatcttttttaaaatgaagataccatgtttaaagtgaaattgattaaagggtgatttaaaatggaacaccggtaataaaggtaatcccaaagtgaaatttaatgttatggtagtgtaggtgctagtgccgccttccatctctaagacggagggagggtgttgcatccttttgaaccaggttgccgcgtcatccacctcaatgctggaagttgtagggactaggaggttgtcaccgccgtccacctcaatgttgaaagtccaccgtcaagcctaagttgtagggactagggaggttgtcaccgccgtccacctcaatgttgaaagtccaccgtcaagcctaagagccgttccacgggaggctgcggtgttgtccctcccgagaatttgggagagccaaataatagttgttcacattaccattacttttccatgatccttcttttgctttatggtggatccttaatttgctggatggtacatgagtgctttattcagtagatgttcagcgaaattaatttgaaataattttctttatccattttacaagaataaacgattgttatcccattcttaaaaaaatagctattatctctgtgataaagctccatatctatcgtccgatacaactaaaaaagatcagatgttgcgatgctagcagtaggcccacctccactttataactataccgagccttctagtccccccttatccactctctcactcctttatccgctcgttctatgcatctttctttctctctcgatgatccttgcaggggatcaagcgaaatagctcaccattcgacagcaacgaggcgtcctccccatgcgactatctggcgggcggagtttttgttcatccgaatgatgacgatgactcgggaccagcaacggcagggtgactaagatggctcgggaccggcaacggcggggtgagtaagcctcggggtctccgtggagcggcggctacggcacctcggcggaatagaagagcctcgcatgtcccggtctagatctgcagcggagaccaaaggaaaatgtgatcactggagaagaggaaggaacccaatctagactagtgcatttttctgattttcaatgtttcaaccaatgtaagtatgatgtttcttggggaatcaaaatgtttcgctgagtagtttgaatcttgtttcatcaattcttgcatattcgttgctgttttagcagctgaagctcgatgttccgtttgttacaacggattgtttctatcatcattcacaaatgttttatttagtgatgaaacttttttctgctatcatgattcacaacatttaatagattggaacttttttatttagtggtgaaacttttttctgctagaaatgaaacaacgcacgattttgttccttttaggaacaaattgggcgtctgatttgtagtctctcactatctttgcagttgtagttcaatttagtttaccattgctaagcaggagcctcttctttcatgttccatgttgttagatcccgacaccgggggccctgacacagtgcatgaccgagcctcaacgagttgcaccgagtcaaattgcgcattgacagttccattcgcggtgccatctgctactgctcatctcgaggaagcagcaaatcctacacatgggaagaacgcagcgcactaacacacacaggaaggagaagcagtagagattttgtttcatggaccagtaggtccggttgatgtacgtcattaatacgcagtataaaagaccaaaagtagtatcacatcatcatatgcctaacatggaaaacttgatagtattatcgcccctagagcggaaagaaacaatttgtcgccgccgtcaaagccgtgcagatatgtatgcacggcgctgcttgctgcttactgctgcgcgcactgcacgcgctgggcgccgccgccgtgcatgtcctcgtcctcgtcgtatgcctcctgctgctgctgttgctgccgcctcctcatctcctcctcgatgttcacgtcgtacggcatggtctcctcgcactcgtcgagctccatgtcggtgtactgcgacaccggccttggcgggaggacggtctccagggccttgcactggtcagggttcaaagagtcggggaattccacggagaagtggatgtagagcttccccttcatgaatggccgctggtacatcggcatgccctcgtcgttgacagccttgaatgaatctgcgacaagatgacggccgatatgagtaaacaataaaatagtttctaaaatgaatgcttaaaaaaacaatcagatggtttccaaaatgctgctactctatggtgatctttctttgaagggagactcaccaggcttgacaacttcaccgggcttggacttgataagcagctgcctgttgtccaagtgagtgagaacaaactggaagccacaaagggcctcagtgaggttcagggtgtgctcgtagaagaggtcatctccctttctcttgaacttgggatgctccttctgctggaggacgaagataatgtctccagtgacagtatcgggctgcacaaagcacaggttggtcagtaacagtgttgacaagcacatggagtactacaccttagaaccatgtactgtacaatgcgaggagtcagaacacagacataccgcttcatcagcctcaccagggaaggtgatcttctgtccattctgcatgcccttctcgaccaccacctcaagaaccttcttctcctgcgccaccttctcacccttgcagcctgggcatctatccttgtcgctgatggtctcaccagttcccttgcactcattgcagggatgttgcatttgctgaatcattcctggccccaactggcgaatttggaccttcataccagaaccttgacaaccagagcacttcatggaagcaccagatttcgagcccttgctgcaagatgagcacagaacagtgtgagatatcagaatagtcaaacagtttatgcaatatttaggacccacaaaaggaagctgatgacatacccattgcacttggagcagagcacattgcgagaaagggagagcttctttgatgtgccattgtacaattcctccagagaaaccttcagagggtgaaccacatcctctcccctacgctgtctcctgcccctactgctaccacctgcagaccacaatgagagccagtcaaaatctaagcaaaccacaatcaccaggaggttgaattgagctgcttctcatgtctcgtacctccaaagccacctccaaagaatgaggaaaaaatgtcaaatgggtcatgcatcccaccaccaggacccatcccctccttgagagcatcttcaccgtactgatcatagatttcacgcttctcagggtcactcaggacttcataagcctgagccaattccttgaactgaaatgaaggcaagaattttagtttgccatctcatcaagaaagctattgtccccatcatacagcttaaccagataaagcattggcaattcagtactcataaagcttaaccagtttactcataagatatcagcgataattatgaggtaaaacaatatatataatagaacacaccagcctgtatgccacagtaactaggctcctaactatgacaatgcaggatagatagtacacatggtcacaaactcgcaatacaaaatcaggttggcacttggcaggtgacgatgtaatgtttgcatcagccaaatgaacaatatctcacatcattctcaatactacttatcactagaattggctatcaattagctgaattaacaagaatgttccaagaccctaatctgtcataatcatcagcaaagcccctaaatgtgcatatcaatagttaatgaatagtacagttaaaaacatacaaaaaatagatgatctcaatatatgaacaagtaatggaattgcatctaaggttcacatggttttggttgattggcaagcaattgaggaagggcaacttatcatcaacagctaatgaatagtacagttcaaaccatagatgatttcgatatatgaaccagtaatggaattgcatctaaacgttcacatggttttcgttgattggcaagcaattggggaagggcgacttatcgtgctctgaatccaacacatttccacaaccaaatctacttccccccacctaaatccatcattcccggagcacacgcaagcgctactccaaaccctcctaaacccatcgaattcttcaaccctatcacagatccaaaactccccaacgcccccctcaaatcccccacctccatccaaaccggctacgcccctcaccgccgccgcagacagatcgaaacgaaaaaacaagagacgaatcgctcgcgagctcaccttctcggggtctccgcccttgtcggggtggttcttgatggcggccttgcggtacgccttcttgaggtcatcctgggacgcatccttgggcaccccaagcacctcgtagtaccgcgtgttgtcgctcttcttcggcgcgcgcccgaacatctcgtcgccctc

SEQ ID NO: 6328 - DNA, 2387 bp, Oryza sativa
  unsure (1)..(2387): unsure at all n locations
ggaagcgcgtgtgtccgcgcgtgttgacttgactccggtttcgggttgcgtttgtcgggtccggtgcgacgggagcaacccggtaaggagattccctctcttcagagagattccttttttcttgccttggcgatgcttgcttaccttgcgctgtcgagaaaaggcaaggaaagtatactactaatatggttggtttgtttttttatttttatcaagtttccctggatttaaattgttttcgaatactcctataggattttttttcctcacttttttgtgattattatttgtgcattatgtgaaaaacgtttatattcattttttcatgttttttttagaaacatggaataaacacggacactcacaacgcgcgcacaatttcccctatacacgcacactctatctctaagaacacctataaaatattgagattgacgaagtcactatatgcgcctcaccgtcaacggtaacattgcttagcactgaaataataaataatagatagccgtaaatacgatcacccatatcaaatctaggacttgaaccaaactaatagagctacactcacttcgtatctttttcatggttattatatgtgcatcatgcaaaaatggtggctgtgttttttctgtttttaaattctttacaagaaactttatgcttcataagcgacgagataattttctccattgaagagagatttgtgacgctttttttcatttgcacatagaagacggagatagcgacaaatgcctcaccccactaaacacatgttcataagtgtgtaatactcatggacacgagaatttaaaccatgatggttagattataatcatcctccctcgaccccacttgcataccaccaatttttttttcctgtttgagtcactggccttctattcgacctcactgaataaatggaaccttttctaatcacacaattaaatgcaacttttcattttaaatccaatattttcacttttggcttggtaaattcgcatttgtttcgctttgtaccaccataactctgttctcgagtcgcatatagtctctcatatgataaagggttgcttgcatggaaattaccgacatgtagccgccaatacgcttaaaggcattgatgcgctcgagaagaaagttcaagatagttcggagtgtaagaaaggaaaaattacatatctcaagtgtaaagatcaaatatagggtgatccaaagcgaattttttgcgggtaaaaggtgactcacactgtaaaaattacccaatcttatttcatataagtgaaagagcagattgttattcgagctactttcctcatactttaggttcttattggttgcccatatttactaataagccaaaatggctcattagaaaataaaaattagtttttaggtaaaacttttatatatgtgctcttattgacttaaaagttaaataacactataaaagaaactaagttgaaaatatcttaaaatcaattttaaaattaagtttggaaatttaaattttagttttggctttgacttattaaggcaaccaatgaggctcttaacttagtacagtacatagttaaaccagacggagtacgatcaggatggtcattctagcaaaataaatatactatggtccaccacgtgtaaaagaggaagttctacggttatacctcaagggacaatgcacattggattaacaaaatggaaaaaatatggagtttatactgtttaagttaccacactttacagtgttatttgttactctgggtgtgtttagttcacgctaaaattaaaagtttgattgaaattggaaagatgtgatggaaaagttaaaagtttatatgtgtaggaaagttttgatgtgatggaaaagttagaagtttgaagaaaaagttaggaactaaaccaggcctctagatcaattgtcgtagaaaagcctaagcattggacaagaaaagtgacacatgacattgagctctagttttttttttctgcaaaaggcgctgtggtttatacacttttcatgtcacttaaaacgggtgtgtttggttgcaagccacactttgccacagtttgccacgcctaaggttaggcaaatttgacaggtgtttggttgtagttacagttgtggcaagattcccctccaacaaattgggtcccacatgtcaatggctcaaaaaagtgtggcaagattcccttaggcttagtaagttgtggctaacaatttgatcacctcaccttaggcaaggtgtggcaacttttgttggcaagtaatggtaaagtgtggctgagaaccaaacagccccaacatctcacggttaaaagacatccctctgttgatagccttttcttnnnnnnnnnnnnnnnnnnnnnnnnnnnnnnnnnnnnnnnnn

SEQ ID NO: 6329 - DNA, 679 bp, Oryza sativa
tattttgggaccctaaacagttttaatttaaaaacttttcaactacaaagttgtaggtcgcgttgagggctacaattttgatataaagtttgtcttcattagagttaacatgaaaaagttatgaattattttttgatataaagtttttagaccgtcctgtttagggaccgaggtgacacaactgaacaagttggaggacctaaacgagtgatccgcatgtttagggactgggatgatacagtcgaacaagtttgagtacctgaacggttgatttgtgagtttagggaccgggatgacacagcggtacaagtttagggaccggtgatggactttactcattagaattttatgcatgactatgtgcatctgaatacctcatcaataataagtacaaaacaagttctcatgtctagttttctcaactactaacatttctagttttgtgttttgtcagccatttgatatttctgcaaaagttagttttgttttctagaccaaatatctggaaatcagttttgtcaatccttgacaaggggggcctgcgcggtctcccggtgaggagccccacgctccgtcacacatatttcgtcatttaagttttttctttctatggttggttcttatatgtttctaaatgtgaaaaaaaaattgttggacatctcttccctctacactatag

SEQ ID NO: 6330 - DNA, 1659 bp, Oryza sativa
ttcctgcagcccctaaagatcaaatcagtacatgaaagattaggccatattcattctctacttatccatagatgcagtgtgatttcttgaatggattggaaatcttgtttgttataacagttatagatactaaattcaatgcgccattctggaaaagaaaaaaggaaaagaaaatgtgattcgctcacctgggcgaaagaaaatggagagaccaaagtcaatggtcttgagagcggcctcctccgtctggtcggcgaagaggaagttctcgggcttgagatcacggtgcatcacgcccatggagtggcacacctcgacgacgccgacgatgaccctggcgagctccgccgccttccgctcggtgtagtgccccttctggacgatccggtcgaacagctcgccgccggcgcagagctccatgacgaggtgcacggcgacggcgtcctcgtaggcgcccctgatggagatcacgttggggtggccggcgaggtggtacattatctggatctcgcggcggacgtcctcgacgtcgtcgtcggtgaccagcttccgcttcaggatggacttgcaggcgaactccttgccggtggcgcgctccacgcacaggtacgtcgtcccgaactgcccctgcccgagcttccgccccaggctgtacttgtccttgagactctccgtcttgcgcttcagcaccgagccgacgagcagcccggcgctggagacgcgcttcaccggcggcaccctcggccgcggcctggcggcctcgccggagtccgagccggcgctcgacttggaggcgtcctgctcggcggaggcggtgtccgtggtcgagacgatcttgacgtgctcggggggcttgttttggacggcgagccggcgcgtcggaagtcggcggcggcggcgccggcaaccggccctggccgccgccgtcaggggcgccattggcgccgggcagcgcgtcgtcgccgtcctggcgcgccttccagagcaccgtggagacggactggaagaagccgttcttgctgatgctggggccgacgcacgtgttccccattgccgccgctccgaatctttctcggacaccacgcctcgatccaacaaacaccttcggattacgccgcgaatgtctctccctccgcgcggcgaagcgcaaccgcgccaagagacgatctcccctcccgctcggagtaatcaccgatcacccccggatcacgcgaccaaatcagaatcggcgatcgaacgcgatgcacccatcgaagtcaacgctaagctctcagcacaaccgagatcgttcgcaaattacaatctcaaaaactcaaaatcgcaatgcggagatggcagattgggggcaggagctagctgctaactacgcatcaaggatcacgcattcacgctagctctagtgcttctagtaatggagctgggagcgaggcggaatggttcaatgaggacgaaagggttggtacgatggaccacttctagctgccggcggcaagtggaagaagaagaagcagtcaaaggctaattgcaagaaaccaagatcgctcaaggctaaagagagaacaagaaactcccaatccaaccaaattaacacaaaggcgagcagctaggggtataccaccaagtacaagaaccgatggaaaggaaggggctgcaggaatt

SEQ ID NO: 6331 - DNA, 4241 bp, Oryza sativa
ccaaatatctaagaattctcttcacggccacaaggtaacactctttcggagcggcttgaaatctggcacacatgcacacactaagcataatatcgggcctagatgcacaaaggtaaaggagtgagccaatgatggaacggtataccttttggtcgacgtctttaccttgctcgttgaggtcgaggtggccatttgatggcatgggagtgtggattagcttggcattctccatcccaaatttcttgagcatgtccttcaaatactttgtttggcaaatgaaggttccttccttgagttgcttgatttgaaggccaaggaagaacttcaattcacctatcatggacatctcaaaacgtttggtcatcatcctactaaactcttcactaaaagacttgttagtacaaccaaatataatgtcatcgacatatatttggcacacaaaaatatcattatcatgtcttttagtaaaaagagttgaatcggctttcccgatttcaaagccgtttttcacaagaaaattttgaagacactcataccaagctctaggggcttgcttaagcccgtagagtgccttgtggagcttgtacacgtggttgggatacttcggattctcgaagcccggtggttgctccacgtataccaactcgttgataggcccggcccgttgaggaaggcttaaaaatgaggttagtagcaaaagcaagcaatatgcgaatcaactcaagtctagctaccggcgcaaaagtttcaccgaaatctaatccttcgatttgggtgaacccttgcgccactaaccttgccttgttccttattatgaccccggtctcgtcttgcttgttgcggaagatccacttcgttccaatcacattttgccgaggtcgctccatcaaagtccacacttcattctgggtgaaattgttcaactcctcttgctgcgccatcacccaatccggatgattaagagtttcttccacccttagaggctcaagagaagacaaaaacgagtaatgctcacaaaaatttgcaatacgagaacgagtggatactcccttgttgatggctcctaagatgttgtcggtggggtgatctctttggatactttggtggattcttgggtgagctagattgatcggtgagggtggcacttgctcgccatcttcaccttgatccacgtttgaagtagagggatcgtcggcttgggttgatgtagttggctccacttgtgtggaggaagaggccccttgttgtggctccctaggacgtacgtccccaagagccaacctcttgattgcttcactcgggtcctcctcttcacctaacacatgtgagtcaacttgctctacttgagagccattagtttcgtcaaatgtcacatcacgcgcgatctcaacaatgccggaggttttgttgaaaacggggtatgcgcattcatttgacccatacccaagcaagaacccctcatccactttaggggcaaacttagaggatctagccttcttattaagaatgtaacacttactaccgaaaacacgaaagtaagagacatttggtttgttactggtaagaagctcatagggagtcttcttaagaagatggtgaagatatagtcggttgatggcgtggcatgcggtgttgacggcttcggcccaaaagcggtccgatgtcttgtattcatccaacattgtcctcgccatctcgatgagagtcctattcttcctctcggctactccattttgttgaggtgagtatggggccgagaactcatgcttgatgccttcttcatcaaggaaactctatatgcacgtgttcttgaactccttgctgttgtcgcttcgaatgttcttgatcttgaggttgaactcgttttgtgctcttcttgcaaacttcttgaagatggcttgtgtctcactcttgtcatgcaagaagaacacccacgtgaagcgtgaaaagtcatcaacaataacaagaccatatttgttacctctaatgcttagataagcaattggcccaaagaggtccatgtgaagaagctccaatggtctcgtagtggtcatcacattcttgaccgggtgatgcgctccaatttgtttcccgacttgacacgcgctacacaccctatctttctcaaattgaacatttgttagtccaaggatgtgatcgtgctttagaagcttgtgaagattcttcataccaatatgggctagccttcgatgccaaagccaccccgtgttggatttcgccactaagcatgtctcatgtttggctttacttcaggaaaaatccacaaggtaaagctttcccttgagaacacccttaaagactaccgatgaatcatttcttctatagacggtcacatcaacatcggtaaaaagacaattctaacccatgaaacataattgagaaacagacaaaatattgtagtttaaagattttaccaagagaacgttggcaatagaaagatcattagagattgcaatcttacccaatcccataacctttccctttccatcgtccctgaagactatgttatcttgtgaagtgccatttggatcaagagttgaaaatattgattcttctccggtcatgtgattggtgcatctgctatcaattactcaacttcttccaccggagacatattcctacaagagatcaatttctagttttaggtacccatacttgcttgggtcctctcatgttagtaacaagtgccttaggcacccaaagcactctcttgatagaaatattcttgctccttgggcctacatacttagcaacaacacgaccactagcattcttcctaagaacataagatgcattaaaagaacaatgtgaagcataatcattaggaatgatacttttggccttaacaaagttgctaagaccttggggcctcttgatcatcacactcttgtccacctttccttttggtggaggaacatacccaagaccctcatggttgaagttgttcctttaatagcctaagtactcctttagggtcttactacccatatgacacttaagtaggccattgtgaaggagtcccataagcttctcattttgcttttgcaaagcactcaatgaaatagagttggtagtacaaccttgaatatcaacatctttgcatctcacacatggttcattacttgggacaattttggaacaagatggctcgctagggagagagacactattttttaaagtttcgaacttctcttcaagagagaggtaagctttgtccaagccatccactctctcttgaagttgagcgttcgccacctcaagattagcatgagactctttggtttgcttgtaaagccgtaccaaagcctcatttttctctctctccttagtaagctcactcttgagttcatgagaccgctctttctcacgaatgagcaaagcctcttgcctctcaagagtagcatattggttctcaattctcccaagcaactcactcaagtgtcatagggattccttagttatggatttgaacaattcgtcatccataacctcatcctcaacctcatcctcctcatcactaacaagatcaacattaaatgacttgagaggagaaggtaccttaggctcctttgccatgaggcaaatgggagcatcctcatcacttgagtagtcgaagagtctcggtggtgatgaaggcttgacagcgaacgtggcgactccttctttatcacttgagcttgactcagagtcggagccaaagatcataccaaggtgagcttggtcataatgttcctgcttgctatgcttgtgcttctccttcttctcacccttcttcttatcttccttgatgtgggaaccatccttgaggtgggggcaatccgcaatgaagtgcctgggctctttgcacacgtagcacactcttgtggagtgtcttccacttgacttgttgtagtgcttggaagaacctcccttgaagaggccgcttcgcctcatgaacttgccgaatttcttgacgaagagagtcatctctttatcatcgatctccgccttgctcttgctcttgcggttctcttcttcttcttcctttgccttcaatgccaagtcttccttcttgatgcttgcggttgagctttggttgatgtattggatgacatccttggactcttgcacgaacatgtcatgggcaaggatacgtccgagcaaatcatgaggtgtgagagtcttgtagtccggacgctcacgaatgatggtcaccaaggtagagttccttggagtgattg

SEQ ID NO: 6332 - DNA, 4298 bp, Oryza sativa
tgggttgtgaggggagcgttttacctattacgtatcctgggtgaataacagttctataccccctcctcctcaagagcccgacacgcctcccccttcttttgttgggctcaaaacccacctcccaccccagttaaagcgtggtcaaaggacggtcaaatcgctgcctgttgatggtcattattgatcagtttcgactctcaatattactaaaataaaggaaaactagtgatacttgcaatgcatatatctgttagaacaataatattccactagtattaggtctactaacatttttgcagagaatgacaataaagtggaggagaatcgacatcaacatagacgataaatcaatcggacgatgttgagagttagacttatgcatgaatgggccaagaactcagaattgacacgacatactgggccaaatttcacaagtctacggaggagaacaacagaggaggccacctgccgaatatgggccaggttgggccggcccctggttcggccgaacctcccccggtgccgttggatccaggttttggctggaaggcgtggatcactccccaatgaaggttggagggcaattccgaccattccaactgccacaaccgtcattggcagcctatttaaggagctgctctcctcacttcactcatacacctcaagcaatagctctctcatttctctcaagtttagtttagtagtatctagctggtggaatagaattagaataggaatcaggagtccggaagtcttcggaagagttcgggtatggctctagcagctttcctttcctcttttgtcagatttgtaattttattagaatactcttctatatacatttatggtattgaaatactttctgagtatacgagtacctactttacattatgttcttgttatactgaatatactgctagcttatctgggagatgctttggtgcgggtataatgtttgcttatgcaattactctatgtcatgatgatgatattagagtagtatctggtagtttagacgtggtgtctagattacgggatatcattatttggggttatatattgcggatgagaggtgggccgctgatggtgacaactcagtacgggtattcctccgcgcctatatatatcctaagttaattttctggggagggtattcctcagtatttagccctggttggatggtcatgacgggctgtcgtaaggaactcggcagtcaggggtggcttctcgaagtaccaggagggcatcgaatagagggtattagctagtatatcagttaactagaatgtatgtatactatgtatattagaagtattggaatagattctctttctcttttctttccacctagtttagattatttattatgaggatgagtagaaatgcttgtgtgtcactctacccatggattatcttaacccctgcttagactatgattatacaagtaatatataatttattagttgagttctctctacatgattttcccacgggataaaataaatacgatacccttggaatactctcgggtgaaatgctacaatggtatatccgtgcgcttgcggatgaactctgtaaccataatataccagaagtatttctgcgccattactgggaattatatttctagtaatgtcgttaagaaataccaataagcatttcttataataaaataaaacatgatatccaacatagtggtaggtattattactaatcatttgcactagtgttggtgaaatatgcgtatgcaggtattttgagaagaaaacacatccgtcaagcgacaaactgcacctccgcgcattcaggacacatttacacggattggaggccccataagtcaattaaacaaatccaaatgggcccaactatcatgccaatgggctgagggcctcaaaattagtgtccacgatgaaaaacgggccgaacggagccatcccgggagttcggccgaaccgttttggtggccattgatcatcaaattttgcgtggacggccctgatcacatcctaatggcggttctggggtagtttggtcatttcgcataggctgtaatcgtcatacctgcctataaaaggaggagctcactctcatttccaacacacaactttgagctgaattacaagaggctctattgtatcttttatacattagaataaggtagagagtgaggggaagctctggaggagtgcccggaagtttggcgctcatccgacttctacctcaacgagtgtagcttcgtaggaggaattctggaggagtaccggagctgtcggtacactctgctccaggttcggagaacttcttctataaagtaagcattcgtgtttctttcttatgttatttaattactttgtctaagtaagatatatttgcatctttgtgggttcattgtttagtatttatactaagtgctctagtactaggactccggatagagaaggaagttcctgcgcaagtattagagtagtaattaataacttagacgtggtgtctaggttagagattacctttgtttgttgtgtatcccacagatttgtcagaggtagtcggtaggtggtgacagccctgaattctgtcccagaaatcctccacgttcggatgcatcatagagctatagccggaaccacgctggtagaccagcagaggtcggtgcccgaagcaacagataggaaattaccttcaacttagcttaggtaattaaaatacatagaaagttctctgtagcctgcctacctatagttgttgtccttggatcgtcttagccttaggtagattacacacgttccctgagttcgatatcctttaggggtcacccgaaggtgaagtgctacagcggtattccgtgggtttccggacttatctgtggttgtaagaaataccaacaaaaactttcctgtagggattagtccacagaagatatatatccaatgtccatgaacatattaactctgaaattcattagtcaaactaaactttatgtccaatttgattaaagtagactattttgacctaagcaccatgcttaatttaaaaagcctatagatgtcttgcacgaacacccaaaatagagcatatgcaaatagacaaaagaaacataaccatgtaggatcaagtctcattcaaatgaagataagtatgagtaaaaggaatggtgaaccttgtcttatctttcacatacctaagtgtacttgccgccagcatgatgtatattttgaaatctcgggggcagtggcatggtcacatatgattgtcgatttctcctccatctccatgcagattgtaccggaggaaggtgctttgaccatgcaaactcaggcaagtagtttagtcatgcacacacctcgggtgcaagaaccttgtgccttgaattcgtgatccgttggcacattgctgtagagacgtaggatacatctcttcgtggaaaatgtgcaagtaccaactagggtggagcatcaaacgcctaaaaaaaagaaagggggcaactcatctttcttgtatgcacgtaagtgctgcgggagcgagaagttgtgcatagctaggagtggataaaggctaagccaaggcggcacatgagctcgagagagcgactaggtgtagccaggcagcacgattgctactagcgaggtgtatagccatatttcaaagatacgcacataatgcggtctttgatccaaatatagctcgtcagctctcttgctcttttcttctcctcccattttttcttcttttcttctgtctctcttttctcctctttctttttttataatccttttttttctagcaagctagtactaacaccaacttcaaactaagatggccctagttgatggaactcgtcatgaaaagctcgtcgaccttcctccccccctgccccacacacacacacttggacttttgtgtcgcaagacatcaaaaaccaagtgtgtgatgtcggattctcctatagagtgtgttccaataccaatggtcaccaaagtgtacagttgatgtagctaccgtgttcttaagcatcgcatgaccctcgttcttaatctcaacctaaaatggttagcgaccaagaatacctgaaggtgcatattatcctaaaaactggttcttgcttttattagaaagaaaacttaccatagtaatctgggctatctcccggcagtgctttgtttatggtcacaagcttgaccatggggacatcgctctgcaagattagtgccacaaatacgagatttgcagtatttatgataaatataagcatctacaaccattcttctaaatatgttagaaatgaaaaccggaagatg

SEQ ID NO: 6333 - DNA, 693 bp, Oryza sativa
agggatatattttagggtcattttgggacgtgacggacctacccccttaaacggaatctcaggcccgagattcggaagaactggcgaagaggacgggatgggctgcctttagctcgtcttcacgctcccaagtagcttcttcctcggcatggtgctccactggaccttgcaaaagcggattactcgattccgggtcctacgctccattgtgtccagaatcttcacaggcttctcgaacatcaatctgctctgaatcggcttgctcggatggcactcgaaggcatttcttgagctgcgacacgtggaacacatcgtgcacattgcccaaggatgtaggcagctccaactggtaagcgacttctccgcgtcgagcgatgatgcggaaaggtcccacatacctaggtgcaagcttcccttttgtctgaaacctgtgcactccccgctgtggcgtgacccgaagatacacaaaatcatccactgcgaattccagattgcggcatcagttatctgcataacttttctgccgagactgggccacttttaagttatcccgaatggttctgactttagcctcaacttctctcaggatatcagtcccgaacacttggctttctccaacttggtcccacaacagcggagtccggcatttgcggccatacaacgcttcataaggtgccaattgtatgctggcct

SEQ ID NO: 6334 - DNA, 5111 bp, Oryza sativa
tacagtagttcatcaaatccataccgcgtggtgaaggcagtcttagggatatcttcttcacggatacgcaattgatgatacccggaacgaaggtcaatcttggaaaagacagaggcacctttgagttgatcgaatagatcatcgatccggggaagagggtacttgtttttgatagtgacttcattgagagctcggtatcaacgcacatcctctttgtcttgtctttcttttctacaaaaatcacgggagcaccccagggagaagtgctcggccgtatgtaccccttctctttcaacccttccaactgcttctttacttcggccagttcattcgctgccatacggtagggtcgcttgtacatgggagtggttcctggagcaagatctatcctgaactcaatctcccgctttggtggcataccgggtagctcttccggaaacacatcactgaacttgctggcaacgggtatttctgacagtcccagctgatgaagtactgagttgccggtgggagttgggtgcgcaaagaagacaaccggttgatcaggcctccggtacatagtgacagtacgtcttgcgcaatccactactccttagaatttagttaaccaattcttcccgaggatcacatccaagtccttggtgtcaagaaggatcagatccgagggaaaagaaattccctggatctctataggtatggtcgggctataatactttgctgtcatagcccctccaggggtggtgatgagcagagagctcctaagctttgctacccttagttgatttctccccacgaattgcacagatataaatgagtgggaagctccagagtccaacaaaatggtagcggggatggaatgaatgaagaacgtatcgaggatgacatctggagttgtcaggacatcctccgcagtaacgtgattcacacgaccccgggtggcatccttaccaccgttgttggggccgggtggcgctgggccttgctgacgcctcggctgacgcctcggctttggcgctgggccttgctgacgcctcggctttgggcatttatcggcgaaatgcccaggctcgaaacagttgaagcacagacgctgctggccttgagcatccttgcgaccttgaccaggctgcatagccggtgcaggaggtcggggtgcacggttcccttgttgattctgccgttgctgctgcggctgtgggacacgaaccacatactgagggcgtggcacggggcgaggctgctgctgctgctgctgtgaggaggatccccctagatagggattggtgtagcggatcctttggttagccccctgttgattacggaaattcgccaagcgacgcttgtgcgactccagttccttgtgcttggcttccaggcgaatgctcttgtccaccaggcgctggaaatcgggatagtccccagagaccagacgcacagaaagttcagggtccatccctgccagaaacttctcctgtttttcttcatctttacgaacatcctccggggcataccgggccaagttgttgaactcatgcaaatactccataacagagcggttgccttgcttcaactcccgaaattccctcttcttaagggctacgaccccagctggcacatgggtcctctggaaagcggcggtgaagcgggcccaggtgattggctgtccttctggctgcgtagcctggaaatggtcccaccatagcgatgcgggcccctgcagctgatgggttacgaagataactttctccttatcattgcactggacggtgtccaactttttcccaacggcatgcaaccaatccaaggcatccacgtggttattggagctagagaaggtaggtgggcgaatgcggaggaactcggcaagcttggagtgctgtgggggtggtggtggcggtggtggagcattgtgttgcggcggattctagatatggtggaggagagcagccatcatgttggcctgctgggcgaggatttgggtgaggatggggctggtgccatgtggcggtggtggcggcggagggggaggtggaggtggaggtggactgccatggttgttgttgtggctgccttcggggtgactgccctaaccggtagcagtgcttctcctggttgtcaccatatgaagattccacacagaaccagcaaacagaaagagctgacgattaaaactaaccacccacgactaccataattcttaaatttatttctgctattaaattggttcattaaggttcaagttgcttacgcaaataaaataaagacaggctccgacacagttataccacacaccggtataaccatgccccacacaactcagcaagagaacaaacgaaaagaacacacgcgcgggcctactagctgctcgtctacttctgcgatgggtcggggcggaaggtgagcaatagcacatcctccgtgctgccaacgccagaggctcccaactcctgaggaaccacaggcgcaggctcagcgcaaggagtctccacgaagcaggtccatgccaaggactgacgaaccagctcaggcctggaggtactcttgcgggcggtaatcttctagctgcggcaaacgcggcggcgcttggggcggcagatctccccctgagcaatcttgagctgacacagctgcgcctccatagcgtccaagtccttcaactgcagattctcttgacgcagctccaggatcttcatgttgttctcgaccaggccacggcgcgccatgcggtagaagtcgatacgggccgcgtcgtacgcctctaccatgcgcgccagatgcatgatggtagcgtcatcctccgagctagcatcctggaaggtggcgtagtcgcgggctcctccacgacgagggtagtagcggtagggcgagtgctgcaactcgtccgggtagcgctggtgaagagtgccgatggcgaggagtgcagcgttctggcaggtggcggggaaggagtccctacccgcggtgacggccagcgaagtcctcttaggggagccggtgaggatcatcgcagtgacctcccaagcggcgcggggctccgcatcgtcaccatcctgctccggaagcctcttgccctggtagtccactccatgcggatatcccaggacaacgcacatgccccgcagctccaaagcaaagccagtcagatccagaccacgacggttgaggttggcggccatctataaataaagacaaaagaaaaattttagagatcagcttttgatgagaaatgaagcagcaagacagagagagactaaaggattttcacaaataagagatgatttttatttcaaaatactgctaaggcttgggttctagggttcgtcctagggtcaaggaggctctgataccaacttatcacgactggaattaacccaacatgcattccatacgtgcgtgtattattccttgtcccaggaggcaaggtacaccaaaagttgatacaattcagagtttaacaagcagaagtgtaaatagataaattattacatgggcggcgaaggcccagcacacacgaagacaaacggaaaacagcgaagactagggcgacgaccacaggcacttgacggcaggcacgagctagacaccaaagccttcatcctccaggaactccacttctgggttcgggacaaattgagcaagattgagtacaaccaccgtactcaacaagaaacacccacgaatgcagaataaatgcaaaggagtacaagggagttataataaaggggttagggtttgcagtaaatagcatttccaagacttttagttgctcagggccattttgtaaaggcgatcctgaagctacacaatgttgttaatcaaggccgtgaacccacacgaacctgccttaacccaaggcctacgatgattcagacagaactggcaacccgaccctgggtcccagctcgtcccaagccaacccaggctaaccattccacattttagttgttaagcaggttttaggaattaaaacactaacttgggtacattgctaggcttgcccataaccgagggcgcgactattcgaatagattatactctgatcagaggtgtacatctttacccacaagacacatcttcctcacgtgtaaccacgtgccacataccaccacggcatacggacggaggacatgacatagttcccaacccatcctagccgtaaacaagagtaccgacccaaccctggctacggccgggattcccgagacaggtaaccaagattgagcccctagcagcaggacaccaaccctgtgttatgacatctcgactactaggccgcagcttatgtagccttcatttgtcctagagatgtccatcgagccccgacttcgtccatccctatccgtgtacttttgtttatgaccagactgagctacaaactaggccttacccactagacatgtggaagtacggtagtgctttgtaacagagccccgaagaccggtccttatagtggccgaggtgctgctatcaaaaccatgtacctcgagcccagcctaaaaccattttgggggttttgaaaggagggggaggtgtgtgtccatttccacataatctaatcattccatagtgtccaggtgatatgagaattcccaaagtctaaaaattataaaaccacctaatgttgcctaattaatcagcgaagcatctacctaaattcatactagtggaaccatgaatagagtacccactagttggggtttcattttcctagggtgaacaaggtattaataacaatagcaataataataaggttataacaagggtaaataggcatggctaagtaaaacagtgataacgcgggaatttaaataaagcgataatgcattaatttaaaacaaaacataggacaacaatattttcaaaggagatgtgacttgccttgctcgctttcccaaacgtcggcgtcaacctccacgaagagcggatcttccgaagctgcagcgtctacacgaccaacggaaagaaaaaggcttttactctaataaactccatataacaagcagaaacaaagcacaaaaatgggttcttgacttcttaaggaaaaattagagacttgaacggtccaattccgagttcaaacggccaatatatggccatttgaagtttatatg

SEQ ID NO: 6335 - DNA, 1248 bp, Oryza sativa
cataattgtactatttgatttcacgctgagcagtgacacattttaatgactgcctgataagagtgcacacgttgcactttagatgggagtgacaactcatctacctgctttacttagtcatatttggtgctctctcagtctagttttctcaagacacaatcgtgatgtatctgatttgctggtgtgattctgcctttacatgtggaactaggacatctgctctttgcttcgtcattttcttttaactagataccatgattttgtgcctatggcaccacacaaacatgtggataatatatataactagtcatactgaagtactgccttcatctcaaaatataagaacctaggaccggaagattcgtaatactaggaaatgtcccatccggtcctaggttatattttgggacggatgcagtatatactatggcatgtcacattttcaatatctgtggcagtgtttacctctttatgtggattatctaactcttgctttgctattctttgaagtaatttgtgtctaattgctgaattgttgtctttctatgcttgacctgactatttaattcaattgaaaaaaacaggcggctttttgcagaaaataaggaccagcttggtgtatctctgccctgctgagcacatccctccaaaaattgaggtggacctggcaaatcttgacattggagatagggtatcaatgaatgacatccccgtccatccgtcgttgaggttactgagtaaaaacgagaccatgcctgtctgcaagatcttggcctcgaaaccagttgagtagaggaatccatgcaaatttttggagcttggtgacaatgtacccgagttggtacagcagcccagtaacttcatctccctatgtgcttgcatttggtagctgtttgccaagtcccaatgtggtaataggttcaaacaagttatcatgttcaggaccaatcttggctgtaatgtcacaaaataacaccagctttctcagtttaacatacacaagacattttgtcgattcttggttgtggcctgggtgtattgacacgccgagctgataatgtcgaactttaaacataccatgccccattcttattgttaaccattcctactgagttgttgtcatgactcatgatcatcaccagcgtgtcccatgtactgaatactgaatgcatgaactggagtggaaagatcataagaaccagcatttcatgcatggtgtcactgaatcatgtgtgcatgtattttttg

SEQ ID NO: 6336 - DNA, 6757 bp, Oryza sativa
ggaggaagagccgatgaatgggattagggatttgccagccattggtggatatgagtggaaattcgaggaattggagaggagagtgtgcaaaggtggaggaaaggaggaagaaggagtgttctggtgtgatccgaacgttctacctccaaacgcgcatctaaacagactagggacgagcgggggagactaaggttcaaaattggggccgatcgggcgccgccctagatcggccgaaccctggtgggtccggcaggccaccaaatttttcctaggcccactaaaacctattttaatcacaaaaatgacaactatacagggttttaagcatgcaatagatgagatcaacatggttcataatcaattaattcaataacatccacttcttcatctaaagtttcatttggctcaaggaaaatctttaggcgttgaccgtttaccttaaatatgttacctaattcgtcgcggagtgtgattgccccgtgcgaagaggtgtcgatgacgtcaaacggtccttcccatttgctgcgcagttttccatggccgaaaagcttaaccctggagttgaacattagtaccttgtctcctggcttgaatttcttgatctttttccttttgtcatgccagcgcttcgttctttctttgtatatctttgcgttgtggtaagccttttctctccattcctcaagttcagcgatctgcatttttctccattctccagctccctcaaaatccatgttccaattcctgatggcccagtatgctctgtgctcaagttctacgggtagtcggcatggcttcctgtaaactatctgatatggggacattctaatgggtgtcttgtatgctatccagtatgcacacaatgcgtccggcaatctatccttccatcctgttcccattttattgaccgtcttttgcagaatattcttgatttgtttgtttgatgtttctgcttgtccactggtctgtggatggtaaggagtggccacattgtgtttggctcccatttctcgtaggaggtctcggaaggttttgtcaatgaagtgagaacctccgtcacttatgaccattctgggggtatcaaatttagggaagatgatttctatgaacatcttcttggcatgcctcgcatccgtagcgctgcacggcatagccttaacccacttggagacatagtcgactgccaccagaatgtactcgcagttgcgagacttagggaaaggtcccatgaagtctataccccaaacatcgaatatctcgacttgcaaattgtatgtgaggggcattgcatcgcgagcagtgattcctccttgcctctggcagctggtgcatcttctgacgaattcttttgagtcttcgtacattgttggccagaagaaaccactttgccaaatcttggcctgggtgcggaatacaccgtaatgaccaccataaggtgaggcatggcatcgttctatgatcttcagtccttcttcagttggcacacatcttcgtagtaggccatcggagcagacccgatataggtatggctcatcccatatgtgacgacgactttcatacttcagatttcgttgatttttccctggtggtatgtacttgaataccatgtagttcactatgttggcataccacgggttggagtcgcgaaccgtcatcagcatatcatctcttaagaaatcattgatcggttgttccggcatgttagtgatctgcagcctggacaaatgatctgctacagaattttctactccctttttatctttaatttctaagtcaaattcttggagcagcaaaatccatcttaagagacgaggtttagcatctttcttagtgagcgggtatttcaaagcagcatgatcagtataaattatcaccttggctcttactaagtaagatctaaacttgtcgatagcaaaaacaaccgcgagcagctctttttcagtagttgcataattcaactaggctccggttagagttttgctagcgtaacaaattgcatgatgctttttatccttggtttggcccaagaccgcaccaacagcgaaatcgcttgcatcacacataatctcgaaggacaaagtccaatcaggaggttgaatgattggagcggagacgagtgcctttttgagaacttcaaaagattttaggcatgcgtcatcagactcaaagggcgcatccttggctagcagattggtcaggggtctggcgattgtagagaagtccttgatgaaccttctataaaagccggcatgtcccaagaagctgcggattcctttgatattcacaggaggacgaatttgatctataacatcgattttagcacgatcaacttcgattcctcattcggatactcgatgcccaagaactatcccttcacggaccataaaatggcacttttcccaattaaacactaggtcattttcttggcatcgttgtaagactttgtctagattctacagacaatgaccgaaagtctttccataaactgagaagtcatccatgaagacttccatgatatcttcgatcatgtccgagaaaatagacatcatacaccgttggaaagatgcaggagcgttgcacagtccgaaggacatcctacgatacgcataggtgccatatggacatgtgaacgtagtcttactctggtcctccggatggatgggaatttgatgatatccggaatacccatcaaggaaacagaagaaggaatgatttgccatccgttccaacatttcatcaatgaagggtagcgggaaatgatcctcttttgtagccttgttgagtttcctgtaatcgatacacatcctccatccggttacggttcgttgcggaattagttcattttgagcatttgcaacgaccgtcattcctcccttcttcggcacaacctggactgggctaacccactcactgtatggtacgggatagataatcccagcatgcaggagtttcaagacctctttctttacaacctctcgcattgcattattgagccatcattgaggttccctagagggagtactctcggggtcaataggaatatgatgggtgcaaagtgcgggattaatccccctaaggtcctgaagcgagtagccaagaacagaacgatgcttctctaacacggtgagaagatgttgagtctcgtcttcagagatcttgtcacttattatgataggggcttctctgtcattgtgtaggaaggcatatcgtaggcctggaggtagaggtttaagctcaagcggaggtcgaggtgacggttccatgattggcaggtcgagagtctcaccgggatctgcttcttccttgatgaagtcggggacatcatcttccagaagggcctcgggagactcatgaggaggaactgcagtaacctcttccgctgactcaatttctgggagagggtcggtcaaggtgatccttgcccgcgaaaatagaattgagaattcattctctcccagtgttattttgaggctacctaatcggggtgtgttgatgagaagtttctcaatggacagcccgattaggatatcaaagtcttggacttcaaagacgtggaaatccaagatcgcctccctgtcttcaaagcagacaagcacatcttgcacaatcccaaatccttcgatcatatttccattcggatgcttgaagaatttgtttgtcgaggtcactgccttatcacttaaataagcgaatgcaaaagactcagagacgaggttggccccgacagttggactgtagagaataccgacatcgttcccttccagatggcaaggaatgattcgggagcggtatttatccgaattacttcggatgaaagctctgcctcccttagccattcgtctctcattatggatgtcaactcctggacagtttctcgcaggaacccaagttccataggatcgggaggtgacaacggaacaggtggtttcctcttgctaaaatagttcagggtattgccgtagtcttcgtcaaaaccttccctgaacataattgcggcacaatccggagtctgaatttcttcattctcgacagacggtgctcaggaaccttctcatcaatcgagctagcagaagtagatggtttagcaagtggctcgatcgttagaggctcctctatcttggacacggatgcctccggccgaggttcattggactgcgtcatgaaggaagtattttctagaatgcaatccaagatcgtttttcctcctgacggtgttttgtgtatgaacgatcctccagcggttatgtccagatagaatgcagattccttacccaaatccgtatggaaatgttggagaagcacatactcgggtaaggacagggttggtccggactgcactaaattagtgaatctggaccaagctgcaccaattgattcattttcgatctgcttgaaactgagaatttctactcgaagggcagtaatatgggtaactgggaagaagtcaagatagaatctgtcttgaagcttttcccatctaccgtttacatatccaacggtagaggtgtaccattgctttgctctctcttgaagagagaacgggaacaatttccaccgcacagtttcttgtctcatgccacgaatcttaaggcatgagcagacttgttcaaagtctcgcatatgatggtagggattttctagatcaaggccagaaaaaggattttccctaaccatactaattagctcgggacgaatttcatagccagttgtataaatgggctccgatgaaggaggtggctcatagaattcaccccgaggagcagacagctcaaacaaaggttgctccatggtcgagaagagttgacaggaatacttctctaagatagcaggggtgaaggtagaataaaaaaatgaaaaaggatacgaggatgaactgggttcggaaatgattagtaaccgttccccggcaacgacgctagaaatgcttgttggtatttgatacggttacagataaaatccgcaagcgcacggatatactgatgtagcacttcccctatggagtattccaagggtatcgaatccaagggaacgtgtgtgatcagcgcttcctccggttcatccaaggacaccaagcaaatgataggccaggatagagaggatttactagtgagaaacagtgtctagggaaagcttaactttaatcctaacacagtacttcaggcactggcaacccgttgttcccagatgtcgctctactacgtacccggacagggaggacttcagtgatatcgagggttgtcaccacctctacacccacctcaacgtactgtgggacacgcagcaattactggataacaattacctaaacaccacgtctaagcaaatactatctactttaatgtttataactcaccaaatcaatcactatattttagttgattatagtgaacaataatcccgtatgctatttacgaactaaccaagagataattctcacaagataaatctaaattactcaagaaaaatattatattgaattcagagtaataaacagaataaaagaaataggagaagattaccgacaactccggaattcttccaactctttctactctactctcttcctattctagtatacaatatagtaaaatagagcctcttatagtttagctcaagcttggaagtgtgtgttgaagtgagtgagatgatgtccttatataggggtaggtatgatggttggcgaaggggaaatgtccgaactgccccgcaaccgtcattggaagagcatctagagcatccacgccaaaccccaggatcaacggtgatcgggggggttcggccgaacctgggctgggccctcctggcctggccttcagtcggtggactccttgggctctcctctgtctatttctcggagttttgggttgattcactgatgttttgatgaagttcacaacccctccttgtatggatgcataattctcctcactttagtctgattttcctcccaacaccggggtttatcatctgcatacaaatatacaccaacacttgtggaatatatgagattaagcacctatcactatgttggatgttttattatctatctttatgcggatgttggcggtatagaatcgacatttaacacccgccaacagccttgccaaattatccttagttaacacaaccccttttaaacaagtaccacatgaaaattttaatcttaagtggcaacttaagcttccaaatacatttatttctctcaatatagccattattaattaaagctaggtacatagacctcaccgagaacaagccattcttatggaaagtccatcttaaactatcagataaatatatgtaggccattattttgaaaagatggatgtttgctcttaaactcctctttccaatctctcctaaaacttctacgtagaccatccaaatatcttacttaacaatccacccctcaaactcacgttccatctaacaattctcctcaagcggttatttagttttataccatttttaatcctattaataattgacacatccaaatttattgtcgctcatttgattttgtagctacaaatttggcaaatgccaaatttttcagtggcttcattaaggttagcactagcctagcccaaacaatttagtaccaatttgatacttccaatttttttcattagtgacatggttcaaatcttaacatccactaatattatgcacacattcgtaaattttcaataaaattttagtgaaatcaggaatatgccactagacatgtgttggttggaggggggggggcatttac

SEQ ID NO: 6337 - DNA, 1559 bp, Oryza sativa
atgggataaaatagcctcccaaatcaagaaagccctaaggctcggtttagataatgggttaggagggatgggattgggacaaagatatgagtggagggttgagatgaaatgagatatgaagaatgaatggctaagattaaaagttatccttttagaaggtgggataagatttcccaacccattttctgtaggatacaaaagacggcccagcaagtagcaaccagcagccaagcccaactctcttcgtccccctaaacccccacacatggcgctttgcctccgccgcgccgccgccgccgccgtcggagaggcgctccgccgcggcgcttctacggcgccgtggaggcgggcggcctcggcgtcgtaccaccacacgatccaggcgttgccgcgggagacggccggcccgcgcgcggcggcgcgggagcgccgcaacggccgcgtcccggccgtgctactcgccctcgccggcgccggccccggggagggggtggcccaccggaagctcctcaccgccgacaggaagcagctcggggagattctgaagcagtccccatacttcctctccacccccgtccgcctccaggtccgcgccggcgagcgatccaccgccgtcgtgcactccggcactgtcctccctatcaaggtcttcgcccctctccattcctgtcctttccacccaccaaaaaatatctcgttcattcgttcttgcgcatcgaggaaatcttttcgtatttcagctcagttggcgttggccgtgtcgattcgtttgctcaccctgtgtacgaaatgcgcattattagtgtagtttctcctggcaaattgctggctgttaggttatttgttactagtgttagcgacttcctagtattttgtagtgcttactttggagaaattgctcagatacgtagcagtccttatagtttaggagtgcagagaaccaatccttctttttatatgattgtttactgttcttgagcagttttatcctgagaaagctgggggaaccactggtgtggtttcgcaactatatatgcgagagtgctagaagaaattggtcagatatgttgtgcgtcaggaccgggtctgcactatcttgcataaaatggattgtggttgatgtggatgctcttgtgttttgcaggtgcatagagacgaaacaacaggaaatatattgaacttggtgctggtggaggcagatgaaggaacaatgctgaaggtgaacttgcctgtagagttcaagggggaggacgtctgccctgggttgaagaaaggtataggttttctttttatttggcaaaatccctgtgctatatacaagatgatagcttatgtttttatggaatctcaacatagaaatgtgcattgcatgatgcttaacacttggcacaaaactctgcccttctgtaactaggcccagttttatttagatcattgagtggattattgccacggattatctccttgattatagggatatttaaatattttacgaaataaacttaacaaatagtttaaagtaagcggtctaaggctctaagcaatgcagttgaagaaag

SEQ ID NO: 6338 - DNA, 1903 bp, Oryza sativa
tttgtaatttgtaactgacaatacagacagactacagatacagtatatgatttcttgcaattgacattattcagccattcatattgccattattccaattgatattacagacacaattccaaattgtcttacttacacaatacaaaattttcaagctcacaggattctattgaaaactactccaaaatttctaccaaacaatttggcactacacaaatgctcaaataggcatgctcacatctcaaatttctaccaaaagttctgtgttaggtgaggtatcaccatctgtgtgttacatttagcaccaagagttccagattccattgtccaacattgtccaacgcattgacaacagcatccaggctctcccaaaaggcatcgttgaacacattttcagtctcaggacttgctctgttctgaagggaggttgggattattgtgacttcatagcactgaattgcagttgcagttatccaggtaacccaaaatgaactgcaatcagaaatcaagaacatgttcctggaaaaagaagagaaaaaatcgtctgaaaaggatttaggtgaagttgataatttgtcgacgaacaacaaacaaagaacagaaaccacaccagggcaccaggagcgtatgttctcctcctcgccggttgcgggcaaagacacatcggatgagctcgtgcatggcgtgccgcgagaatcgctgcaggagctcgcccttggcgccggcgtggtggacgacacggatgcacgtgttgacggcagtgcagacgtgctggttcccgagggcggtggcggcgggtgcgcgcaggcaggcgagcagcgactgcagcatccgcatcagcacggcctcctcggcggcggcatcagccccggcctcgaaccggcagctggcgacaggcccattcacgcagcgcggcgctcgtgagggacggacccatgagcgccatcacctcgtggagagcggccagcgacgccgaggtgaccgcggcgccggcgtcctcggagcggaccgcgtagaggaagggccgcagcacggcggcgggggagaagacgaggcggcgcagcgccttgagggaggagacgagcgggtggtccgccgcggcgtcgtcggctacggcgcgcgggtggcggaggctgcggcgcatgacggccagcacggcgctggcctcagcggatatcgcgcaggcgaggccggcatccctcgcggcggcggcggcggccggatttgaggaatcagggcgaggaggagggcaaagatggaaaccagcagtatgactgaactacagcgtcaaataaaaagaatgatttcggattgacttagcgacgtcaaataaaacgaaacggagggagtataaagaaaacgaattaggaatagaaacgatcaagaaaagaatccaaaggatggaaaataagcagcaaatcttagaactggaattctccatatgctagagctttcatcgttatctacaacacagccaccggtgaggctactaatctgagctcagttcagttatgaaccatccaaacgcagagaacgattttagatagataatgttctgctcttccttcatgatgggagaaatatcctgctttctcgctgtggataaacaaacataagtgcgaaaaaaccacccggatatatctcttgttagctcgtctccgatcaaatctcatatatacaacaaactagggaggctacgttcaatttttgaatctgctgtagaagataagttaaccaccgagaaaaataaaaacgggtgggagtattcaattcattagacccgttaacggtcattagcattatctagtgctagcgatcgaattgagggaggatagggagggagtagctactcctggtagtagtttctaattttcctactccctccgtttcaaaatgtttgaca

SEQ ID NO: 6339 - DNA, 4245 bp, Oryza sativa
ggagtatatatatagcccatttggggcaccatggtgtatgggctccaattctaatcaccgttagatttgatcctgatcaaactagttgatgtgggtatgatattaacgggtctgcccattagtagcttatgatatatggaatcagatatacttagatgaaaaggtaccggattcataggcgtaattaattatggatggtaatgatgtttaatcacatgcacacgattgagtatgtcatttatttccgtatatagtgtgaaaaggttataaatgaaacttttttatagtatttttttttaatgaaaggaaggtaaatatactcaggcaattcgtgtgaacgtatctgaaataataattttcttcgtgactttgggtacacgacatacgcatgtattccagagtataatcgtgtcaacatatctaaaacaaatcggttgtgtttggtgaacaaattaattttacgtgacatatattccaggaatcatgtacctatattttaggtacacccatgtgttttccaaaaaaaaaaatgtttgtttaaattctataccgtaccttatttcttttgctatatatgcacgtcgagtatgtgggaccatctccataatattatactggtatagagtatgtgtgacgcaccatgactcttattattgggtatataacccatttaaagacttgtgtatatatacttctcatcagggtatatacccaaatattttgtatatatccaattttacgtgtatgtatccaaatattgaacatatacccaaatattgaatatatatacccaaatattgggtacgtacccaatttgcacgtaaacatgtacatatacccaaatattgggtatgaaccaaaaaaaaatcccggagcatgaaaaataattctggaagtacacatacccaaatattgggtatgagaacacagaaataaataccgtagcatgaaaaataattttggaagtgcattagatcctaaaattcgaaccaaaatttgaaacagtatatatacccaaatattggatttggaaaaaaaaaatccttatccatgaacaaaaccaacgacgtattgggccgacgaacgagcttgcggacgaaaggcgcggacaaccagtggctgcggcaaagctcgcagacgaccagcggcggcaacgaagaagctcacggatatctggcagcgtaacagcttgacaacgaagattgtggaggcctggttgggaagaagaagctcgcggacgtacgatgtcaacgacaaatctcgcggacgacgatcagcagcctgcgacgaagaagctattgcatatccggtggtgcaatagcttcgcgacgaatgttgccgaggactagttgcaacgacgaaggtcacggtcgaacgtcgtcagcaacgatgctcgtggacaaccaacggttgcatcgaagaagattgtcgacgtccggcggtgtaacggcgtggagatatgaaattggagtgtgtaaaagatggaatgacatctctgcccgtatatatatatacactagaaatagaaaagtattaatagtatggatgaaaataaagcaattacatcgaaattagtgggtttgattatgtacatataatttggaaataaattgtgttcatgcaatcacgatcatattcatttggaaagttgacgcatgcaagcttatatggaaacagctagctgtgcgcgaaccatgcacgtatagtacaaatggaaagctggatcttaacccgctaatatatctataatatgctgttttgagtagcacggatcctaaagcagataaatggtggatacaattggagcccatacttcatggagcaccacataatttacctatatatgtgaaccaaggttcacttcaccttaaatctggaacgttggtgtgctttaagatgtgtgctacctaaatattcattgctctgtacttgtgaaggctttgctgtgtacttgctcttgacctcactttctaatcttccaactttacccctgagctaaattatagctctctttcatgctaaacacagttaatattacttttttttcttagtgttgttgtaagttcttcatcccacggtgtgtaactgggcatggtacatttttttgttggaaataagtacccatacttttttctataactacataattaacatttacctaataaattgatcttttaccaaatgaaatttgtaaataatacctctgctaagatccaccgaaggaaggatattatggcagttggcaggagaaaatttgcagctatatcatttttgaataaaaatctaacgtgcatatataagataatatgaattataagattatgccacgtgtacattactccaataaagaggtccgggacaactcacatgatacttttgtggtgcattttaaattttatacacatttcaaattcacatgaaatgtcatacatattcgaaataatgacatatagctagatttacattaaatgatgtacctgtaatatagaaataatacatgtcaatttaccataataacattttacaaaaagaaagtttgatctatatatctacatacaaaaaaaattcaacatatctatatatctacatttacaagaacagtatatctccattcaccaaaaaatgacagttacaaaatgaaatgttgatttgttatatacacgggttgacattttttttgttaaacaaattgatgtatcgcaaaacattatgagaactcatgagaaatcaaaatcaccaaaagaaattatttgaggtgaaatgccgaaacataaacagatacttagccaattaagtgctaacaacggttattaatgatatgacttaatcaagtgatttgtaccttatagcactaccatgcgcatgggtcaacagagaattgtgagtgagtgatgagtcatcattgtccaatatgagtggagtactacttcaagtgcattttggtcttggcaattagatcatgtaccaacccctgctcacactataaggatacaaagctagatatgtacatcttacagtgattataatgtgtacacatgtcacacaaatgagtgaggtgcatatgaaccaaggttcatattttatatatatatatatatatatatatatatatatatatatatatatatatatatatatatatatatatatatatggcgccgtaggcgccacgtattagatggcgcctgacacaacacctccctaccctaccccacattcctcacatcccgcctacgccaaccatttatgagtcatttgataacttatgagaataccgcgtccaccccacacccaccactgcaccacattatctcacatcccacccgcgcccaactttcatgagtcatttgttaacttatgaccatgcccgcgcccacataacgccatgtgttattttttaactaaaaagcgggcatgcatgcgcaagtgagattaagaagccagttatttttcaactcatcagtacatggcacgtatcgacggtgtcacacgacttacctgtttttttggtttatattttaactcatgtggtgcgacaaggtgtgcgtgggggggcattcgtcgtgctcgttccggtgaggtattcgttaactccgtctgaacacacgcaactccattgcgtgttggcacgagggcagttttttttaactcgtttgcgcgtcactgcgcggtgggggcacatggcattggtcgttaaattgagttactttttaactcaagtgatcggcggtcattaaatgcatgcccgtattttttaaatttttttgtcagttacaggcagcgaatcttcagagattagtcacatcaaaaccgccgtagttatcgccgcccactcctcttccggacagttcttttctcttccccgttcttgagttcttagagatcgctcctcttctcgccgattcagttctgtggacccccgtttttataacaggaatcaatcgtgtaaacagtaccatttccctggatcaagtagtctggtacacacaagttcatagctgaaataccaaatacacatacatgagagtctagtgcgaattattacatcataagcccgcaggcatagtcttagatcatcggaccgagcggtccggaatacattccaaaagcagaagtggataaggtagcagagttaaggcagcggcacgacattgccacaggcaacaatcgtaactaagacctactgagcgccatcgtcttcatcaccctcctggtagtatgcgtagggatcctccgaagcttcat

SEQ ID NO: 6340 - DNA, 3226 bp, Oryza sativa
acacaagttaagaatttagagtctagccaagtgtaatacacgtcccggtgctcaataaccgcgagcacggctatttgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggtttaagttaagttctctctctcacacactcatggcagtcctatcaatggcgacaccgatgtagggcacgactctcggccctacctcaacagctgtcccactgtagagcacctgcctcactcaatgagaaaccactatgcatggatagtgcctccgctcggctatctaatccgctaggtctatacccattcgagaagtacggttgtacgggggtcgtttcatgcttaacttcatggctcggtccttaattgaccagggacggcactagcccttttcggataccactcaaatcctccatccgccccagtcgaaaacatttgtttagttttattttcctttcacaaatcatgtcatcaatatcatggcaatgtggcgctcatgtctccacatgccgcatctcaattaccttcccaaaggtaattgcccaagcatatagtatttgataaatatgtgtatgcgtaaatctagagtaacatttctaagtatttgtcatagttgactagggacttatacgtaaatcatggttacaaggatttaagggtaaacaataatcaaggcatggcataatggcgacgcgatggcggcgcacggggctcgggacgacggcgcggggcgcgaggcggcgaggggatgggtgcgcggcgacgggacgggcgacgcgacggcaacgggcgacgcgacagcgacggcggagcggggctcgaggcgacggcgacgcgtggcgacggtagagcggggctcgaggcgactaggggacaggcgcgcggtgacgggatggcgacggcgacagtgacagcgacggcgatgggacagcggcgcggcgcggcagcagcgagtgcgcggcagggcacggggcgcgaggcggtaggcacgcgacgcggcgacgggatggcggcgcggcgacaggcgacgcgacggcgacggtggcgcggggctcggggtggccaggcgcgtgcggcagaggaggggacaggactagggaacctcatcgaacacctatgcctgaatgaataatgttttttcctatttatccctatttcagcctatttcctatataaattttattctataaatcctaatttttgcataaatgaagtttacttaatatttgtgttattctaaccaatggattcaccctagattaatattacccatattttataatttatttgaatttttatattagggctaattcttattccgtcgcacttaaatttagttgatgcaaatatggttgcaataatatttcatttatttctatcctcaccaaatcattattttaaattatattctaattgtttattttgccaatttaattttagggtttattcctaattaattattctttattcgcgatctaagaactccgaaatcaaaatccaatgaaataggcgaataatatcggcatgatgcaatttatttaaaaagtttttgaaggcccataattttagggtttgatttcgttggtcgaattttcagggtgttacaaacctacccaccttaaataaatgagtaaattccctgtgtacccctgaaaactcactcaatccctttcatacccctaaaatttacccgaccccttctatacccctgaaatttcaatttgatcccttccatgcccctaccgttacattttccatcattttactgttacgtttggttgcaaatgtcttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaattaaaattcttatttgaaattttaataggacaatggatttttttatcaggagcattcataaaaatgttgtgaacattggtatacctatctttatatgaatgctcctcatttttatgatctttttttaaaaaaataaatacgtattttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacgggaggggtatgcaagggatcaaaatcaaattttgggggtatataaggaagtaagcaaaattcaggggtatagaagggattaggaaaaatttcaggggtatataagggattttctctaaataaatctcgtcccgagatttcttaccggttttcgaatagatgcgggtattccgtcttcaagaattcttcgctttcccaagtggcttcatcctcagtgtgattactccattgtaccttgtacatacgccacactttggtcctagtcctcttttcagcttcatccaatatccggactgggtgttctggatacgtgagatcattgctaatattaatttcttccaacggagcttgttcctctggcactcgtaagcacttctttaactgagacacgtggaagactgggtgcacatcggcgatattttctggtagctgtaactgatatgcgacttctcctcgtctagccatgatttgaaaaggtcccacatatcttggtgttaatttccctttgaccttaagcctttttgtgcctctcatcggagaaaccttcagataaacataatctccttccttaaattctaggtttcttcttcgggtgtcagcgtaacttttttgtcgtgattgtgccacttttagacgttcacggatcaggcgaaccttttcttcggcctctttgataatgtcaggtccaaataccgcccgttctctagtctcggaccacatcagtggagtacgacatcgtcgaccaaaca

SEQ ID NO: 6341 - DNA, 20236 bp, Oryza sativa
aaatggaatcataccctgttgcggtcttgggcaatccaacaataaaatccatacctatctcatcccatttccactcgggaatcctaaggggttgcagcaaacccgctggtcgctggtgctcagccttcaccttctggcatacgtcacagagtgctacgtattctgccacatctctcttcatgttgggccaccagtatccttccttcagatcctggtacattttcgtacttccggggtgcaatgaatatgctgattcgtgagcttcctttaggattaatcctttcagtccaccctgttcgggtacatagatcctctttttataccataagacatctttctcatcggtcgaaaattcctttgcaaaccctgcagctaggcgttccttcacctcttggatttcttcgttgtccttctgagcttcttctatttgggttctcaaaagaggttgaatatccagggtgtttatctgtccacggggtactatatgtaggtttagctgggctatttcctctttaagctcaggagccatcccttccattctcaaatgattgcaatggctcttacgactcaaagcgtcggccacaacgtttgctttgcctgggtgatagtgaacctctagatcatagtccttgattaattccaaccatcgcctttgcctcaagttgagatctgactgggtgaaaatatacttcagactcttgtggtcagtgtagatatcgcaatggtttccaatcaaatagtgtcttcaaatctttagtgcatgaaccacggctgctagctctaggtcatgggtagggtaattttcctcatgtggtcgcagttgtcgcgatgcataggccacaacctttccatcctgcatcagtactcctcctagtccttgccttgatgcatcacaatatataacaaagtctttcctattgtcgggaagaactagaataggcgcagaggtcaacttttctttgagctgttcaaagctttcctggcactgttctgaccacacaaacttcttttccttcttgagtagttgtgtcattggtcgggctatcttagagaatccttcaatgaacattcgatagtatcaggccaaacctagaaaactccgaatctcagtcacagatttgggtgccttccattccgtgacggcctcaactttagcaggatccactgccaatccaccggctgagattacctggcctagaaaagtgacttcttttaaccagaactcacatttactaaactttgcatataatttatgcttccgaagtttctcgagtaccaatcgcaagtgcttcacatgctcttcctcgtctttggagtagattaaaatatcatcgatgaatactaccacaaatttgtccaagtaatccgtgaacactttattcataagattcataaagtacaccggggcgttggttaaaccaaatgacattactgtgaactcatacaatccatagcgcgttgagaacgtggtcttgggtatatccccgatcctaatcttcaattggttatatcctgatcgaaggtcaatcttagagaacactttcgctcctttaagttgatcgaaaagatcatcaatccgtggtagtggatacttgttcttgatagttacttcgttcagtgagcggtagtctacacacattctcatgctaccattcttcttcttgacgaataacactggggctccccaaggtgacgaactgggacgtacaaatcccttctcttgcaactctctgatttgctttttaagttcctacaactcattgaccggcatctgatatggtctcttggatatgggggcagttccgggtatcaggtcaataatgaactctatgtcacgatctggtggcattccaggtaaatcttctgggaacacatcagggaatcgctgcactacgggcattcctttcaggggtagcatggtaaatatgcctccggcacgttcggttagtctaggatcttgatccatggttgctctcatatccgatccccagggtgtggccagggtaacttctctacgtctacagtcgattactcccctattctttgttaaccaatctatacccaatatgacatcaagggtctgaggcatcagcaccataaggttggagggaaacaccatatccctaaggcgaataggtacgtcaatacaagctgtatccacggttatttcacccccaggtgaatgcactaacattggttgccttaatttaactctggtcaaattgtgttgttggcttgctttcaaagatataaatgaatgcgatgctcctgaatcaaagagaagtttaactggaatggagttgatagaaaacatacccatcagtacgccctggtcttcctgggcctcttcagctcgaacgtggtgtcacgcccggaaattcactagtaatttccgaacttatttgtgcataaaatcctcgtccaggaatcagccgaggtacacaaactgacaattaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaatatttaagagaagtaaaacagtggagtaattaatcagaaattttaatcaacactgaacaacacacccatgctgcacggcccaaccatcctgaacaaccatacccggctgtacagatctaactccaaaccaggagctaagcaaattattaccaggtataacatccataattattgtgagaggtgtgagactaatcacgaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcgaaagtaaatgcacagttgaaataaatagagaatttaaatataggatcaacatgctcaaaggattgtgtttaagatctgtgtgacttgccttgcaataatcggtcttcaattaatcttctgaacactcccgacgcactcacgaaccttcgtaacgacggaaacgacaagctaacacgcaaaacgaagaaaaagactaataaaaaccaaataaacagtacatataaagtaaacaaacatgtagatctcgattttagatgaatttagcaacttgaaccactcaaaaccgagttacgatgatttagttatgaatttccgaagatttaatctattagaaaaacagtaaaaagaaaaacgatgatgacgtcatgatgacctcatcaatagccggaccaagatggcgacctcgccggagattggatggtcggctgcgactttggaggacatgtacacgtagaggacgacgagaggaacccaacggtactcaccctcgaaccaaacgacgaacgacgacggccggcgacgaggtctagcggcggcgcggcttcggtcgacggcggcgacggggctccggtgaccggtgacagcggggagagagcggccgagcttgcccacacctcggcgcaccttacggcggtgacggcgaccggcggcgacgacggaggcggcggcgcgacgcggatggagctcggccggcgacgacggcggggtggagcacgtggcggcggcgctacgaggcacgggagatcacgggagagggggcaaacgaaagaggaggactagggggtcctatatatagccatgggaggccgggatcgagcccacaacgacgggaaaaactcgggaaagtttagatcttcgccggaaaaaggaaaggttgaaccgcgaaattggaaaggatttccatataaacttttggggatttcttggggacaaggaagaggagattgagaggattccattcccgcaaccaattcggaaataagagcaacggagaggttggattttggaaggggatcggcggcaacaggcacggcatggctcggctctggctctggctctgtccagagctggaagatgaacagtagcgcagggaaggaaagtagacttcttgccgggcttttcttttcacagcctgattagaagagggagcaaaaccggactttggctgagagaagaagagaggatgcaggctcgggttgggccggcggaagagagaggaaggaaaggaatgggccgattcagcctaagacaagggaggagaattttattactttcccaattaaaataatcacttaaatgatctttgaattgttaaaaatacttccaatgcgcaaataatttcaagaaaaatcctgaaaatacttggacactcaaagtacttaacaaaattacaattagaccatttaatgattaatttaatatgtgggtaattactgaaatgctctttgtatgattaaaattaggaattgagctccgaaaaatccgagaatattccagagagtataattaactatggagaatttaataaaaaattaaatccatccatgctttatatttaggaaattttatttcccacatttaacttcacttgtaaattaatgaacatttaatataaattctaataatcatttattaaataatttataaatcctgaaacaaaaatcaggatgtgacaaatctacccccttacaaagaatctcgtcccgagattcggaacggctagaaagaaaagggcataggtaaactgcagtctaccttattattccataactcagataattattctaaggctttaaagaaaactactgctgctttgaaactggtggctgagctgtaacacttgaagacgcaactcttgaagacgcaactggcactgcattggctcctgtgacgacaatgttgttgacttgcggctgctgatgctttggcttcggacactctcttgcaaagtggcctggcttgtaacagttgaaacatacctgctgctcccttccactactgttattctcttgagactgatcctgctgaactagcaccggctgattagcttgctcgatgttaactttattgctttcattagtctctgatttgatctcaccaccgatgttcaactgttgcgactgtccttgacctgcagaagaaggttcaccaatttggagtggcttgatacgctgcctctggctactaccttgtgcctcctggaatacagtcattttccttttacggttatctatcctgttcttcttgtcttcaagtcgaattgctttgtcaaccagctgctgaaaatcaacatagtcatgagagatcaatgtaactgacagttcatccttcaagccttccaagaacttctcctgcctttcctcgtcagtacgcacatcttctggagcataacgtgccagacgattgaactcatgaagatactctgccacggtacgatccttttgcttcagtgtcctgaactcacgcttcttcaaagcaacaactcctgcaggtatatgtgtcttattgaatccttttgtaaactcttcccaagtgattggttgtccttctgctctgttcatccggaaatgatcccaccattctgaagcaggtccttgcaactgatgtgaagcgaaaacaactttctcctgatccgtgcactggaggagttccaacttctcaacaacgtgcagccaatcacctgcttccactggcgcgagtgttcaccatctgttgcagattagagaagataggaggataagggttacactaaagacaagatcttaaccagtttaacactgatctgatgtgtgtagaccattatattgttcaagttgattaagcaagcaacctagtatagttacacgctcatcattgaaccccaccaatgacgggaatgcaaccatacctacacacaagcaagcaacaaacgttctaccctactaactattcttcaaggatagtttggcggcataggttctaaggtaggattcaaacttcattccatcttgaccacttggcacttcggtccttcctcgatccacttgactgacctccataagttgaccacatcaacatcttctagtttcaacaactagtttcagaactactcaagttgaaagcaggaggggagaggatgataaaatgatttatagagaattctagagaaggaagaaaggaaaattttcacaaatcatgttttcggaaaatttgtccttaaggttattttcacaaatcatgttttcggaaaatttgtccttaaggtttgaccatttggcttatcctacagtcgagatggctctgataccaacttgtaacgtcccgccttcccccaggccgggcccacttacatctgatagctttcataggtcatagactgccctcacagaccaacacatgtcttttctgcacactttgtcctcactcgtgtgcagcacgcttaaccctggagttctttggagattggcttccggaaaagaagttgcaacttgttgatatgagtattctattaatcctattaagccctagaccgggatgttacaccctcacccccttaagagagatcgactcccccgtcgatcaaccctaggccaggaacgtcctctcttggccacgtccatgtgtccagtgccagcgcatgtgccatgctgtgtaaccactcccggtctacaccagacgtgcgcaccatgcctgcgcaactgcgacacacgcgcccgtgaaaccgcgagagtcggctctgataccattttgtaacgtcccgccttcccccaggccgggcccacttacatctgatagctttcataggtcatagactgccctcacagaccaacacatgtctttatcctcactcgtgtgcacccgggaagaatttcccggtcggtcacccatcccaaattgctccaggccaagcacgcttaaccctggagttctttagagattggcttccagaaaagaagttgcaacttgttgatatgagtattctattaatcctattaagccctaggccgggatgttacacgtggttcacttgcccgcgtccaaatccggtagaggtcctgttagtctgcggagtcctgaataaacctcgtccagtagcaggggtagcagtcccgtgaatagccattgcgttagctccggtgcgaatgggtgtcttgtttggatgggggcacttgttggcgaaatgcccgtactctccacagttgaaacagcttcctggcctcactgatccagtagcggcctgatttggtgtaggagcttgggtctgagtggtaaccagcctgtggaagttgctaggtgcggtaggacgattggttgttaccaccgttggtctccatcctgatgaggtagttcctttaggacactggggtgcgacctgaggcgggcggttcatggcaagcctcctcttacgattgtgctccacaaccttccggtcgttttccagtctaacgaccttattgattaaactctggaaactatcgtggtcctgtccaatcatgggcccacgcaactcgtcgttcaggccttcgatgaacttgtcgatcttttcctcctcgtcggcaagatctccagttgcgtaacgcgccagttgagtgaaacggtttaggtactcttgtatagtggtatttccttgtcgtactctcctgaactcattcttcttcattcgcatcacagcggcaggcatgaagttgtcacggaaggctgtagtgaattcctcccagcttggttctccagcatcttcttctcgagcttctttgtaggtgtcccaccagtctccggctggtccttccagttggttcaccgcaaagatcactttatcggcttcacgtactcggacaagggtcagcttcttctcaatgatccttaaccaatccttagcatccataggttcttcagctgtggcgaatgtgggtggcttagtcctcatgaattctccaaagcttgatcctccacggttgccttgattatttgcgatggcttgcagaagttgggtttgagtagccatgactccggccagggtgtttaggtcgggtgtttgagtttcttcattgctggttgacgcccgatgtcggcttgccatctgtgtaggccgatgaggtaagtatcctaatttcctaactagcccttatggttttatcccgttaagggagttgttttgatgtgaactttgttttgcaagcatggtggaataaactcattcataacccaacagtaataatatcataaataacatcacagagttccacagataatacataagtcatgatgcaatcgactgcacatatacgtagtccaaataaagtttatctaaaagatacatcgaactaatcatcaagctacccgtcaatctaggtagggggggtgtgtctcgcatgctatccaaaaaccatctgaagcgagatcgaagctgcaatagtcctccagtctagtcatccaaccatccgcaggatcctggggcaggtagagggtggttgctggctcgtgcaaacctgagtccccatggctcggaagtagtggcctctggatctggcttgggcttcttgcccgggggtcgtgtgctcttgcgagcagtgctgagggtgcgagggcctctgataaaggtgatgcggtggacaggagtctcgtcctctgaaggatcagtgatgtccggctctatctctggctcagtgtcggtcccctctgtctcggagtcaacctggatcggagtctccaaactggaacccagctgcggtgacgaagtagggatcagtggagtgtgcacaatctctggggcaggtggctgtgtcactgtcgggtccaccaggtaaggtgctgactcagtaactagcatatcaacctctcccaaaagagcgtggagcgctggtgggtatggcggagtaaggaagaagtagcggtcacgccctattgctgaggaagtagaagctcctgtggtgctgactatagctgctcgaagctgctcctcaagctggctgacgtgctcctgactctttctcagctgctcctcgagtgtatccatcatcccgcggcgatcattgtactgatcagatagctgctggaactggtcgccatggacctagagctctaccttcagtgagtctatctcactgccccaagcctggtgctcctcctctagctgaagctgctgcactgtgaggtcagtcacctcggtctccaactctcccaaacgcctctgctggtcgtcgatctctaatagcgcctcctcgtagaagtcgtctactgcctcagcccatcgggacagtcgagtcaccatcgggttgtagcagcaaggtgtatcctagactttgtagacatagttgctctcctcccgaaacggatggtaagcaaagtcggtacttgccaactcagctcggtgaatagagctacgtcggaggaaggcctcccgggctgcgtcctgcatcgcggtctctgtaagtcgcgacggtggcgtgtcggaaagctgtagtctgactctgaaggaactcgtgtatgaacctcaatccgagcctcccaaacgggtccacactgtctcactcggtagatcggaaatctggggtaccgtaggcgcctcatcaaccgatgtagctcaatgacatatccctctgagcggggtacgcccatctcccagatagtgagtgaatcctgatctcccatctaattttaagaaaaacccaaagtcagctaagagtaaaactcgttttgggaagaaaatagttaagagtaagatgaaaatcgtatatagttttgtaaacatagcgtctttatttttgaaaatattactaaatgggaatttctcccttggccaactaggaaaggggtggggcgccttttggtcttttcctacagttgtatggctctgataccagctctgtggacccccgtttttataacaggaatcaatcgtgtaaacagtaccatttccctggatcaagtagtctggtacacacgagttcatagctgaaataccaaatgcacatacacgagaatctagtgtgaattattacatcataagcccgcaggcatagtcttagatcatcggaccgagcggtccggaatacattccaaaagcagaagtggataaggcagcagagttaaggcagcggcacgccattgccacaggcaacgaccgtaactaagacctactgagcgccatcgtcttcatcaccctcctggtagtacgcgtagggatcctccgaagcttcatctccggcctctgattaagtttatatattgcaagggtgagtaccaaccgtactcagcaagccatcacagcaacaatgcacatgataggggtattcaaaggatggctatggttctttgcgcaaagccagtttcgtaattcttttcacaagcctaagacctagcattgattgatcaaactttagtaccagtgttcacatttaaacaacgatggttctgtccaccatccattgtgatcccaaggatagcttctcgccattgagtcgtcatggttttctgatgtcacgaccagaaataacccaacgggcgttccttacgtgcgtgcattattccttgtcccaggaggcaaggtacaccaaaagttgatacaattcagagtttaacaagcggaagcgtaattaatttattacatgggcagtgaagacccagcacacaagaagacaaacgaaaaacagcggaagactagggtgacgaccacaggcgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggagccataatatagggggttagggtttgcagtaaacagcattaaaagacacttagttgctcaaagctattttgtaaacacggtcctagagctatacaatattattaatcaaggccgtgaacccacacgaacctgccttaacccaaggcctacgatgattcagaccaaactggcaacccgaccctgggtcccagctcgtcccaagccaacccaggccaaccattccacattttagttgttaagccggttttaggaattaaaaacactaacttgggtacattgctcgacttgcccataaccgagggcgcggctattcgaataggttatactctgatcagaggtgtacatctttacccacaagacacatcatcctcacgtgtaaccacgtgccacataccaccatggtatacggacggaagacatgacatagtttccaacccatcctagccataaacaagagtaccgacccaaccccacctacggccgaaacccccgggacaggcaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatatggaagtacggtagtgctttgcaacagaggcccgaagaccggtccttatatggccgaggtgctactatcaaaaccatgcaccctgagcccagcctaaaaccattttgagggttttgaatagagggggaggtgtgaatccaattccacaataatccatccattccatagtgtccaggtgatgagaatattcccaaagtctagagttgtaaaaccacctaatgttgcctaattaaccagcgaagcatctacctaaaatcatactagtggtaccatgagtagagtgtccactagttggggttttgtttattctagggtgaacaaggtaataataacaataacaataataaggtcataacaaaggtacataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacctccacaaagagcggatcttccgaagctgcagcgtctacacgaccaacggaaaagaaaaggcttttacgctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaaatttaatttaaaaagggtttattgcgtcagccgaggggagggggcgcgcggaccgggtccacgggagtagggcccacgtggcagcctcacggtccacggtggaccgggcgcacccgggctcgcaccggccggcgccgtgggccccacgcgtggtcgccgcgacggccataggcacggcggagcggcggccgagagaggggaagggaagggggaaaagaggcggcggtccacggctcaccctaggtcgacggcgacgatgaaaaaggcggccggagcggaggaaggcggcgcggctcgggtcgacggcgttccggcggtcggcgaccgaaacggagaggtggacgaggtcggcgaggatgcggtgaagccgaaggaggcggcaccgaggtgggaggtggtccggggcgacgacggcggcggaccggagctcggcggcaacggcggagagagagagcgacgtcgcgagctcgaattcggcgaggaggaagggtggcgagaggcggaaacggacggaggaggtgcggggagggtttaaatagggccggggcgagagagggcggccggagaaggaaggaaaccggtgcggcattctcgggctccatcaatggcgccagcgggattaggggaggggtttccaaacgaatccaagggagagagggagggaaaaatggggggaaagggagaggggatcacggggagtgattccccccactttattgcacgcggggacggcgggaggcggcgggatttgcggcggtggcggcgctagggcgcgggggaggcggcgggagcggcgggaggtcggggatgacgggtgggccccacccgtcagcaagggtggcgggcgggcccgcccgtcagcggcgcccgcgtggggagaggccgagtgggccgcggggagaggagagagagggggagggagatgggccgaattcggcccattagagagaaggagggattttagggtttttctttttataaaatcattttaactttgtttatttcttaataattattatttatgctctgaaaatttcactaaaatttatttacacattttaggcttttaggagatatacaaaaatcgtctaagccttaattgacttttagctttgcacattttaattgttggaggctttcacacggtttttaattattctaggcataatttagaggatgtattttagagtcgttttgggacgtgacatctgaggacgtccaccttcccgcctctcaggaagtggttccaacagcataaaaatcatcatgcaatatcccaacccacacaagttaagaatttagagtctagccaagtgtaatacacgtcccggtgctcaataaccgcgagcacggctattcgaatagatttggtttactcacactgcagtggatgtacactttacccgcactccgcaactgcccaacacatgagcctcgtcccaacgcatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacatatattaaattatggttcaagttaagttctctctctgacatactcatggcagtcctaccaatggcgacaccgatgtagggcacgactctcggctctacctcaacggctgtcccaccatagcgcacctgcctcactcaatgagaaaccactatgcatggatactgcctccgctcggctatctaatccgctaggtctatacccattcgagaagtacggttgtacgggggtcgtttcatgcttaacttcatggctcggtccttaattgaccagggacggcactagccctttccggatactacccaaatcctccatccgcccccgtcgaaaacatttgtttagttttattttcctttcacaaatcatgtcattaatatcatggcaatgtggcgctcatgtctccacatgccgcatctcaattaccttcccaaaggtaattgcccaagcatatagcatttgataaatatgtgtatgcataaatctagagtagcatttctaagcatttgtcatagttgactagggacttatacgtaaatcatggttacaaggatttaagggtaaacaataatcaaggcatggcataatcacaagtaggatgttcatcattgcatgcaattttattagtaaacaaaataattttgtaaatgggatcaacgtgttcaaagaatagtgatgacttgccttgctcgtagtcctgcgggtcttgaccctcgctcggatccgcaactccctcgggctctagaattacgtgcgaagaacgatttgaattcaattagaattcaaataaaatccaaataaacttcaaataacagtcgaacgcgaatcgatctttctatattgattacaaagtttgcaaaaccacgctattccaattttaaggtcatttaatcctaagtcattttgtgatttagaagtgtctccattaaaaattcaacgaagaatacaattcttagtaactaaatccgattatctccgcgagtgagttacttatagagattactgaaaataatctattttcatattaaactttgcaattctatgactataaataatctataattaatttctaattattctaaattttctaatcctccttaatctccatctaatttctatttatttatacttttttttattctatttctctcctcttctctttcttttcttttcctctctttctttctcttctttttctctcttttctttcttttctttttctctcctctttcttttctttttctctcttttctttcttttctttttctctcctcccccaggcttctttcttcccccctctctctcggctcatgctaccggggcggtgacggcggcggaacggggaagggcggcggcgacggcgaggcgacgctcggcgtggcacacggcgcggcgcggtggcactgagggcggcggcgcagcggcacgaaggcggcggcgcagtggcacgagagcgacggcgcggtggagagggaagaggagagaaggagggaaatggagtggggagaatggagaggggtggggtttttataggggagagggggaaagagagagaggaaagaggtggccggcttaatggcgacgcgacggcggcgcacggggctcgggacgatggcgacgcgcggcgacgcgacagcgcggggcgcgaggcggcgaggggatgggcgcacggcgacgggacgggcgacgcgacggcaacgggcgacgcgacggcgacggcggagcggggctcgaggcgacggcgacgcgcggcaacggcggagcggggctcgaggcgacgaggggacgggcgcgcggcgacggcgacagtgacaacgacggcgacaggacgacggtgcggcgcggcagcagcgagcgtgcggcaggcagcggggcgcgaggcggcaggcacgcgacgcggcgacgggatggcggcgctgcgacaggtgacgcgacggcgatggtggcgcggggctcggggtggcaggcgcgcgcggcagaggagggggcagggctagggaacctcatcgaacacctatgcctgaatgaatagtgtcttttcctatttatccctattttagcctatttcctatataaattttattctataaatcctgcataaatgaagtttactcaatatttgtgttattctaaccaatggattcaccctagattaatattacccatattttataatttatttgaatttttatattagggctaattcttattccgtcgcacttaaatttagttgatgcaaatatggttgcaataatatttcatttatttctatcctcaccaaatctttattttaaattatattctaattgtttattttgccaatttaattttagggtttattcctaattaattatttcttattcacgatctaagaactccgaaatcaaaatccaatgaaataggcgaataaaatcggcatgatgcaatttatttaaaaagtttttgaaggcccaaaattttagggtttgatttcgttggtcgaattttcagggtgttactagttctcggggatcgtcagcgccgtcgaagtttctcccaagtgattcccttcccacaatgttggccggcaggtaccagcaatatcaccctccacacattcctcttcctcatcccatatctttatcccccgccgcatgagtttgcctcctcacccccattgccgggctaaccttttttgttgttgatctagagccatgtccaatggagatgactgggaaaatgccggctagggtcaagcggattaggtttgccgattcgcaaaacgagtgcgaggtcgtcctgccccaaacacttgctagcggcggagcgtcttcgtcgagggaggtcggtgaagcagcacagagcaagccaaaaaggagacggcgtgctatgtcggccggcgagggcccatgaggcgacgaggtgagcaccacattacttttctttcccttataggttttttcctcatccctttttccaccaatactatcaggaactagattgtaatgtttgtttttggcattatagtgcaaccattggtcatgctcacatatcatgggttgcctacggggtcacttgtaaaaagtttactgggttggtgcggtttatcagacaattaaatgcatatgtcaaagcatactatagttgtccaaatcgttttagttaaaaaattgctgctatgtgtatagcctgacgcgttcagcgctctggtttgtcatttatgagctatattttgaccttgtacacctgcttggtgggtggagcccataatttattgagttaaaagtttattgtttttttggagtgggtatagtcagactggtgatcaaggtatagtttgattcgcacacacaccagttgcccaaatattatgtcagtaaaaacaattgctgctctgatatatcatgatcacctcatgtaactctgtatccttaagagctaccatttggtactgacaaccctcccacggttttgctgctcgtcatatctattcacttgttgtttactttcctctttttatgtttgcagccacctgagacaaagggtcataacctcacatgctgtagcgccgctctagcggcgcaggcttgtagagcgctattagccgtacaccatgagaaattggaggagattggacttgaagcggtagcgtgcatgtctcttgaaagccttgagcagccagacctaatacgatggctcatggacaggactaatcccgtgtcgcgcccgaaaaaataccttctccagaacgctagtgtattaatccccgtcctaggaaaagccagggtacaccaaacaaacatgataaaaaaggcacatctttagtatatcgataatatttacattattacaaaggcatttcaggcctgacaaacaaaaataaatagcagcggactagtgggcctacggctctatcttcataggcgctcaactggggtataagcgaggactccacccaggacttcttcttcagagcttctcttattgaaggggggggggaagatagagcaagaatgagtacaaccacagtactcagcaagtcacacaaggagatgcatgattaatgcaagggagtacaaggggtaataatataggggttaagttttgcagtaaacagcatttaaaagtcacttagttgcccaaagctattttataaagacgattctagagctacacaatgttattattcaaggccgtgaactcacacgaacctgtcttaacccaagacctacgatgattcagaccgaactggcaaccagacccaggtcccagctcgtcccaagccaacccaggccaaccattctacattttagttgttaagcaggttttaagaattaaaacactaacttgggtacattgctaggcttgcccataaccgagggcgcagctattcgaatagattatactctgatcagaggtgtacatctttacccacaagacacgtcttcctcacgtgtaaccacgtgccacataccaccacggcatacggacggaagacgtgacatagttcccaacccatcatagccataaacaagagtaccgacccaacctcgcctacggccggaacccccgagataggtaggcaggattgagcccctagcagcaaaacaccgaccctgtgccatgacatctagactaccgagccgcaactcgtgtagccttcatttgtcctagagatgtccatcgagtcccgacttcgtccatctccatccgtgtacctttgtttatgaccagactgagccacaaactacgccttacccactagacatgtggaagtacggtagtgctttgcaacagaggcccgagcttaatccttatagtagcctaggtacgactaacaaaacccaaccccgcacctcgagcctagcctaaaaccattttgggggttttgaatagagggggaggtgtgtgtccaattccaacataagctagccattccatattgtccaaatgatatgagaattcccaaagtctaaagttataaaaccacctaatgttgcctaattaatcagcaaagcatctacctagattcatactagtggaaccataaatagagtacccactagttggggttttgtctatcctagggtgaacaaggtaataataacaatagcaataataataaggtcataacaaaggtaaataggcatggctaaataaaaccgtgataacgcgggaatttaagtaaagcgataatgcattaatttaaatcaaaataattttataaactgggattcaatatgctcgaggatgatgtgacttgccttgctcagagacaatggccttccgaaccttcggcgatgaccgcgaaccacgcttcaagaacctccggaacgacagaagctacgcaaagcacacaagcaaagctacaaacctataaagaagcaataacaatacataaaaaggaagcacagggttctttaggttataacaaacattaagagacttgaacgggtcgatttggggttcgtatgaccaagatatgatcatctgaagtttaatgctattatatggagatttgcagattattataattaggctttgcaactataaaacatgcgtaggcgctagcctagaaaagacaggaaggctacgccgttaacatgcagaccccacatgtcaacctaaaggaccacggtagaccgagtacacagagactgtccacgagtcaatggaaacggaccccgtgtgtcaaccgaagcgagtggccgacaaacggactccactagacacgtggaaaccacgcggctaccgagcgggcacactaacacggtcaccacacgcacaagcgaacgactaccgacaccagtacacgggtaccggggtcgacaaccgcacaacgggtacggggcgacaccgaaaggacgaggatggtgcagcgaaggagagatccttaccaccacgcaacgaggtgtgagaacgacgacgacgaacgggcgcggcagagacggacgggaacgacggagacgaacggcgaggggacgacttcggcggcgatccttggacgaaggcgagacgcggccggtgcaacgcttgacgacgcggagctgaggacgaagacgaagaaggagctgcagcggctcactttacggacgcggacgatggacgagaacgacttgacggagggacgaacgccacgacgatgaggacgatgaccgggaccggcgagaaggcgacgagggcagccggcagcagctgcacggagacgaggacggcttggaacatgccgctgtgatgacgatgacggtggcggcgcagcgagacgacgagccgggcga

SEQ ID NO: 6342 - DNA, 1150 bp, Oryza sativa
acaacgcttcatagggtgccatttgtatgctggcctggtagctgttattgtaggagaattcagcataggggagactcttgtcccaggtcctcccaaaatccagaacacaggcacggagcataagagcttcctgaagtatcaactgtttaagttccttgttgtccggaacgcatacacgatttccattccataaggttccgtgttcatcttccgtgaagccagtggctttaccctgcttcatattcttgaggatctcctgtatatccggatcattcttctgagccttgcgtatgtgatcaagcaaggtgggctttgcttctagtgcagccaggaatccatggctaacgacacttaggttcagggcttccaactgttgattaagttccggtggaatgccgcggacacaaagagcgttgcagtggcctttccgactcagcgcgtcggccaccacgttggccttgccagggtgataatggattcccacatcatagtctttgatgagctctaaccatcttctctgccgaagattcagatccgactgggtgaagatgtatttcaaactcttatgatcggtgtatatttcgcagcgatttccaatgagataatgccgctagattttcagagcatggaccaccgcggccaattccaaatcatgggtaggatagttgccttcatggggtcgtagctggcgtgaagcataagctaccacatgaccttcttgcattaacacacaccccaatccttggcgtgaagcttcacagtacaccaggaaatccttgcgggtatcaggtaagattaacactggtgaggaaaccaacttttccttgagagtttgaaatgctctctcacactgcggactccacacaaatttttcttccttccgcaactgcgtcatgggcctggcaattttggagaaattctcgatgaacctccgatagtaccctgctaaacccaagaaactgtggacctgggtgaccgtcttgggttgcttccaatcggtgacagctgttactgtctcgggagccacagcgactcctttagcagatattacatgccctaagaacttgacttcggacaaccagaattcacacttgctgagcttggcatacaactgatgttctcgaagctttcccaataccagacggagatg

SEQ ID NO: 6343 - DNA, 499 bp, Oryza sativa
gcggcgctgcacggcatagcctcaacccacttggagacatagtcgactgccaccagaatgtactcgcagttgcgagacttagggaaaggtcccatgaagtctataccccaaacatcgaatatctcgacttgtaaattgtatgtaaggggcattgcatcgcgagtagtgattcctccttgcctctggcagcttgtgcaccttctgatgaattcttttgaatcttcgtacattgttggctagaagaaaccattttgccaaatcttggcctgggtgcggaatgcaccgtaatggccaccatagggtgaggcatggcatcgttctatgatcttaagtccttcttcagttggcacacatcttcgtagtaggccatcggagaacacccgatataggtatggctcatcccatatgtgacggcgactttcatactttagttttcgttgattttcccctggtggtatgtacttagataccatgtagttcactatattggcataccacg

SEQ ID NO: 6344 - DNA, 985 bp, Oryza sativa
aatttgatgatatccggaatacccatcgaggaaacagaagaaggaatgatttgccagccattccaacatttcatcattgaagggtagcaggaaatgatccttttttgtagccttgttgagtttcctgtaatcgatacacatcctccatccggttacggttcgttgcggaattagttcattttgagaatttgcaacgaccgtcattcctcccttctttggcataacctgaactttgctaacccactcactgtatggtacgggatagataatcccggcatgcaggagtttcaagacctctttctttacaacctctcgcattgcattattgagccgtcgttgaggttccctagagggagtactctcgaggtcaataggaatacgatgggtgcaaagcgcgggattaatccccctaaggtcctgaagcgagtagccaagaatagaacgatgcttttctaacacggtgagaagacgttgagtctcgtcttccgagagcttgtcactgattatgacaggagcctctctgtcattgtgtaggaaggcatatcgtaggcctggaggtagaggtttaagctctagcggaggtcgaggtggtggttccatgattggcaggtcgagagtctcactgggatctgcttcttccttgatgaagtcggggacctcatcttctagaagggccttggtagactcatgaggaggaactgcggtaacctcttccgctgactcagtttctgggagagggtcggtcaaggtgatccttgcccgcgagaatggaattgagaattcattctctcccagtgttattttgaggctacctaatcgggatgtgttgatgagaagttgctcaatgggcagcccgattaggatatcaaagtcttggatttcaaagacatggaaatccaagatcgcctccctgtcttcaaagaagacaggcacatcttgcacaatcccaaatccttcgataatatttctattcggatgcttgaag

SEQ ID NO: 6345 - DNA, 10695 bp, Oryza sativa
atcgccggagccctcaatccacaagctcgccgctcaagtgaagaaactctgcaaggagaacatagagcttagggatcgcaatgcggagctaggggtagaactcgctaaaattagaaataattttgatacccgtagtcgcggtttgtgcgctaagatcaagcgtgcattcatagtgatggaaaaggaaaataagtattatgctaattagatgtttcctttcccatgaataaaatagcagtaggtgcttggttttatttttccaatcatgtaagcacttgctacaaataatgtggctcattggtgttaaccccaatgtttgccaaggtttttttttgttttatatttaataaagtttaggtttttaataagtgtgggggagatatcccagcttctgacgtgtatacactgaaaattgctgaatatctgaacacctggaaggcattgaactctacagaaaattgcaaaggtattgggcaccatagtggttcggctgaaccaccaggttcggccgaactagtgttggccccaatacctcctagttttcacaggtaagcaggtgagcatgtcttgtatctgtatatctccaccatggtatagtactagagctgaaaattgagaaacaattggttcaagcataagtaagagataaaatttccaactaatgaaattcttcatgtgattgatcttgtatattcattattctcagctgaactttgcttgtgaacaaccatccatgttttgggaaccttatacatctaagtaattgctttatgtgagatgattaagatgaaaggaatccttgcaacatggttatgactcttgggaatttattttcaaaaataaaattattttaagaaggctcaatcctccaattgactttaccttatacctaccaaggccatatgcaagtacattaatgatcaaccttatcatgcatatgactgcttgacattatattgagctttgtcaaaattgtgtgacttgtgttaaatatctttcatactctcatgatcaaggggtcactatcatttccactttccagttccacatataaaaaaaattggctaagcttctacactggaagttggctttccacaaaaatatccattcaaataaactcctacattggactatgctttcttctcctggaaaagttcttggcaaaaaaagaatgacaaaagggggaaaggcatggctatgaaaaaaaagagaaaagaaaaaaaagaaggaaataaaatttgctctcaaaacattgagcaaagaaaatatagccatgccccctccacaatcatgccaagaaaaccaatttggagagaaagtataggaaaaaggagaatcatttctttattccatcattccacaacatatttcacttttccattttcaaccacaaataaagatccttgatctaggagtatgattgatgatcttcttgagtccatatttttggctttgcaatatatatgatgcaagtatgtcaccagtttatccctaccaagctccacatatcagccttagaataggggtaaattctggcacactttgccttggtgaggatccaaaagaaaatatacatctttgagagacaagagagaaaagtcaatataaggaaaagagctagtttgcgaaaattcataaaaatcccatgagtatggcagagaagcaagaaggactggaatcaagattgttccatttatcaattactcaagatggtaagatagccattgatatagttcacaagtgcaggtatgggtgtgaatgatttatatgcttaattcatatcatgaagaaattcattctacactaacctttactcagggacgagcaaagggctaagtgtgggggttttgttggtggctattaaatgccgattctataccgccaacatttgcataaagtacagataataaagcatccaacatagagataggtgcttaatctcacatattccataagtgttggtgtatatttttatgcagaagataaaccctgaagttggaaggaaaatcagactaaagtgaggagaattatgtatccatacaaagaggggtcatgaacttcatcgaaacatcagtaaatcaacccaaaactccaagaaatggatagaggaaggtccagggagtccaccgaccaaaggccaggccaggaaggcctagcccaggttcggccgaaccccctggttcagccgaaccctggtgatcgccgttgatcccaggttttggcatggacatcccagatcactccctgatggcggttgcggggcagttcggacatttccccatctcacaaccgtcataactgccctataaaaggacctcacttcattcactctcacacacacttccaagcttgagctgaattataagaggctctattgtactatattgtatactagaataggaagagagtaaagtagaaggagtcggaagaattctggagttgtcggtaatcttctcctatttcttttattctgtttattactctgaattcattataatattcttcttgagtaatttagatttatcttgtgagaattatctcttggttagttcctaaatagcatacaggattattgttcactataatcaactaaaatatagtgattgctttggtgagttataaacactaaagtagatagtaattgcttagacgttttgtttaggtaattgttatccagtaattgctgcgtatcccacagtacgttgaggtgggtgtagaggtggtgacagccctcgagatcactgaagtcctccctgtccgggtacgtagtagagcgacatctgggaacagcgggttgccagtgcctgaagtattgcgttaggattaaaattaagctttccctagacaccatttctcactagtaaatcctctctatcctagcctatcaattgcttggtgtccttggatgaaccggaggaagtctgatcacacacgttcccttggattcgatacccttggaatactccataggggaagtgctacatcggtatatccgtgcgcttgcggattttatctgtaaccttattaattaccaacaatcccccctcctgaccgatgatatgatgggattaaaaaagggttacaaaatcatacgtgttattactcatacgtatgcacgggtctaaagctaaaaaaacaactcaataagcacaacccacccaataaatcacgcagtaatataacgcggctaccgtacataagtaaatatttaactctaattgccatcatagcatcatctataatatatctttattcaaatctacacctcgaaggtctcatgtcacatggtttaactacaatgtagttaatttataacttgttacattgtagcaacgtccaatatcgccacattgtttgttacagaacatttcattcggtaccaaaaaaaaaataaacgggctgagcattaatcggacaagccgttatcacacaattaaccccacgatccgtttttttttaaaaaaaaaacccaaaaaacggggcgtgcaacacatgtagatccatcattatcgccagtgcttacgtccaaggcgtaactccacacagaaagcaaaaaaaaaaaagaatcagcaaccaagctagcttcaagttagtgggggctctcggagcacatccttccagtcactccttcatcttccttggctgctcatggcatcgccggagatcactagctccacgtcgttttgtccgccactcactcctcgctcatcaatgggttgccctccggcgagctctccacaccaacaatgtaccccaacgcgccaagcaggagatgctccctctcaatggatgccgccatgcttggatgataacgacattgcaacccccacgccgaatagggtctacaaccatgtaagttccactccttcaatcccactgtgttctatggtgaatattatcgacgtctagtttgcgatagtgatgcaccaaaagcacattatttcgagccacgattattttttttcgttgctatcgccgtgtgacgatactaactactcccactaaaaatataccattttttatattttatatatggtttgccaatatttcatgaatcacattcaccgattgattcttttaacgacaagcaattctcattgcattcaatagttaaaaactaactcaactcccattcctagaacaactaggttcaacaaacatctatgcacgataacttcgatctataagtaattttatatctctaaacctgacactcttgctacgtaattttggatgttttatatcactaccttcatgaatacgaaagttatttttaaactatcacaatgatcccgaacgcacgtctctgttttattaaccgaattaatcccatacctaaggaatacactagcaactggatacaagccattttttaactggcaatccacgtgctatactcagcagccataataattttagaaatggtatctaaactttcataatgtttccagtatttcatcgataatttattaacaaaacttatctttgctatataacagggtcctagcgtgccaccgcatatggtgcccaccgaaggcatggctttccctacatacgacaacgcatacaacttctaccagaggtatgcatgtcacgctggatttgacatcaagaagagccgtacgcacaaagcgtttcgcgaggtgtgttgtacgagggagggcaagcacgtgtcgaaggtcaccgatggtgatagacaacggaggagaccgtccaagaaaatggggtgcaaggcttttatgaagctgaggcacaactacgacggtggtgcgctctcatcggtggtgtatgatgtggtcgagctacagcacaaccaccctctaacgccatccccttcggcggtaaagcacatgcgtgcacataagaaccgcgacgacacagttatgcaatttgtggacactatgcaagaaagtcacgtgccgcaaagttgtatcatgggcgttctatctgatctccatggaggccaagacaatatccctttcacttcacgcgacgttgagaacaggtgatttttttaaattattccgtttcttggctttgtgatgttgctttcatgaaagtttcttttcgtgctttcttgcacgaagacacaaatgtggattgtaattaggacgttcccatctgaccgatgcaggaaagtagccaatgtccgaaaggaaaatgcgaatgacatcaacaagttgttggagtttttcaacgagtgcacgttgcaaaaccctaagttctactgggacgcccagcttgatgaaaatggtgtcattaagaacttgttttggagtcatgctagcagccaggttgaatttgctgactttggagatgcggtaacgtttgacaccacatacaaaactaatatttacgaaatgccacttgcaatgtttgttggtgcaaaccaccatatgcagagcacactcttcggatgtgccttgctcagagacgaaaaggtgcagtcatttgagtggttattcaacaccttcaacaagtacatggctaatttcccggctccgcgctgcatcctaacaggcaagtctatctacaaaaaactccctattgtcatccaccattaattttttccgtgtctccaatttatctacacttcctgtacgattgttttactgccatttacatcatttttttttcagatcaagatcctgctatggcagtcgctgtcgggcggtgcttccctgggataatacactgactctgtaggtggcatatcctcaaccgccactctgacccattgaacaccatttttgcacgggacgctcaaattgaaccagacatgatgttgtgcatcaatcaaacctacacgccttatgagtttgaaacatcatgggatcaattcataaagagttatgatttggagggctgtcccatcatgaaagctttatatgatatcagggaaaagtgggtgcctgcgttcttcaagaaggaatactgcaggaggatgacgtcgacgcagcggagcgagagcatgaacaagttggtgaagcacaagtttgctgaccaccaaaccgcgctgcaccgttttgctcggagaatgttggaggttataactgacaggaaggagaaggaggctgccgagacaagagcatgctcggttagtgatatttttactgggggaaacggtctgacatcactcctataattctactaaattttaactcacaccaactaattatatttctttttgtacatggaaagccaatgttggctgtacggtggccatctgttatacagatgtcgagactttacaccagggcggctttcagattgttcgaggaggtgcttcaggacagcactgacttcaggatcacacaagacgacaatttccgcaacgggtgggtagttgtcgacgttcgatgtcgcaatttcggtatttgcatagtatgggcatcgttggtacaaggatatatgcgagactaaggtaaaacagatagggacgaggatttttatacaggttcgggcccctgaattgtcaggtaatagccctacatactgttggccgaagcaggtcgttgctcttattcatcataatcacaccagtacaatatttggggtagcctatctaactgttgtcaacttagcagactgaagtatcatcacgtagtcgacaacagggtagtcttcctcctcgaatccatgcccggcgagatcaaagacagcgctagattcctctctttggttccgcaggtaccatatggggttttcctaggcttatctctgaaatcgatatccggcgtcttgtcttggcatatgttggcttgtatgttgatcttgtttattgatctattgttccgtgtcccctctcctcctagggggccttgtatttatacccctaggtgtccccttgtccaagtagaactagggaaaccaatatggatacaatccgagtagtccttatcgtttccatgtagaactctagtcatccttccttatgcggaactcctcctatatccgaaggttgtttccgtataagacatggtatgtggtgggtcctgccgagatttagtcaactactgctaggtatgtggtatccataaccctgacagcagtgtcacacaccaaacattccgaaaaacacaactagtgtcagaagcaattcaaggttattgcagatgtcgatgaaggggtatttacatgcaagtgcaaacagtgggagcatacaggtatttttatagtataaactcgatatcgatgttttatgtacgtttaacattttcagcattccgttatcacacatcgcaatactttggtttaaatgctctctcctttttttggatgtaatttaggcatgttctgcacacacatgctccgggcatttgttcatgtacaagttgagaagatacccgctgtctacatcctaaagaggtacacaatgaaagcgaagagcaacgtgccctttgataggcgggatcgagagacaactagaccagatggggttcaagaaagttacaggacaaatatgatgatgattgaagcgtttggagttgctagggcggcgtgcaaattgaaggtagcgtttgacagggctatggctgttctgaagggattgcgtagtcaagtagaggagataccgggtgactctaatggggctgttgacaccaatacgcaagatggcattgctggaggagttcaaaacgccgaaataagcagggagcccccctcccccccccccaaagtcaagaataaaaggaaggacccatgacccggatgaggaagttcaacttggagccaagggcaaaaagttgtgcacacgggaatgtgggtggtgccatctgagggatgggcattacgcaaatacatgcccgacaaacccagcaaatttcgacaaggtgatgaaggctgctaataggggtaagggaaagaggggcaggccacgcggatccggcaggggtagaggacgtggtaccaatgttggatgcaaagttagtactgcagtccctagaacaacaaggagatcaagcaggaagggtccatcactgcgaagatgtttagacgacgagtgagctgaagatgcagctgaatctgctgggtatacagatgacgatcaaacaaatgcagacgatgatttcgggagttatgaaaacggttccgcccgattacagtatagacactccaattttatataacacagtctatatgatacttgtctttttttttcatctatgaatctgtattttaaattcaacagtgactagttccatccttatttaattatatccattctcactatccatcgtcgtatgttcagtttgatcaatgtggttctagaaactaaaattaaaaacccatagcgtctttgcgcacgagcgacaccaaaaccgaagttatttttcaacttacatacttgatcaaatcactcgagttcatccaataagagaacaagttaaattttaactcctttcagattttttcaataccatgttgaacacacactcatatatggactatgtgagttaaagtataactggcgtaccacgactgaccatatgtgatatttctaactcacccactgaatcaactcagccaaaccaacaaacatatcatgactaaacgattcattctttattatcttttaaaaagcggcagacataacaccaacatctaaaaactttaacccttttggactatgggtaatgtattcataaaaacatatggtctatcatatgtaatggtttgtggcaaaaattaaatagacatatcaaaactaatcacgtttatggcgcttgaaccgggttactggtgactgagcatctcttggcggggtctggtcatatcgaaagttgtaaatgtcctcttgtataatatcaaggtcaccgccgtcgtcgatgaaagctgggtgcagaataatcttgttgttggggtcttccggcggatttagatcgtcaacgtcagaagggggggaagggcatagggtagacatgtaccccaagtcctcgcgtagatcatgccatcatcttccatcgatggcgacagcgggtaagggggtggcgacagtggaggagggcttgtcaccccaaactcttcggggagatcactctcatgctcatcctgttgcagcgtggcatcggtggtggggttgtgagtgggatcgacaaaatgtgtctttgtggattcggtctcttgtttatcacccatggttgagttggctgcgtaatacaaatgatgagccgggcagtttatattggggaaactgacaggatggttgattcccacatatcagggcaaacaatctcagcgattttgtagcgattcttgtttgcatgcatgcgcgatatatctggagtaatgtgcgcatggataaacaaccataatgccaccacagcatagcgacgtaaagttattaaataactatatttaaatcatgtcgtgtaaagttattaaataacaatatgtaaatcatgtcgtgtaaaaaaatcctctgatacgtctttcagcatctataggctcattccagttattttttaactttgccaacgtttacttaaattctccccatggccctatagtactcccgaaacaaagacaaatttttaactccttacatgcgacatcgaaaggcaaaacaattatctcaatcagttaaactataacttctcacacacggaacgtcttcatcaccgatcggtctatgcaagttaattttaaactatttgacctcatatgcacaatcaaccaccaccgattttaacataaacatgactctgtcgtacgggtggaccacggtaaaaatttaacttgttatctgcaacatcttaactcatcaccaatatttaaaacagttaaatttttactatcacattcgctctccctttgacatgcgaactgcaggtatcgtttgcgccacaatttccgtcagttaatttttaactctctaataggttggtttggttttggtgggctgacattcctcatttgtgtgtggcgccatttaaaccgtggcgcgaagcgcatgtgagcgccactgtgtatatatatatatatgtgtgtctatatatagacatactataccgcatcctaataactaaaacactccccctcacactagggatgaaaacggagcggatagtttccgtccgctccggacaaaaacggatacggataactttcggatcggataattctcggatagttcggatacagatacgaatacggatattttctcccggatacaaatacgaatatggtaccagggtttccgtcggatacggataataattcggatatccggtgaacagtgctattcggatatccgcaggacccatgagacataccccatttctttttaactctataaccttcaatatacctttatagattttaatagtagtttatctctaacactagtccatactattaatattatttaaattttaaaaaatatttataaattatacctcattttatataaaatgagctaattatatatgttgatatttgttctattagaagttgagttggttttcgtgttccgagaaaaatttatttccgtattcgtgtccgatcatattcgattcttattcgtattcgagataatccgtatttgttttcgtattcgagctatccgtattcgttttcgtatccggtaaaaaaatatgaaaacgaatatggtataaacattatccgtccatatccgctccgttttcatccctacctcacacctcacccccaacccccttcccacccacccaccct

SEQ ID NO: 6346 - DNA, 2340 bp, Oryza sativa
tggtttgttccctcttcacttatgcttagtcccctgctctgccgatggtggtggaggtcctggatagggcggatatgacggaatcgacagcggcggagaggaggccacatcccggcgtccggttcacctcctccatgcggtggctggtgcaatccgagccatcgaggtgggcgacgatgccatcaaaggggtgggaagactggtcgttgccggctccatatccacaccagtgatgcggcggaccagatccaggtgcttcttgcttcttttccccacgaagagagacaaagagggagaagaaagggatgccagtgatgctgcaatgcaacgtctcctctgtgcgcctggcatcaaccccatcgatctgatcatcttctttctcctgttcgtcttcgttttctttccttcttttctctgacacgcccattgattttgcaaagatttcactgtggtgatgcctgctgagtactgttctcataatgcattcagacggttggtggtgctcccctccaaccgagtgaccgtcagcaggagagggcggtggcatcctgcggtggctggagcgacgactggtgctgctccactcccccaagttgagacctattggaggagcaggcggcagcttccggcggtggccaggcgtaggcatttgatcagagattcataatgtacacaacagtgcatcagatctttgttgggatacatacatctgttttgcattccgttttcattgatttgcaggtttcctgatcagagcagtagaacaccacctgcaacatgcacatactctggtgtttctctgcattggctatttttgccaacaagatcatcaacaccccaccctccaggtacaaatatgacccttcacatgctttgatctctctgggtgcctgcggtatgtttttcacatgcatccaaatatgttggtaactaggatttatttttggggatttttttcctcctgaatagagcagagcagctcgactgcctcttgtattgttttcattagtcttctgagaacatttagttgatatgctagcagtttctgaaattttctacctgataagtttctgaaattttgtagtagtagttgatatcttattagcttctgaaatttcgtagttcagcacaacacctagctgataggctaaacagtcctctgaatttttttaagaatacttctttgaatggctgaaagatggatggagaatcttcattgagagagatgtttttcagagctctgaatgtcattttgtccaagtgaagccattttaaaattttcattttggttggctggacagtttgatactctgttggcatcgaagctctgaaatattgtgaaagttgtggggtttggtgaggtcgaaggataacagctttggtgtaatttacaagcgcatacaaaaaacttactaacaactgcattaaggctgcgttctttcaggggagataggggggattgtccctcgttttccgcgcgcacgcttttcaaactactatacgttgcgtttttcgcaaaaattttctataggaaagttgctttaaaaaatcatattaatccattttttaagtttaaaatagttaatactcaattaatcatgtgctaatggctcacctcgttttgcatatcttcccaatcttctctatttccttctcctcaaacacagcctaagttcacaggtatattaacatattgtgtgcatggaaccatccactgaaaatatagtgccagatattgctgggaagcagtgcaaccagtccatagattagctgcacttgctgatcaggattatgaagcctaaccctgctgcttgcaagaatgatttcaagtggaatctctttatccagtttagaaatcagaattgaagaggtgcttaaattcatgctggagatgacaaatgcgtaatttttctatccatcaacacggcttgcccctctgctcgccgctggggaagattgatgcaccgacgaagtggcctctgccgactgctccctcaacaccagatccaacacgtaccaagcagtcacgccgacacattgtggatttagcttcatgtttccttctcttttttttttttgcctgtggatgtgtaattttttttacccatacagtgacatgttgatcatttactcctaatttggtgaaaatgttgatcgtttactcctaatttggtttctcctgagtgatccagtgaaaaatatacctgactaaaagtaaaagtattacttcacgtgaaaaatacacttgagtaaaagtattactacgttatgtggcagtatggttaaaatgtaaattttgtgccatttgagtttagtcgaagagtaaatctattactacat

SEQ ID NO: 6347 - DNA, 611 bp, Oryza sativa
cacccgtacgacctctagcgcagccaaccaacatcccgcccaacctcgccagcgaccaatatcgccggtcagttgcaaccaatgcctttgctgtactaacacgattgaataaagcattgacgatctgaattgaccacccctctgcctgattccatcgcttgtcgtatgtacgccttctctatagcatgtccatcacgcaattacctcatcaacaccttcaaaagctgcctctaggaaccacccgctccgacttccgattaaacaccatcaatctagtcgcgagccgaagccgacaagttgcatgccgtcttctcagccgcgaacgacccgagtgctatgtttagccgtctccctgtcgaacgcaactcatcgaaaggcccaggccaccccgcccagagtgatcgatccacccaccgagaacgccgatcgcctccagcttcaatcaacccgagcgtgcggccgcacgtctccctattgagagtagctcaccggaaagtccgagccacccgctcgaagtgtccgacccaccaattggatcaccaatcgcttctgccgccatcaaccagagcaccacgtctagtcatctccctgttgaaagcagccatcgaacg

SEQ ID NO: 6348 - DNA, 12774 bp, Oryza sativa
  unsure (1)..(12774): unsure at all n locations
tcctgcaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatacatgctcatcatcaaactcccaccattgaccattgctttcgtcctttacatgtgctacatagtgcccactattggcagcactacccttgtggatcaaaatagcagacaggccatacgtataactagatgaaggattggataaccgcttccccatatctagctgtcctgggaaactgaatgccgaagaaatctttttctttgttgttgtctgtggacgaaacgagttagacaaatttcttgctcaaatacacaatcaaacgaacaaacaaacagaaggaatataaagcaagctacacctttgggaggaatacatagcgtttcagctgaaaattaacaacaggaggaagtgagcgaagttttatgcaacgagtggcatctacccttttctgacatgactcacagaagtactggttctctccatccagtgcctcagtactcaaatagtcatccaaactttgttctagattatttaaacctttaatgttaagctccagttcgtaaaagtcttccatctttgaagatgcttcggaatcccttccacatgatgagcacctaaagcataggatgaataaacttcagctctacgcaaaattaaatgtactatgaactaagtatatcattccctttaacatctgcaggctatgtgaatgtgaacataataagtgcatgggaagcaaagatcttgctaccggaaagcacaaatctacttgatcttttcaatcaatataagaacacaacatcagtcttatcaatcaatacactgcacacatgtttttaagtagtaaaacaatataactatctggcataactagattcatgcagctaagaattttttagaacttctacacaacaaaaaacactaacaaaaaaaaagatatgtttgaaaagatgatagtacaaaccaacaagcataataaccttggaaaaaaaggaacttctacaaactagaaagcttatttccctttcctttccaaagcctaacataagaccattctaggaataagactcaaagatcgcatgagaagcatatagcatttaccctaccgagtaacatgggacacacttccacggaacaaatgctgcacaatggttctagcccctggaaccttggaatgacttagtgaaccctcgagcaaagacaaaaataatgtgaggaattcatggctgtcctgctggacaccattatctaattccaaggtttttataaaaggtgccgaatcaatgaaagccattttgctggagtgtagctgagcgaataaccgagcaagctgatccagcacagggtgcatcttcaagatgtcgggctctagagagaaaatgcccaagcggaaggaggtgttcatgtaaaggcactgcagtatgctgtttgcataacaggtagcgcccaggttagtcaatccagcaggcgtctcagtggagtcacgaagatccgtcgacgggttaggaccaagggcgcgaatgatctcgtttgttctctgccacaggccagatttcctcaccccattagcagcagggatcaacccgcagaaacaattgggtgagtccttggagttcccatggcaaccatgacaaacaggtttccacaccatataaagttgtttaatatcgccttttgtgattgctccagtggaatgtatcttcctgcatagcagacaccaattttttttcaaaaaaaaaaatcatcagcaagcaaaggcagcggcacctcaagactagcatatcaaatctccacagctttggccaaggcgacaaggcaatgcagacatacttgaaaacagcagacgggctctcgcagtcatcagcccgcggcctcttgctcttatttcgtgtgtttggcctgctcattgtaccatcaaaatcaactcaccaacgccaaaccaaaaccgccgccgccgctccccttccctgtagatggaaacaagcggaggctacagcattagcacatcagcgcgcagggaaccaaatccaacacctactccgatactccgaaacatgcaggaactacgcggaatctcgcggtcatactgatgattcgatcgctgaaacccgccgccagtgggggttagggattacctggaacagatgctcagtactccggggtggatccccccagtggcgcgagggggagaaggtcgccgcctggagcagccggagcggagatcggcggcgggggcggggaggaagcggcggtcgcgggggtcgccgtcggtcggggccggagggagcgaggccgaggcggagaggaaaggacggtggtctcctcctgccgcgcgcggttcggtgcggtgcggtgcggtgcgacgggtgcggtgagctcgggttcgggctcgagctcgcaacgaagtttaaacgaaacgggaaattttggatggataggcacggaaggggtagtaatttaaagcgtcattaatgcttggagattttttttcctttttattttgtttggccttttcctctaagaaaataaatgatggaagatttttttgggtcgactcgtagccatacgttgcgatgtcaaagctagaaggcccaatctcttcgctaatcgccgtgtgaatctagaagattttgttgttatcttccggaatcaaagctcaagatacgaaattcggataacaaaactggatctctctagtgcccgtaatgtgatcgatctgcatcaatagcgaatctgcgaatgggcctacatttgtaattggaagtagtggtagtatggcccatcaaattttgcagtccgggagttgtgttatggttgggctgaattgatgctgtatatcggcaagcctgagatagcccgttcgcactttgcacgatgggtcaggccagaagcatgggcccagagtaggagcggcggatggagcaggtgttgggccaggaggcaatccgctgagccgggacgtgaagatacgtgagctcaactccaacaagggcaaaatgagcagaataggtatatttactgatcaaggaacggctgcaaaaggaatggggaaatggaaaagaaattatctcagaccaaaactaaaagttgtatatcaacctgacaagcatattagaacgtagaattaaataatggcctatcgtaaaactcggaatgaaatgtttagcacgatagcaattaaagaatgtggtgcggcattccattctacttatgtaattaaagaatgtttagttccaaactttatttttaaactttcaactttttcatcacatcaaaatttttctacacacataaacttttaacttttccgtcacatcattccaattttaactaaatttttaattttagtgtgcactaaacacaccttaggtggccaatggcagtaaaaccagaattcaccgaacaaactagctacatccaaaaagaactcgccagaacgtgcccgcgcgcgcggcaatcatagcttggatgcaaaggaacttttcgtcactcacaggcatccaccaaccaccgacctctctaccctgacggcctgaccgtgacgtcgcaaaatcaattaacacgtgaattcgaaagcaggacgcttgctagggctaggggtgggttacttcattagcacagtgacgactgacggctcagtttgtttgaaagattagcccagtattaattataagagctaatgtttagttataaatcagtaggctaaacattagtttagggttgtatgtttagatccatgggctaattcaaggctaaaagttgaagagagagtaaaaagagatgagagagagagagagctgctttttgatactccccacacaaaattagccccattagcactttttggaggggctaatgttttaaggggggctaattcactttagcctcaaattagcccatctatttaaatccttgagggctaactgagagttaaaaggtggaggctaataattagcctatagaaccaaatagggccgagcttgcaaccagcggcttagctagcggttgagatttactggagacaccagaaagggagtgcgaatgtgcgatcgggaatcgtcgcgatcgcgcatatgaatgtgcaagaatctttcaggtcgacgtcgcccatattttacagcagcgttgggtttgcactgtagcagctgccacagagaaccgaatagtgcctcttctcgagttctccgttcttttgacttgattggcttgccttggcgaatgatcggccatttatatcaaaaaggaaaaaggaaaaaaaaagttccctctcctagtctccagagaaacaaccgctattttaaaattgtaataataccattataattttacaaaatttgatatatgtcatcctgataccgatgactcatatgggtcctacatattacttagataccgatgtcatatctcaaactttgaaaaattataatggtatggttccaaattacccttaaaaaaactgatccccatatatatgctgaacactgcattttcctttcaaatttacgtacttcacgtacgtaaattcgtaagaacatttttcctgcctctaattcacagcgtcaagtagctgtttcactcaatttttctggaccttctctggcgttggagatcatgcggcgatatactacagtacacgcctgaacggccgaacgcgacacgtacaggaacgtggcgagcgtcccgtgtagcagtactaaccaaaaaagcttttacatgcaaggacaagggctattacatgcaaggacaggtccattttacaagcaaggacacggctactccatttcgctacatgcaaggacaaaccccttcccacgtgggcccacgtcccccgccacgcggctcccctcgggatcacgcaacccggtgacagaggcactgcccgccaccacatggtgcgcgttgcctatgggccagccaccgcttgtgtcatcctgtgggttttgtggctcgcagctgcgcggcaccccacccccgcagcggtgcgtggaccgcgtccagggagcgggggagtagagtagacgagacgtgagccgcttcggttccctccaggaggttccgccacggtcgagacgcggtgggccccggcgcggtccacgtgacggcgccagcgggcctccacgcagccaaaagcgccacttggcgattctcggccgcacagcccacgacgggtggctgttttgcggtttgccccctcagatttctgtgtgtttttttttgctttcgagaaattaattaatgtggatgatgttttttttttgggacgtatatggaagagcagtataccgtatactccctccatccaaaaaaagacaaactctatttttccgtgtccaacgtttgaccgttcgtcttatttaaaaaaattatgaaaaaaattaaaaagataagtcacgcataaagtactaatcatattttatcatctaacaacaatgaaaatactaattataaaaaaattgcatataaaatagacactcaaatgttggatatggaaacctagggtttgtcttttgttttttttaacgaagggggagggagtacgttccttgatacatggcacgtcgacgttgcctttcccatgtaggagtagtactatgtactacatcagcacgtactagtgtacttcatcgtctacacggtgtgaagaaagtaccgcgatgtacttcgttcgagtcaccgtagagtgaaaattagcgaagtttagtcctatacttcggctttgatcgtttgtgcagcttgcgggccgcagctgcgagcataaacgatcagccttttcgttggacgaaaagcaaattttcaaataccagaaaataggtacgattggagaacaggaatacgtacccgagtaagctactagaatatatgcactcattttatgcgtgatcatatatggttaattactactatatcaatgcaaggttaaattcaatacacacatgaaaataaataacaaatataatgcaaatgtgatcgtacttttcgtaatttgctttgttagttttcttctctcttcatgcacagattaaatttaaccttacattgatatagtagtaatatataacatcacttgtatggtgtttaacttttcataattgcttgagccatttgctagaaacgaggataatttagagttaaataattttcctactaacaccttgaggatgcttaagattatgataaacacctcctgatcgagtaggcaactggtgagaccgaaaaaaataaagctgatttttttattattatttttagagaagggtatattacccggcctctagattcaaccttatggtactacttatgtcactgtaaccactggggtacatgcccttttgttaaagttgaaatttagacctttgacctctgattcattttctagatattctcatctatagccaccaattcttaaaaggacgtgactacacagctagtgataactggtttgtctaaactagctaccactccatatatgagagacactatccacctatactttaaatacaattttctcttaaactactcatccgatctacgatccgattacaccgttgtgttcgtaacaattaaatatttataacaagatcccacatgattatattttgatgaaaaattataaattgcttttataatatatctaaattacttttagatttcactaaattacttcttagacatatgaaagtaaattcaataaagcctaaaagtaatttacatatattatagaaataacttataacaaaaagaaagtaactttagtgaatgcctttttcattggacgtgactacacagctaaaaaaaaaggaaaaaacaatcgatgattaaatagatttatagagagttacttttgaacaatgcaaaagttactaccaattaacattgaagttacttttcaaaattgttaaacttacatgtgttgatccgtgctgattaaattttatttctagataaatttatattgttattcctacaacgaatttacttataatgtattgacaaagttacttccgttttgttttaagtgttaaattagttttagactatattgaatttacttttatatgtctaagaagtaatttagtcaaatctaaaagtaacttatatatattataaaagtaacgttcatatgtaataaaagtaatttacaaatataaatattttttcatcgtaatataatcgtgtaagatcttgttgtgaagattcaattataacgaacacaatggtgtaatcggattatagattatcacatagattctaagtatcagtaatcatataatccaaaaaaataaattgaaagctagaagctgaaaccgtattctgaaaaactatctaccaacaacagattctcataatcttatgctcctttaaacaaggccctattttgttgtagaacataattgttccctaggtaataactaatccaagaattcacccttcatccagaacacatagtaaccaataatgcctctaatgcaaaaacggtacaaccgatttatatttatttgtatataataatgtccttcacttagagagttaggttctgtttagtttccaaaacaaaaatttttatgttatcacatcgaatgtttggacacatgcatggagcattaaatgtagagaaaaaacaattacatgaattgcgtgtaaattgcgagataaatcttttaagtctaattgcgtcatgatttgacaatgtggtgctacagtaaacatttactaatgacggattaattaggtttaataaattcgtatcgcaatttcctggcggaatctgtaatttattttgttattagattgtggttaatacttcaaatgtgtatccgtatatccgatgtgacaaccaaacccaaaattattctccaactaaacaaggcctagaggtctcttccaaaatagaattgaaggctagactaggaattaatctcttacttatatatcgtaatccatttatcgtttcaatttccgttaccattatccaaaatatacatatttatttgtctagctatcgctattacatattaaaagaatcatagttatttccattaccattatcggaaaaaacattcatatttatctatttaattagttgttgctcctatatgtattaaaaaaaccattaattatttatatagtaatccctctacaatttttcgtggtgatggaaacatgatcaccctgtttgtatttttatcagcagtgatttatcatcagactctctttcacccttaggtttgctgaatttcagtggaaaatttgaactccaaacctctcctgtttaagctcccattggttgcccatttggccaaaatagcttatttggcttattagaaaattaaaattaatttgtaagtaaaacttttatagaactattcgtagcgacttaaaagccaacattaacaaaaaaaaattacgttaaaaatatttcaaaatcaaatttaaaaattcaaattttgacttattctttggctgtttaggccaaacaatatagctataacattgcgacgcacgggacgtatcagtactggtatcaaacaagcttttctaattttgtaactgatcttttactatagtagtttccagcgatcaaatgcaaatagccctcgaaaagaaagcagagacaaaacataataatcactcagaaaacccatccggagaggacgaacttgcaaacacagaactgtatgcctacccacgtactcctacggtcctacctactaccgtcaacttgagattttctccctgagaaaaactgattttaccgattccccccacgcacaacgcacgaaccttctcagctctcaccggtggatagatagatgatactcctcgcctcgccgcttgcctcccccattgcgctcccaccggcggccggagtcgtctcccaatccgacccaaggtggggaccaccctcctgctcggtgggcccgagcagcccggccaagtggccgccgaaacccgctataaatcccccacgctccaccagcctccgattccacagcctacctagcttctccttctcgctcgcttcgcccgcataagtctagccacaaacccgccgccgccgccgccgccgccgccgctagcttccgcggagcggggcgagatgttcatcgagagcttccgcgtggagagcccgcacgtgcggtacggcgcggcggagatcgagtcggactaccagtacgacacgacggagctggtgcacgagagccacgacggcgcctcccgctggatcgtccgccccaagtccgtccgctacaacttccggaccaccaccaccgtccccaagctcgggtacgcacccattaccctcgccgatcgatcgatctgtccaccgatcgctttcgatccggcgtccgtcctgttctcgttttcgttttcgtctcccgtttggtctccgtgtttttcctagctatagctagcgcccgatccagcgagatgtgggatggcaaaaggccaaagagggggactgcgagtctgcggcgccttttgttgccttgctgctcggccaccgtggaaatttgcctgtctctgggattcgatcccgtctgctcaaaacgacatttcttctgagttttttttatatccgctagtttttattattatggctttatcccatggctgcacctgcactgcatgtgaggtttccattaaaattttgcatctgcaagatcgagcagggggacctacctagtaccatatataccactggcaagaactcccaaatttatgactgtttattagcttcttttattagttcaccccatttgttttgtttttttttctgtccatgttggctacgtgccagcacacttgtcgatcatgtttcttgacccagttttatggctgtgggtgcagggtgatgctcgtggggtggggcggcaacaacggctcaacgctgacggctggggtcatcgccaacagggagtaagtgatcactcacgctctacttttctgcctaagctagcttcatctgttttttcttttctgaatttaactgatgatggtgtgagtttaatcaggggaatctcatgggcgaccaaggacaaggtgcagcaagccaactactatggctcactcacccaggcgtccaccatcagggtcgggagctacaacggggaggagatctacgcgcccttcaagagcctcctgcccatggtaatctgtcctgttttctttgacatgctaaccacggaaaagatggtagtagtaatacactgctaatgtgatagtagtagtgctagtacaatcataacatggccttggcctgttttaaaggccaaggttctaaatgaaaagaagaaactttgacttgtggtcatgtcctaaaaaagaaaaagataagtcctgtcacaaaagggtatcaaaagataagtcctgtcataaaagggtgtcaaaaggtgaccatcgtgtgtcacctttgtcatgttgtgatgatgcaagtcaaaatgttgtggtacaaccacaaggttccagcatctttggacaatgattgatctgttgaatacatccacaaatagttttcagatttgcagaacctgtttttccgttttctgatggttatgaaaaaaattcaggtgaaccctgatgaccttgtgttcgggggctgggacattagcaacatgaacctggctgatgctatgaccagggcaaaggtacttgacattgatctgcagaagcagctcagaccttacatggagtccatggtgcctctccccggcatctatgaccccgacttcatcgccgccaaccagggatcccgcgcgaacaatgtcatcaagggcaccaagaaggagcagatggagcagatcatcaaggacatcaggtatactggcatgcatggaattgagcccattttacttcataacaaaaaggaatagtattctgaattagttatgtctacgaggcatgaacactaggggcagaaataacggaataccttcaggcaccagcttataacagaaaatagtattcacatgatatggtgtcaaagcactaaatatatattggcactttcatatatcaaaagggctccccgaagagttatactactgaagtgaacttgtttcgtaagattagttccagtctgcattaagatggttggaacaacatgacaaacttgtgactatgaatgctgtaaacattagacatgatattttttttattacttaaatagggagttcaaggaaaagagcaaagtggacaaggtggtggtgttgtggactgcaaacactgaaaggtacagcaatgtctgtgttgggctcaatgacacaatggagaacctcctggcgtctgtggacaagaacgaggcggagatatcaccatcgacactgtatgccattgcctgcgtcatggagggtataccgttcattaacgggagtcctcagaacacctttgtgcctggtatgtaattttctgtgtagagtagtatgcggtttattttctcaggttcatggcttatttgtttactgtgtacagggctgatcgatcttgctattaagaacaactgcctgattggtggtgatgatttcaagagtggacagacaaagatgaagtctgtcttggttgatttcctagttggtgctggaataaaggtaccaaccatatatcaaatcctttggctagcttttcgcattgaaacgtcgatattcttccggaaacttttttttatatataacctgataagaactttggcttttgttttcgtagcccacctcaattgtcagctacaaccacttggggaataatgatggcatgaacctttccgcacctcaaacattccgatccaaggagatctccaagagcaatgtggtcgatgacatggtctcaagcaatgccatcctctatgagcttggcgagcatcctgatcatgttgttgtgatcaaggtttgcaatttgtccatggattcttctgcagcagtatgccattaaaaaaaaacttagttttggattaaaacttgtccatgtattcttctgcagtatgtgccgtatgttggagacagcaagagggcaatggacgagtacacctcagagatcttcatggggggtaagagcaccatcgttctgcacaacacctgtgaggactcactccttgccgcgccgatcattcttgatctggtgctccttgccgagctcagcaccaggattcagctgaaagccgagggggaggtaagagttctgatggactgagatcaattgactctctgctgctctgcaattgccaccctttttgccagcaaaattgactatgttgttgtttcacttgttatcctgtgcaggagaagttccattccttccatccagtggctaccatcctgagctacctcaccaaggcaccccttgtgagtgcatacatgcatctgtactgcccattaaccgttatgttctttcatgatataccaactgatttacttatgtcacgaaaaattcgtctcctggaacaagttcctccctgcacaccaatggtgaac

SEQ ID NO: 6349 - DNA, 40650 bp, Oryza sativa
ctgagcgttttattattttctcgccttgtaacataaccaattcccccttctctgttgtgtgctaaactgctaatccgcgaggcaaacaatgcaggaaactaggcatagcatcttgttgtgattttgtaaacaagatggtttatgcagaactgcactatatgcttcgttgctcgcgttattagccaactattatgcaacgaagaggagtagaggatggtgtgatcaaaactgaaaaccgcgggcagatggcgaaatttataggtgatgcccttaccgcatcaaactagattttctatcatacacctatatgagtatactcctatatcatcctcgtaagagcatctccaacagtctctccatcctactctccaagtcaaattttagccattctagcctaaaaacgtgctctaacagcctcttcaactggccaaaaccccctatccactagtcaaatttggccagccagaaatcactggccaaccatgggtcccacacagattcctcctcccctctccttcagctcggatgatgcaggcagccaagacctcgccaccgccgcgagcatcggcttccgtgcaccaggatggtacggcggagctcctcggcgcgggcgctaggccgccgccggcggcaaggagggggccgtggcggggttgttggggagccggcggcggagagcacgacggcgagcatcttgaacccacgctggagcgccaccatcgttgtcgaggtcgctagccgctgtcgccgtcgtctgcaccgtcgccagtcgtcctcgaggttgccgttgccgtcgtctggatccggcggcgaccgacctccgttgcctttgtccccaccggcgcgacgtggattcacgcggcctccgccgtcttgccgtcgccgccttgccattcgccgccgccaccatccccatccactgcggtagccgtcgtcgtttccatttgccagtgttgaggaagaggagagggagaaaatctagaggaagaggggaagaaagaggaaggagggataatagagactgacatatggatcccaatgtcataggctcagaatagagagtttagatggagaggttgttatagtcaacaatgagtttgaccgaccaaatcaattggttaactggctatatgggtatttagagagtctattttaattagtctgaagatgctctaacaaaattagaattttccaaacagacagacagcaaggcgaatcacatgagttccgcgagttcgtgcgtaacgtgtagagcgcgccttgacatctgtgttttcccctctgacgttcgtgcagataatcccgtgacgtgcggagcggagtatggcgtagcatctcggtgtgctccgcgcgctgcagccgtttcctccccgtcggatccgcccgcgccgtcgccgatgccgctgcctcctgcgcccggttgcctctgcggtttcccttctcttcagccctcgccacggtacgagacgtgacgtgcggagtagtacgtttacacgggcgtccgatcggtttattagacggatggtcttgcgagttgcgaccgttttgggcggtttgggccgtcgtgtctcgcggtggcccaagtcggcctgcgtaggtttcccattttgcatttcttttcttttctcggcgtggtgaaaaatctgatgttagttctgattttgcctgtcgttgtgcttgtgcagctccgtgctccgacgtacaacgcgcagcctccggaacctggtactactgcagttgacgcgcattgccttgctgaaaagaaagtggccctcagagagaatctggctggttaatgttgtgcagctccagtgctcccattatcgccaactcctgcgccggccacaccgccgtccccactgggatctcgatcgcctgtttcagcgccaaatagcaggactactttagagtttctttttagagaatggtattttttacccagcctatacatccaaccaagccctcaagcaacttaatctgaaattcgcttttatagagatatggactcaggaccataaaatactactcaggtcactgcaaccattaggttacatgcactttcgcaagctttattgcagagtatatatctagtgtacatgtatgactgccctttgctctctctctctcaatagggagaacaaaggcgtttcacgggcgcatttgtttctcatgtatagtattttcagcatcaatatagaagtgcatctcgcaacgcttactgcgtgatctgttggcgaatgtctgaatctgaatgtgatgtaagcgattcgacgaggcagcgtaagcagccactccactccagccgcgtttggcgtgcaccgcatttgggtcccgggcatggcttgaaaaggtctttggattccacttctcgtgccaatgtgcgcgcacggcttttttttttttctctcatgcaaaaaaaaaaaagctttccaaaagaccacacgatgtgtcaccaaacgtcagccctgtcacgatggattagacgagcatatactcgtttaatgtagctatagaactaacactgcccgtttgcagaaaaatagaaagagaggaaccatccaattgccagttaatataagaaaaaatctatacgtgttaaattttgttttattaaattcttattttgttttattaaattcttgctaacactacgtgtcatgctgtgagtatatttagtttttctataactacctgcacaattaaccatgcccgttttgttctgcagaaaaataaaaaaaaagttttgtgctgcagggaaaaaaaacagaggaaccatcaaactgggtttcagggctgcaggagaaaaaaaaacaatgtgaaagagaggagaaggtcagtcaatcagtggccgatcccaatcgaaagctttttgaaaagatgggctaaaatcaacccacatccacattccacaaagctagcgccgcggcctcatcattccaggcgcaccgccgctgccaccgcacgcacgcccgccacttcgctgtagtttatacgctcgccgtccccggctcatccccaatgcatgcatccatctgccaaagattttccaatcaatacattgccaatttgccatgccccgcgcgcgcgcgcgcgcgtgcgatcctccactagctacgcaccgtggcaaggcgccattttcatagacttcgctagggtgtgcgtgactttgtcagtgaggtcgccgcagtgtaaacgccaaccaaactcccactagcagagtagcagtccatcagcacataaacccttccattccaaccccaattagcactagatcgtcatcgctatcggctgcagcaaagaatggcaggagctgggaggactaggagcacggccatggcggcgtggtcgtactcgtcgctgctgctgcagctgctgcttctctcgatggtcgccgtactagacggcgcggcgacgaccggcggcggcggtgccggggcgccggcgccggcggcggactgcacggacgcgctgctgagcctggcgggttgcctgagctacgtgcaggaggggagcacggtggcgaagcccgacgcgccgtgctgctcggggctcaagggcgtggtaaaaaaggaggtggcctgcctctgccaggcgttccagggcagccagaacttcggcgtcacgctcaacatgaccaaggcgctccagctgcccgccgcgtgcaaggtcaagacgccgccgttcagcaagtgccaccgtgagtaaattaatttctgctcacaatttgatcttcttcttatcttcggggggaaaaaaaagaaaagaaaactgagtctccgtttcttcttgtttgtttatctgatgatgtggttcgtgcgctcttgcagtttctattccgggcgtgactggtggtgctcctggtaagttattgattgctcaattacaaagtcattattttttttcctgattacataaaagatactccctccgtttcaaaatatttgacaccgttgacttttagcacatgtttgaccattcgtcttattcaaaaacttttgtgaaatatgtaaaattatatgcctacataaaaatatatttaacaatgaattaaatgataggaaaataattaataattacttaaattttttaaataagacgaacggtcaaacctatgctaaaaagtcaacgacgtcaaacatttcgaaatggagggagtacatgcacacacatcgttacacacgcgcactgcacgtacctgtctagcctgcaaatgcataacgcgtgttcaagaggatttagatttttgaataaaattggcatgggttttgatgtgttgggaaaaaaaaggtagagcgataaattgcttctgcatgttataaataattgtttttacagagtataattattctgaaaagtaacattacaaaatatgcttttaaataactctttcaaaaaaaggaaatattacacatgcttaaaaaatatttacaaacaaagcttttaaccgtttgatttaactgtaaaataattacagaaaatctcaattaactcacagtttgtaaagctttgtacctatagccttttcaattcaaaaagaaagaaataccttctgaaaacagtcaaacaccgacaaaatggatcagttaacttggcgtccttccattccattaattccagctcccgctccattctccggggctccgttcttcggggggtcgtcgccttcggcatcgcctgctgggacaggaagcgactccgccgccgccaccgtaagagctccggccccatcgccgtcggctgctgtccggcccaaggagacaaaggcggccttgttctctgccgctgtaatcgccgccgctactctgctcgcgcaccgtgcctagttaggctttggcctgcacgggtccatccaacgagcgtgtcgttgcagttgttgacttgtgtgtttgcatatgtaccgagatgtatcttgtgagagtttttccctccatattactacacacttaaaccagcattttttacgttcatgacaaaggttctcacagatcatcaatcttttttagttgcattctcagttttacgacgtgatgcgtaagatcgataaggcctagaacgatcaaagtaaactagtaattgttgttgttttagtgaactagtgatgctggcctaagccctaaagcactagtttgggcccacctccttttgttctctcaaattgattgagcccatccatagtttgggtgtgtcagtttgctttatttcggaggccaagatttatatggaccttacccaagccagtgtcatctccctcccaacaccctgtatgaaaccaaacaaaactagcccgtagtcacacaaacacagctgcttcactcgagacagagaagcgcaatcgcaacttacttagtagctgcgatcatggccacgaggaacatacagcttatcatatgtacacgtgaggttgggggtacctcacatggaatgctcatggacattcgccagcaaacgcagctctggcaaaatctaggagctgcattcacttaagccaaaaagaggcttatagtttaaacttcagatttccgaacaacggatacaacaactgttacatcatccagcttgcccccagagtaacccagatacccaactgcaagagccgcgtcagagaaggggcttctacaggttgccgatctgcccacttccttcgccctagcaaccaggaactccgcaatctcctgtgattttatgcaaaatgatcatgtaaggacacttcacggacagttctatatgagatgggtgagtcttctctagtattttcagaagaaaagtgttaggatctaaccgaaggcttgaggccggcttccaatgatttggagatgacagctgctatttcttcctcatagacattgtcaaaaaggccatctgttgctgtcacaatggcatctccttcttgtagatcaattgtgtatttctgccagcaaagagggacaaaataagttttaagttcatatgaactttatacgaggaaccaatgatagcagggcaaggatgacagggtaagtgctgtggcacctgtacaagtttgaaaggatcatcccccttctcaatttgcaagggaaaattgaagccgtaagtcattggctttgatttttgatatatttctccgtttcttatcaccaagaatccagaatcacctatattacatgcatgaagtacctgtgaaaccaatgagttcacaattaatcaccattcgccaacagtgaaagaaaagagaaatgggcatccaagacatctacgaacatacttgaccatcaaagtgagcaaccaaaacagtggaagaaccaggggatcgtgcttcatctgcagccttagcaagaacttcctcagttctcatctctggagctccttgactctccataacagcttcttacaaccatccattaattctctggcatacagccctgcattgattcctgaggacggaagtcaaatcaacaaatgtaagtggccatattccaaaggatagcaagaatggtgagaaatggaatccacacttaatgtgaaattaggtgaagatagaaatattatccataattctcttcaaatcctccaatagtacatactaacaaactggcttacagactggagcaccctatatactatgtgatatacgagctgtactagagcagaaaataatattttgctgtacacaatgattctttagcagtgccttgtgcccccctgaaattcagttcagtgcctcatttacttagattccatagtttctcagtctcccctacataattttcctattcccctttctgctcgagggtaagttttatgacatttgggactaataactggactatggcatattttagcaacatgatttagtcctatttccatgtgtattacctattattccacaattttgtttggttttacatgttaagatgttgttcatttacactcaattgagctagcaacagatagagtgacaatttaaaaatcacaacaaagcaaataccataataaaatgatgaataaaaatgatgtagagtgcgatattgaaaactatagtagttctatttatcatttgtctttgccttaaacatcagaaaagaaaaaaaaacaaaaggaatgcagccatcattttttaggttgatagtcactgtcagtctctattaaatgtgatctcgcttcccactttacctggaattcttataacttgtctgaattttggagccttacagtagtaatcgaaaataggcacgtcctttatagttatgccactatgaacctaatctcaacatttcgcaatttctaagtctaatttggtgtgcaaatattctgcatcccatggagattaattatgccattagtattggtcaccaaaaaaactcaggagttcaacacatctgcaacgacgaggttacacaacaaatagtagttgagaaagaagaattggtttaccttcaaatgaccattgacctactccatctgctacaccaaaccaaccgtcacaagctataaaataagcatcttcaccacctgtcagcacctggaatattatgcagataacattgtcaaaatgactgaagaaaaatgcgaggttatctcgatggtaatacaacttaacatattcaacaaatcaaatacacgtggacggttacttcaggtataaaaccagatatcaaaaagttgcacaaagaattcaaccgatcaaaatacatgggatacttgggctaaatgttgatgaattatattagtttcaacacttgtttggatagaggctatacctttgtactttcacgtaaaggggtttcggacaagcagatagaacgctataattgtgtgtttgcttcaaaagcttatgttgatgtttctatctttacttctaaggtttaaggaatatgaaaactatagatcacatatagactgggaaaggagcaagaaataaaccagaagcgagataatagtgtttattattcttgtaaaatatttggaaatagcgtggagtggaatgaactttatcagcatgaaagtaaagcttatttcatctctatacaaaaaatacacaaacccattcaagtgaaaaatcaagatagtggtaccatcattctgaagtgcattttttatttgaaggacatagtaaatatattttacagacaagggtcagagaaaaaccataatacctttgaaggatgaggtagcattgctgcacctgaagccaatataagtgttggtagggttactgaagacatcctacataagaattaagcataaaaaatgaatatgcgatctctttgaatctctgcaggttcaaaaggaaaatgataaaaccatgtggaacatccaactttaaaagcaaacaaattacaccagaggcttcagttcaataactttatattcattcaaaaggatcaagctgagtcaaaaccttaaactctaaaatgctaaaagcaatagagctaagtagtacctgtcagagctcttcacctctgaactcttgtttcccctggccacttcacagatcgcttgttcctacaaaggggaagaacaaacatctgagcagaagaaaataacattaccatggtatattcttattcatatgacagcaaaagctccccgaaagttactgcagcctgcggcctataaatttctatgaacagggtcacttccaaattgtgcattgatatcacacaaaatctgagtctcttgagttagttgaacaaacacgcctttcagaaaaagtgatatatgaccgtatcatgaaaggataaccaaataactaacaaggtactgaatactgatatgaagtgtgaaaataaatgtagagcactcaataaaagcatataattgcaagaaaaaaatgactcactaggatgaggtatctaattttcagacgctgtatctttgtattaaaactaaactgattcatataaactgcaaacctgagttacaaacatacagcatcaacttactgatattaagcatagccacgttcacaactatctaggtcatgagtttgcagaaaaagaaataccgtgtgtgggatgtgcactccgtatcccatgtcttgttcttctatacttgaaccgctcgactccgtctccacgtcagtatcaaaatcctgcgtggttgagccgtctgaagcctcagagtcatccaaactcgtctccatcctgtccacaccttcctcaacctgcgtgatggagccaacagacgccacacacggctccagggctgtttccatcccgtccacaccttcttcagacaagacgccagtcacctttgagctcttctcggcgccgcctccatcaacgctcgacaccaattccccttcaccaaggccatttcgaccgtccgcatccgagccacgctccgactcgacaccgacctcagaacttgcatccctattagatgaccctacaacaacaccgggcataacctcttgttcacatcctcgggtatcactggtctctggcagggactccaacatgagaggggagccaccaatagccccagcagtatccaaatttgaactagcctctgacggcgacacctcaacgggtgaaatctcattgattgcaccagcttcatcggaacctgaagtaccacgatgcaacagctgctgctcatggattccgactgccggagaacctaatctcacatccagggcaccctgctcagccaatttgagctcagcgccatcctcagagcacaaaacccccggtccttccggcgcctctccactcaccacgacagcgccggcgtcctcaaaacacggacatccaggcacctgctcgataccctctgcatccaaaccaacaccaaaccaaaccaacaccaaatcaaatcgagaaccaaaaccgaaggagattaagcaagcatgaatgccccttacccacacctgtaggggagcagaggcagagctcggcggcagcgccacaggaagcagccggcgcgcggggcggcgctggggagcatccggcggcgcgcgcctcttcatccatggctaagctagagcctgagtcgaggggatcgagggctttggatcagcacccagcgagagagcgagcgagcgagctagggatcgcgagatggaggtgggggaggacgggaggagaggttaatgggggaggggaggaggcttgtgtgggaggttttgaggtgttggggggcagcgccgcgggcttccgcggctcggcggcggcgacgttttctctcgccctggcggtgcgcggtggggtgggggttttccgcgcggttttttttttatggaatttttttttccgtgtccgctttggtctttgtcggttttaggacaaagggcctcccagaagtttgtatttggcgggtaggagtcagtctctttttactctctttggccgccccacgtgtaaaccggcgtgaccgttggtggcttcccggttgtttatttgttggttcattattttttacgacttgggctgttaattaaatgatcgtactacaattaaagcaaaagatatacttcctccataaaaaaagaatatgtccaaatttattgtactacactatgtcatatcttgatacgatgttggttttttctgggacggaatgagcattcctttcatctaacttcatttctatcatatgccattgttcataaataagttaacatgcttttttaatatgagaaaaggggaaggtcttgccagacctttctgtttcataaaagatttctcttagtctatctcagtccataaattgacaaattttattcttccatatctcttacatatccaaccattcaccaatactacatctccattaataagatgtacttttttgtctttttgtttcattttaatttagtgctcctatgattaaaagttattttagacagaagaagtaattaactgatacagtgatcgatatagtatgtttaaatattcaaaagttagcaatgagttattttttcaagttagtaaatagaaaaaaaaataaatgaattggctcgtagttgttgtgaggaaaagttctttatatggcactatggtagattagaaatgtgtttattcaaatatctctcatgcattccgagggtcaaaactctcatcgtttcagccatcctcgaacacacaacaacacaaatgtcacacgagtaaaccttgtatacttcctccgtcccaaaaaaaacctaacctcgtaccacgacgtaacacattctaatataatgaatctgtacatactctatgtccagattcatttttctggaacgcagggagtacctttcaaaacaaaacagaaagtaaaccttctgtaatcaccaagggacaggcatctaagtctaatacacaatcttcccgcgggcaaaactgcaaaaaggagtaggagccgttgatcagtcgtcgctagtttcggtctgcggataattttgtggatatcaaaaccggcaaagtcgggtagggtcgccacatgggttcgtgcgtacaagtccacactttccgcaaactatcaatcgatccacaccctccacgtgtcgtccccgtcgtccggacgtgtcaccgccatccccagctaacgggaggatgcgccgggcccacctgacagtctcgctgaggccaccccgtgaccaaccatgccaccgagctgctgcaagtgggtttcccgcgagtggatcggatccgatcgccacggctgcgtgattagcgagacagggaggcttatctgtttctctcctccggataaggccctcaattattaaaaaaaaacaaaacttattcctaagttcatcgattggttgattaatgagaaatcatgagtgtgtttttaattagtattggttggataccgtatcataggtctgcggtattcaataccgggagggattgatctgcactgttctctgcttgacggatacgttccaggcaatcattgatgctttcttcccattcttttcagttcagctaaatttaacttgttgttggctactcataactcacctactgttctgttcatctaattaatcgctctcttggtagatgttgaaacgaacaaacttcaacattggacatattctatgagctaagttagctgaatctgaatatcatagtagcatgtactgtttaaagaaggcaagtacagtgattaggcaacaaagtttttggatgaagtgatgaacacaggattggatattgtactctattgttaggtcggatatagatatccttggggcgaactgagaaagactagctagcggatcagagtaggaaaggcttgtctctctgaaagagaatttaatcctgaatttggtttccgggagacatgacatgcctcactgcgaacctcatcttcctgtcagaatcaagaagaggatcgcaaccacaaaagaaaaaggaattttccattctcgcgtcggctcgagcacgcggcgaactgaaaatttcttctctgcaagtaatcaagttgcatgtgctatcttagcttctggaacagcccgatcagctccatttcttggccataccatcgccatagtcagaaattcagaaacagctgcgtgcaatgcaacaagatgtttttgcggtttctgcctgaacaagaacaaggtgtgatgcaattatgcaaaccacagaaccagctgcagcggaattcggaaaacgtcatgccatatgtatatacgagatgtaatcaatgcagatagatattaggttgccgtcattgcatcaatcaactgctatgatcgatcgatatgagagttgcactggacagataacgtaaaagattctgatgcaagttgtgtgtgtggtacaggctgcagatgagggataggatggccgaacctgctttcactgttccatgatgttgccgacttttaattctgtccttaattctttttcagcttgattccgcagcatgcggctgcaggtgcgcaaaccatgctcgccacagcctcccactagcgaattagcgatcgattggcgattgttcttcttcttctgaaaggagacaaaacctgtgttgctccactcacagattccctgcccattggtgtgcccaaatgggatcgctgctttgttgcaacctgaaaaagaatactcgtctcttggaagattcactgttctatcacatgtccatgtgatggtgcatacattgtcctggagctgaaagtttttctttaatggtgactttacgtagatgagatttattatatatttatatcttgactaactcggatcttggcttgacatctacgtgcgcggcgcccgttgctttggcgtgagaaagatgcctttgttctgtgaaaattctggtggcaggaacaagaacctgtaagtctgtaacggccgctgcttttatcctggttgcaagttgcacgaatatttggtctgcaaagttaatttgttcgcctgtacatcggaataaaatgcagtttacaggagattggaatggagagtttgttgatcggtttggaaggaagatgtaaaatgcaaagttgaaaacgtcattagactatacttctgtctgaagacgcagaaataattaatttggtgctgtctttctgcgaatttgaatctgactacctgggagaagcatactacgcaagaagtttctgaattaactttgcctcccttgaccaaaggcggacgaaaagaaaggtcaaaataacactccgaaaattgacgagcagagataaatttcagcagcagcttaagcgtgactttggatagtttctgtgtcggtggccggcacgagatgatggactccgacaacctatctcttacgatgccaccggccaccccagtgaagcaggaaagataattctaacactgaactattactggcttgagatcgaagccagaatatcccagctgcctcttgtcttaagaaatcaggacaacacagtgtttatgtttcttgcatctgatcccttgctccaatgcttgagcatgagtctcggctttcccttctcttttcctaaccacccaagggccagtaagagtgcaagtatctaatcgatggcctagcacggtactcctcggtaggtttgccatggcacaagaccggaatcaacaagccatgtcgctactggcccgtggcacatgctgtcggcgtctctctcttggacgcagatgcctcctgcccaatatctgcgcagatctaggagcagcagaagcatccattccttcccatctgaatcgattcctctccgattctcatgttgccttccattgcaggtacactgaaacacaaaccaaagcggccgcggtgccggtgcacacgcgcggcaacggatcggggagagattgcgtgtaaatccgtaggcaaactcgcgcacaccgacaggcgcgcgtcgcggagtcgcggttaaccgaggcgcatcgcggaggagtcgcgtgaccggtgacaacctaactgcttattagccactccttagccaaatggcgtcgcttctcctgtccgcgtccggtatcttggcgaaaatcatgtacaagcgcggcgtcctggtcgaccgaggctgtcgagatgtggcctgccctggccaggccaatcggttagccaacgaaaacttgtgacctcagagctgcgacgtggaagcgatcgagtcatgcgcaagcaagcaacgtcccaacgcgacggtgagatcagatttttttgcgatgcgcaacgcaatgctgtcgtgaacttgatgtgttcgagaccacacaaaattttactagtagcagactcggatgccacagttgggccggtatgtattaaaaaggaagcccactagtatgtaagcccattaacgcgcaggccttacggcccggtatgtgaagtgggcccggcccgtattcacttttacgaaaagcaccttggagaggaacgaaatggcaagcccactcttctcgctggtgtcgaggagattccccaaaaacttggcccccatttctttcgcatcgtcgtctcgccttgccccgtccactaaccctagcggcaactgcgatctccaaccgctcgatctctcgccggaggctccagatctgcgggaggtagtcgacctcgtcgccggcggtggggtttccgaatcgggggcgaagatgacggaggcgtgggtgcggcacaagcccgggatggcgagcgtcaaggacatgccggtgctgcaggacgggccgccgccgggcggcttcgcgcccgtgcgctacgcgcgccggatccccaccaaggggcccagcgccatcgccatcttcctcactaccttcggcgccttcgcctgggggatgtaccaggttggccaggggaacaaggtccgccggtaagttcgccttgcgcatccatgtttatgttaaactgcaattcgttttactgtgtctgtttagccgcgaattccgttggtatgggacacccgccaaaaatcatgccttccagagctgcttcttgttatctatattctacgctacttcgaatgaattgttgcagccggcgatttggtctgagaaaaaccttttacacgaagtacggtaatggaggtggaaatgcaacatacaaagaatttagcaagaactagagttgtagtagttgtatcacacactgaatggatgaagttgctgcattttctcaaaaaaagaaataactgcgttaatgatacactactattcagcaccttatctgattagttaatctgaaggaaatctgattcttgctgcccttccgtacttgtctgtctccgcataagttcagaatcaagtagctaacccgagaccgatcggagtcctatgagcaaagatattgcaaaattgggaatccagtgaactctgcacaacagtttgcttagaatgggtcccaactaattattgatctcgaatttaggaattaaatcattagattagtaaaatgagagtccaaggttgatacagcttcattttttgttaatttcgaatttaggaaaaaccttaggatatctaaaactaaagattccattgtagtaaaaactaaagaatctataatattttcaatagcatatttttaactcgaacttttaatacaatctatggttgtgataattcaatccaactaaccaatggccagctctatctggttaacgtgggagtcccctcagagtgcccaattagtataggtatagtcttgtatgtagactgtctaggacagttggatgttactattcgtatgcatgtattacaattctactcctttagtaacccctttgatgatgtgagatcttccacatatttatgttaattttatcagttcctatactttgtgaccatttcagtatttttagcatggattctaggatttttgtgctctgtgctccactcttcagtattcagttccaggagaaattttcattaatgtgacagtgtgggtgaaccataactttttgttgtcatcgttgagctagttatatgcagatttgattgcagtggcaatggcatcatctgagttccgttgccttatttattcaatttagtgatcctgagacatttgttaggtcacagtataactttggactggttagattaattgtgaaagtaatccttaatcaaggtgcagcacctaatgatatcatcctccttttatctaaatgtttttttttattaatgaccatacacattaaaaaacaagtgtgttgattcctgctatgctttcctgttatgttgtttgttacaagtaggcctgtagctctgatgagtatcttgccaaaccatgctgtttacattccccaccctcccagtttatgacaaaattgcttgctcatgtttgtcttctggtgcagttcatgttgttttttgttgcattttatatttgtcaattgtctcatcgactgtgctattgtttttgtagtgcactcaaagaggagaaaattgctgcccgcaccgctttagtgccagtgctccaagctgaagaagatgaaaggtacagctcaacaattgatgccatactctatatttttcccacaacatcctcagtttcatcttacgcataagatccatggtacttccttagatttgtcaaagagtggacaaagtctcttatgtgggaggaaataattatgaaagatgtccctggatggaaggtcggccaaagtgtctataattccgggaaatggatgcctcctgccaccggcgagctgcgtcgtgaagattgatgaaatccaaggggcttgccgcagcctaccaaagatgccatcatgtcttttgggcatgcataaggcttttgaaccagaatacccaaaaaaaattgctacgaggaactcactcttaaagcactcgctgtgcatttgttgtgttgatgaaatcttggctaataattggacatgtcaaacagacatttgtttcacatgaactatgctcttttgtggacggaacatctgttttgccctgatgttctcccttctctatgttttatttttttctactctgtactaagcacttcttggtcagtgctttaccttactgtaaacattcgaatgtattcagtctttttagacaaagacacaggaggaacattcaatgtcaagcgcttggatcggatgggtatattaccgagatagtgaacggaaaactcaagaagtcagaatcaagcccgtgatcagatagggagagccaaaacagtgtcactgcgtactagagataaatgaacaagcaaaaggcaactcaagaagtcagaatcaagcacgtgatcagatagagagagccaaagagccaaaacagcgccactgcatgcgtacaggagataaatgaacaagcaaaaggcgaccgataatatgtattccattcgttttataatgtaagactttttagccttgcccacatacatatagatgttaatgaatctattttataatgtaagactttttagccttgcccacatacatatagatgttaatgaatctaaacacatgtatatgtctaaattcattaacatctaaatgaatgtgtgtaatgctagaaagttttatattgtgatacggaggaagtatcacattttgacagtttgattttgtactgtactaggtttgatgaagattggaatgcgaagattgctttgagaaaggcccattgtacggacctcagaacacctagctgaactagcctgggctttattgtttcggccttgatgggctgggctccttctgtgttgacttcccggtagaactggaatcggaatcagagcggaaaaaaagaaagaagaaagaggcagatcagatgacctgacctccgattcggctgatcggagcccaggccccggccaagtttgccctcgtttagttttcaatttttatttaaactttcaacttttccatcacattaaaatttttctacacacgtaaatttctattttttttaaaaactttcaattttaacgtttgtcgagctcgccgtcgacccccctcgtccgcgccgcaggctattcttcctcggtgcaggatggacaggtgataatgacaacagaaaatggcgttcgtgctgcgcctagactcccctagctctgcgcctggcgcaccgttgcgttgagggaggcgttgagccgttgactcgccgctgctctcatgctgtgtttagttgctgaaaaaaattgaaagtttgagaaaaattggtagtttgaaaaaaaatttagaagtttatgtgtgtaggaaagttttggatgttatgtgatgtgatagaaagctggaagttaggggtgaagtaaacacgacctcagtgctcgttaacgtcaccccgattctgatctttgcatggctagctgcatgcggcttctgttggctccgtgacctgtgttgagccgataccctacccaacatttactgcatgatggcactgtaaaagtcacaggcagcagcacaggatccgaagacagtttgcagatgcatgcaagccgagttgatcgtggccatggatggcaatttgcaagggaaagggagcgataaaacaagtgatcggaggtgccagccgtctggccatggctgagcctgagtcctagtaactgacaggagctgcgcggcagtagtacagttaatactgcggcacatttattaatctgacgagacgtcttggcttctcgtgtgcctctgccatgtatcgatcctggccggctggccgctggccgggccttgttgcttcctttcctccgaaacgtttccacagtctactctacagtataattgtggaggtgtgtcatgagaaatggctgcagcagataagacgtcactgagctcattgtgcagattaaaagcttcaggggtgtttagatcgtgttgttaagttttagcgcgtcacatcggatattatatagggtattatatagggtattcggacactaataaaaactaattacagaattcgtcggtaaaccgcgagatgaatttattaagcctaattaatctatcattagcaaatatttactgtagcaccacattgccaaatcatagagcaattaggcttaaaagattcgtctcacaaattagttataatctgtgtaattatttatttattagcctatatttaatacttcatgcagatattcaaacgttcgatgtgatatggtgtaaaattttatgattgaatccaaacaagcccttattagtagccgtagcagcctttcctctctcttttttctttcgctgggtcttctgcttcttctgtgcagttgttccatttggtgatttactgcattagtaacattattacagcagctggcgcggcaaagtccaaaagcgtgagtccatgaggcagtgctacgaaccaacgattgccccatgcagccatgctgcttcaggcttccgctttttacgtgagtactcccatttcgtcgtccttgctgcaactgctagatcatcggacaaacagacctgcgcctgctggtcatgatggattcatggatgtgattgcgcgaatgatggctagaatgtggtgagcaagtctaacagcacagtgcgcacacacacacgttggatttagatttgctaggtgtattttgaacatactcctaagttgatactgatagtactcctaagttacatgtacatcacccggtctgagcatcaatacaagaaggatggtacagtaattgatctggtgagttcagagcgacatgtgggtcaggcttggtcgcaatcaggcagctaaagcattgcattggttgggtgtggccatgaaaattgatgtcgacgtagtactacatgtaggactactgtttactcagtggaaatgctctgcatcaatagaacaggggcaaaggcaatatgctggtactcgctctggctagctgtgccttctactccatcacagtagacatgaacctatcgacccagcccatgttcagccctggcctacgctgatagatggagagtatttgcttgagcgacccaactacttcgtccctcttgtgttctgcttctgaattgctgcatggcgacatggcataatccgtgcaagtttggaacggtacatctagcgcaatgcatgatatagggactaaacataccgtcggtacgttgccttacgctaacaaaccgaatgcataagggacacacttcaaccctcgactctccaggaaatggtcagattgatcaaaccttattgaagcagaggagcagaatcttcagagcattcattgtgaagagcaacacgtaagaatgggcaaactgtatactgctcgtcaccctacatcgtttttcatgaattaatatcaagaacagaagggatgccaggattgcgcgcttcatttctttttattcactagcatttgtagcaccgcagtgtagtggagtagagtaaggagtacctacaagctactgattactctgatcttaaataccctgttcctagctacatgcatgaccatcggggatgagataatagcatttgtagcacgcagtaatattaagcatttttaagattcagaacatgtgctctttttctattttaagtatatagcgttgttaacttttgaacatagtgtatgaccatccatattatttaaaaatttagtgtaaatatgaaaaagaaagatgagtcatacataaaataccgtcactaataaaataaggcataacaaaactagtaacacgtgtacatagttctttacgagacaaatagtcaacattagccgtttaaatagaggtagtatataatataaatatttccatagtactatttatctcataaataaaactttgactgacaataacttttaaaatatttagaatgaagaaactatacttcaaaagtattgccttcgtcctattcttttagggacggagggagtactttaataaaattaaatatttacgtaaattttaatatgttacaatagaaaatcatagtaaaaatatgttttggatatgtgttgttgtccaaaacatcaggaattatagaagcggagtatgattttctttttcctctcttcaatgcacttatatacacattcatagaggaaaaaaaatgtaatgccgcctcattttctccattctggagtgtcagtagcaatgaaataatttgacgcataaatgtattacctgatcatcacgttttcaaaccgataaacgatatgcttttttttaaaaaaatatatactatacaaaggtttctttaaaaatcaaataaacaccacttaaaatttataatagttaataattaattgattatatagtttcgtgtatggcaaaaatgcaaaagctaaatgaggtatcaaacaaccctttatactcctacagtacatgtctcgtagtaccactgtagctactgtcatgtttttgaatttttaaagaaaaagaagacaataaataccagtactagatttttatacttgctgcgatgaggtacatttctgagctggtgctatatatacgtctgttgcagacttgcagtgtttacactttacagtggcgcatgcatggagaggagagacactgtttggtcttgacggccattgatgcagctgatgctcgctgtctgatgagtgtctgaatagtgtcttccattgggtgtctagactagagtctggaactctggatatgtgcatgctaatatagcaaaatgccaggaatgaatgcaagaaacttttcgccttattatttttatttgtaaagtactctctccgtcccaaaaagaatcaacctaaaacctctcacagtgcacctacatggaccggtgctccaccttgctagcgaggattttcgcttacgtggcagaaggaatcgcaccctagcagaggatctcgcacccatggagggcgacgcgaaacctcgttcttgcgagtccatgggcggagaagaaaacggctagcgctcgcactgtggagggcgtggcttcgatgcgccgtgtcctcttgcgaagaaatccctggtttgcccacgaaaactcccctcccgccacagccattcctcccctcccgccacaggcaagaaaatcttcggattcaacaagaaacacacattggattcaaacagaaatatctcacagatcggattgaaagaggagaatcgtttataggttaaacaacgagaaattgaagaaataaaaatcaatagaaaaactaacagatcgaggcgtatgtccaccacaagatgaaaaagaaaaaagaagccgacgccggtagtggtggccgacgcagccgcagccaagaaggtgccgccgccgccaagaacccgctgccgcccaccggatccactcccccacctcctcctcctcgccgccaccgcgtgcactgtggaagaccgcgccgcccactgttgcttgggaggagaggagaaggaggcacggcagcatgggaggcgaggaggcgcaggaggtgaggaggcgcggcggcgcgggaggcgaggagcgacgactgaggtggagtgggaggagccgagctcgtgaccgggaggaggaggaagggtaggtgaaggaaatttatttccttgtggtcatgcgccgagtcacgcgcgttgtggcactctttgccttgtacggtgccttgatccaactaggtcacacaaaataggatccttgcattgtgagaacgagtgtctttgagtcttttttagggctaagctacgggagctggtgcttgcactgtgaatggcctaaaaggatatgcgacccgttctaggacaatgcatttggatgtgacccctcttaagttgattatttttaggacaaagagagtactctgtctcttttcttttttatgatattggtcaattcaaaaatgaactagcaatggagagagtagatcgttagtgtgaaactaacctgggaccgggtttattaaggcctggtttagttctccaatttttttccccaaaaacatcacatcgaatttttggacacatgtatggagcattaaatatagattttaaaaaaacctaattatacagttagaggaaaatcacgagacgaatcttttgagcataattagaccatgattagccataagcgctacagtaacccacatatgctaatgacggattaattaggctcaaaagattcgtctcacggtttccaagcgagttatgaaattagttttttcattcgtgtctgaaaaccctttcgacatcagatcaaacgtccgatataacacccaaaaatttttcttttcgcgaactaaacaagtcctaaaagccaaaaactcaacccactagacactgttacaggagcactgctggtagagtaaaatactgcgagcaatgtcacttcaaactgaactaaggaggtcaaagtgttcaaacttaatcatggctccataattcacgagattctaatcagaccaaaactttcttctgctactgcgaccacttgatagcctgattattgtcctggcaaggcatgcctgcgtgtgtgcgtgcaattggtgggtgacacgaaacgattggttcgaacaagattatcgaaaagctgcaggttagtgccgtttcccatcccatcaaatcagatccaaggacaccgctatcctattcctcccctcggctcggccggctagtttccaaaagctgcaatccagaggctcctatataaggccttgttagttggcaaaaaattttgcgctacatgtcacattgtatatatggacacatatacaaatttcaccaagaaactacgagacgaatttattaagactaattaatcaatcattagcaaatgtttactatagcaccacatgttaaatcatggcacaattaggcttaaaagattcgtctcgcaatttcctggcgaactgtgtaattgatttttttctacatttaatactccatgcatatgtctaaatattcgatataacagggtgaaaagtttctgcgtgggaactaaacagggcctaagtaagatttcaaaatttttaactttggtttaaaaactttcaagctaagatttgaaaactttaaactcagttttgaaatttttagttaaaaggttttaggttttaagttgaatgttttcaaattttgatgtgaaaagtttgaattttgagttaaaaattttcaaaatttgagttgtcgttttcagattaactcgaaagttttcaagatctgagttaaatgttttcaaattttgagttggaagttttcaaatcttgaggtgaaaatttcaaattgacttgaacgtttttaaaatataagttaaaaattttcaaatttcggttacaagttttaaatgtcaaaagtccaaaccgtgcaaaaaaaaaaagcaatgtgctaatcgaatttaattacgtgaatcattaatgaagcggtaatagaaaaaaaaacggtacgatttcgttttccactacatccaaccatcggaccgttcgctgacgcgagctatgttttcgacgcttacacacgtattaggattctcgccacaatcttggtccctgaccccgtcgcaactcacgcaccttaagggcgtttacaaattacaatgtatctacgcgacgttcagtcttagaggaagaaacggcatattcggtgccacgtctccacatgcaagtgagaaccgagtagccaaagttggtcacctgttcttgggctaaaaagcgcacagacgcagctgagaagaggagagagagagagagtgggaaaagcagcataagcaaaagcacagctgcccgacgccgtcgccgctcgggccacggcgcagaggttgaaggagaaagggagaggcgccgagatccgagcgttggcgcgccggcttggggaggatggccgcctctccgcccggccgccccgcgccgccgccacctcctcctagggaggagaccggacggggagaggaaggggccgcgtcgccgccttcggccccaacgaggagaggtggaggcgtggagctcggtgtcggcttggggaggagcttcgtctgcccgggagagagtggtgggaaagtgtgagaggagagagagggagagataaaagtgagcggagagagataggtgagacccactccaagcaacatgtattatggagtatgtagctaatatggttctttagcctagttagaagcccatgcgctgtattttgtacgatacactgtgagtgctctaacaccacacaattgggaggggggatgggggacaaactaggtcgactcaactcattaacaagctagcaaaaggttagcttggcttaacttatgagctgctcattaacaatctcatttatatcatactaaactattttatcatatattaacataataacacttaatggtaattaataatcactaagtatataaagatatggtgatatcttatactaacgagctagctcgttaagcttatggacgcaatagggatcctggatattctatggaataccaaaaaaatctgcaaaatttaatatatgtcgatcaattatatgtctatgtacttaattggacataatacttcattatcgacttctattttcacaacaaattcactccttctatggtcttagctcatgccacttctatcttgatagccaattgtctcaaatctccaaactttagctcactaaacatcaatgatatgacatttgtaattgttgattaaatactcacactttggtggcgaaaaaaaaacctcaccttctatcactagggcgttgtttggtttcatgggctaattattagcctccatcttttagcctgaatatgaaaggtgagggtttttttcgccaccaaagtgtgcccccaaaaatccaaaaaggtgggctaatttgtggctaaagtgaattagccaccatcaaaacattagcccctccaaggggtgctaatgagactaattttgtgtggggaccattaaaaagcagctctctctctcttactctttctccaccttttggtcttgaattagtcaatggatccaaacatgccaacttagactaatatttagcctactaattaatgactaaacattaactctcaaaattagctctgggctaatcttccaaacatagcctagctcagcttgaccaagttctagcttagagctttttatccatccctccacacctccgcaccggcctgagctgcactacacaacacggtgccctccccaaccgctcccccgatcgcatgccgcgttcgacgctcgacgacccaactaaccaacaagcggagaccccgcggcacaagcgcaactgcacaagaccgcaccggaacacaagacctcaccggacaccgcgcacttattgcgcaaacagtgcgtgcatggatggagcgatgtcgctgacgcccgctcggctctcttctctcttgcagtcgcatgcagcctcgcacgcacagcctataccctctgctgtccgcacccgtttttctactggatttttctctgcgtcctctgccctcgattgctggcgttgctagatgcactgcacatgagcacatcctaaaatcacaactgcagatgagctcatgagcacatcctataaaatcacaagtagtactacacgggaatggaggagtaatgaataaatgtacagagaaggagggtgcgtgctgtaaatactcgagatgggcgcttggtacttgcatgtttccattcccattccaattccaaccatatctcctctactactcctactcgagtactagtactaaaacctgtgggcccaactagccaccggcgctaccggtcaggagtgatataagccgctgcgagtgtggtcatcagtggtgagagtgtgagagctagaggccaaatggaggcgacggtggaagggaggaaggtggtgggcagggcggaggcgagcccggagcggggccggccggcgtacgcgccgccggtgaggtcggcgccggcgaggccgatgaggaaggtgcagatcatctactacctctgcaggaacgggcagctcgagcacccgcacttcatggagctggctcagcatcctcaccagccacttcgcctcaaaggtgcacatctgaacatccctgcatcttgttgtatctgcatgctaaatgcatatggtgcttagtttagttaaatcttctatggtgatcaccggttctgattcttttctctttttctttggcggtgtgcgtgcctgaagatgtgatggataggctcacgctgcttaggggaaaaggcatgcctgctctcttctcatggtcttgcaagaggtacctaactgaaaactgcggtcattcatgcatgcttcccacttgtttctctatcttttagtagtacaacacttacttgagcttgatgtagtagtaacattgctgctcatttgtgtgcaaacatgaaggaactacaagaacgggtatgtgtggaacgatctatctgagaacgatgtgatctacccgtcggacggcgtggagtacgttctcaagggctccgaaatcttccctggctgttcttccggtatgtactcatcaggccatcactctacaaagtactcactcggccaactccacctgctatcactactccgtatctttttcatgtgaaactattattgatggactcgccgtttgattgcactgggagaggtcgttcaaaaaaaaaagtactgggagtagtactggaactgccatgactttgcatggacaccatggtcatggtgcatgtacagcaataatttatcgtctttttcagtactcacaagaaagaggccatcttatcaatctgaaaaaggctactatcttcctaaaataagtgctgccatagatattcgtgtccagcgttttgaccgtccgtcttatttaaaaattttattaaaaattaataatattagtcacacataaaataatattcatgtattatcatctaataacaataacaatactaatcataattcttttttaaataagacgaacgatcaaacgttgagcatgagcagtgttaaaactgtatttattttgagacggaaggagtaatttttttctttgttctcacttcacattgtcaactcgtttttcaaatgtgaaaatgggccatgatgggtgctgatagtaaaacacaagtacagctttcttacaccttgcacgtttccttgctgcacccacatcgtaaatcgtgtgtgaagacttcactacgaccctactgtctgaggttaatcagttaattaatgcgtggcggtagaagaagtctctcatactgtagcagcatccatcatccgaattataatggtcacctgtctctgccaaacctgctgtgtaaactgttcaattgtttttttctcctctaaaatttgcagatcggttcccacaccttcgtgtcaccgataggtctccggcgaagcggctggcgttgccgcccagccacaagcagtacgtggacagctaccgggacgacgccgcggaggatcccgaggacgacgagctggggtacggctaccaccggcgagccggcggcgctcgcctcgctgcgaagcccgtctcggcgcgcaccaaccggagccgcccggtggagctgcccgtggaggagacctcgccgccgtcgtcgacctcctccgacaagccccctgccgcgccgcagctgcagccgggcggcggccgcggtagtgacgagaccgagtcgaacagggccggctcgatgctcctgcagctcatcgcctgcgggtcggcggccggcggcggctcggccaagtgccggaccgagccgaggcggagctgcggcctggtgagccggctggcggcggcctcacgcgccggcacggaggtcgacgacgacgaggaggccggcggcggcggcgagctgagccggcggttcggccacctggcggtggaggagaaggagtacttcagcggcagcatcgtggagagcggagtcaggggcactccactgccatccagctcgctcaaacgctccaactcgtacaacgaggagaggtaaaccttaccattaccggaagtggtaaaatcctttgcaaagtcttcgatcgcctaacctgccgtagctagcttgcatctggccgatcgagtgactgactgactgacatcgcgattgtcgaatgcgtatggctttttcctgatatctcatcactcgattcgtcacatctcttgtctaattgtcgaatgcgtaggtcatgtgtagacgtagcatgcaatgcttgtctagactaaacggaaatcttggaatttagccatgacacatgacacaacataatagaggtcaacgaatgagcacgtccttttttatgttggagaaaaaaaaaacgacagcaaaaactgcagaagacagcaaccggcatgcatgcttgccgtttaggaggactaggaaggtggcccgcgcatacacttatatattattgaaaagtaagattattgtttgttcagaaattttgtctcatagattcagggcaaattaaagtttggataatgttattttataataatttaagggttgtatttttcttaaggtatcttataaaaccaatcataaacttttgagtaggagatggattaagtacttacgacttttgaatcattttttttctcgagtaaataagaaactattgctagttaattatcatacagtacatgtatatacataccgtgtagtatggtcacaaattaaaaatgcgagtgcaagatactaaaaattcttttgattaaatcgtctcatgaagacgcatgatatagtaataaaggaagggaagcatatggatgggaaaaaaagaaagagaaaaatgaaaaaagggaggggaggcgtatgtacccgtgcacgtaggtgtgtacctatgtcgaggtgggacctcgtagtatttagtttgttttaagatcaatttaatctaacggtttataatattggacctaccagtttaagtgaaaatcaaataatatatactttgatttttttctaagaatttctaatatttgccctaatttattatagcaccacgtggcagcttgtgagcattttaaggaatttgaaatgactaattagaatattaactgcacaatatatatgtatgtgacatatggtaatatttgttccagcttcgtccatgtttatatacatgtagagagaaattaattttgtggctagcaagccattagatgtctaattaatagcaattaattttgacacctatttacaattgttcagatcaactcttatatattcatcttacgactttgatgatccgttgatcaccatggctcgcatgaaaaaaatatgtacttcctccgtttcacaatgtaagtcattctagcatttcctacatttatattgatgttaatgtgggaaatgctaaaatgacttacattgtgaaacagagagagtagtacttaaagtttaggatagctgaaattgatgaattatataatttatgtgatagctattcgagggtataaatgaatggattgacttctaaaaagttagaaagttgtttaaagatgacaccatttagaaactcataaagcgtgcaaacaaaaatccaaaatatggaatcgggaaaaaagagagggccttaaactccctttatcacccttgtcgtagtaagatttgtattgatattcgtcaatattgcgctcacatttataacataatgattccttttacctgtacaaacaaatagtacaaaatccaaatatgacataacataaatacattatagttgttatgtaatcaactctcggtttcaacttaaacagagctaattagtgtagagaaaaacacaacccatggtgcttaattattctcttgtcgcatcacacctttaattttctttttatgttatttacaaaattaatcatctacatatatgatttgatacgtggcaaagcggtagcgctataatggttgtgttcaccttagatgtctcagacactatgctttatgctttgtaacacgtgcgaaaggcaaaggtgcagacgtgcaatgtgcagcaggcaaaaagataattttggacgctttatttattagcaaacaatagatctgatgattataataataggtccatcagttctagtgtaagtgtaaattagttaatatagattttaaattgttaatttaatgggtacataatataatggtgtagaccttattttgaaatagtgcattacttgagaataatagaacagtgtaataaaatgtagatccaataatttgcataatggagccataagtttaagtgcacatataaattagttaatatatagatattgtttatttgataggtacacaatataattgtgtaaaatttattttaaaatagtgcattatttgaaaataatagtacaaagtaaagagtacaccggcttaagttatatgatggtagattctttgtttgtaaaattatgattatttaaaaaatatatttatatatatatatatatatatggaaaaaagaagaaaaaaggaaaaaggggggggggggggggaggaagcgtacgtatttggcacgggaggagaggataggtgggacccatggtttttagtttgttttaagatcaatttcatctaacggtgtataatattggacccaccaatttaagtaaaaatcaaaggatatatgttttgtttttttcttagaatttctaggattctctctattttattagagcgccacgtggcggcttgaaagcgcttgtagaaagtttcatggacttttagtatataatagatagatttaagttaaccaggcatggcgtatgcacgggtgtgtgcagcgagctgtagtacttcgaattcgcatttttttgccggaaaatactcgatcaaacgtgtacagtatctcgtttggttgcatgctgtgcgccggtgcgttttggcatgaagacagtaggttctttcgtgcttcgtcgacgcgtcatgtaatcgtgctgcacaactgtagactgtgtgtgcatattggtatgggccatcgtccaggtccactcatggctctcgtcaagctcaagctcaatcgctgatggattctgtactaggttctactgtgtcagcgtacgacgttgttgtacatagtactgtaaacgtacggacagaatcgaatctctctgtgttacacctttacacatcgtatgcttttgcctgtaaactttaaaggcatttatttgcaaataacttttggtttttaacctcaggagctcgatcaaggctgtgttacacttttacagatcggtatgcgcttttgcctgtaaactttatggcatttgcaaataacttttggtttttaacctcaggagttcgaggcttggtgtcagcgaggagagatcaacgacggatgagcagatggaaggggaggaagggatgatcagggggagatgcatcccgggcaggaagaagcagcacaagtaacttagctaggtgcactccaaccatcattcagattttcaggaactactgagtagaacattaatctagctagttgtacttttctaagaggaattaaaggagactactcactgtattactacatgttgctggtagatctggaatgttgaagtcattcatcactcagttcagagagtagagtaggggattgattctgcttgtttggtttcctttctcggtgaaaatatgatgaacgaggtcagcatgctgatgccagatgtgcttggtaacagatggtagtatggggcggtgtgtgacgctcttgggtccactgcgtaaaggatggcaatgaataggccccgatgcattgcatccgctccataaattcgtgctccatcgtcctgagttgatgagctctgactctgagcctctgactgtgttgcaggcgcgtcctagcttttgcctgattgtgtatcgcccagcgctcgtatgggcatatggctagaaaaccggtgggaaaaacgggttggctacagatcgaggtttggaggttgtcacggattgactgaaatatgcgtcaccctacacacataaacacagttgcgatcgagtctcgaaagacaccaagagtacagcgagaattcacttccgatccgacgacgcacgagtgcacgacgacacgttgagctcctcagctcggccatgccatgccaatctccctagctacgtatggcaactggtgcagcggtggggcacacgcgcgctaggcgtcgtgttgatcaggttgcggcggtgggagcggctgcccccggatgaaggaggagacgagcaccagcgctcgctccggctggtcgatcggggccatgtgcccggacccgcgcaccgtcgcgaacaccagcccgtcgtacgcgatcacgtacccggcaacgtccttgccgtccgccgaccacggccgccagtccgccgccacccgcagctggagcctctccatcgactgcctcgtcgccgtcaccggcaccatcgcatccaagtcgccgctgcagcacacacaaatatatgtacattgtcaccaaagaagagtacatgacgatgctaggcaggatgaacggaagagctagcgatcgaacacgcagcatttgacggacctgaatatccagatgcggatgcggccggttatcactgccttgatgtatggcagcattgactttggcgagtcgccgaagtggtctaggttgtaaaccctgtcacatttccatcctccaacgtcagagatgggaaagcaagagcgtgcttgcgtgagcttgacaccataaatacctgcatctagtccagggatacttcaactccgtgttcgcatggatcgtcttctgtacctggggctggttcatgtacgcctccacgaagtattgggagcacggatcagccaaatcctgcatgcaaatgcgggtgtttcatgcggtttgataattaaattcaacctgcaaaagcgtgcagtaatatatcatccgtaccatgcacttggaggctgagggcctgactttctgttcgtggcaggtggacgagtatatgttgtagatgtcgatgttgccaatccggctatacgccgctttcctcgccgactcgcagagcgccgacgggtggtcgtcggggtacttgcagctctgcgtgatgagcgcgtgcgccgagtccgatatgaacgcgtgctgccacaggtactcgtacagctgcgtttgctcagccgcgaactccagtatgccgttcccgatctgaacgtagaacatcaccagaattcagaaaacattacagcttcgcggctatctgaacatggccatgcatggcgaatcctgcatactcacggcgattcctttgagcttgatgggggtcgcgtgcgggagcaagttgttgtcgaggatggtgacggcgagctccgggacgtagtggccggcgtagctctcgccgacgatgaagaggtcccgggtcttgtattccgggaaccggtcgagccaccggagcaggaaggtgtgcgagtcgtgcgccgtcatgttgtcccctatggtgctgtacacctcttgcggcttcaccgccgcgtacgagaagcccacgcccacggggctctccaggaacagcaggttcccgtgcgccaacccgcggttcaaccgattgtcagtcacgctcacgcacaaggaaggagaaagtattttctgcacctagtgccatgtcacctaggtgtatgtatgtaatttaaacagttatataaaaaaatataaaatttgataagatggactttgataatataagacaatatacaaatatgcaagtttaaattcgatcgatatatgaagaaacaaaaataacaaattttatctacgttgtacgggtactattcattgtctgattttattatttttgtttctctaattgtagatcaaatttagttctgcatgtttgtgtatagacttatatcatcataattgatgttactaatttttttttaattttttctataactatttatgtcgcatgcaaacgatgggtgccatggcacctaggtgtagaaaatccgtgtccgttgcttatgcttatgtttaccggtcaaaatttgaattttcaaacttaaatttaaagttgattttgagggtttttttatcaaagtttatttttcagccattttttagatcgctaaaaacacgcatatcaaagttttgtcacttcacaaattaatttttatttataaatatgccgtctcgcttatgcttgaaaccagccaaactatggctttttttttgttttttttatataccgatgtaataatgtaacgtgaccgagaaacgtatcctgaccagtaatccaggagtgcgggttccggcagagcgtcttgccgtccgtgtccacgcggaagggcccgatctcctggaacgctccgatgcccatggatgagcagccaggccctgtaaacacagcagtaatttgatgaagaattccaacatgtactcgatctgtttcgatcactattctgaacatactgattgggaacgcaattggatacggaaaaattacctccgttgagccacaaaagaagcggtttgtgggcagcatcaacggaggcttccacaaagtagtagaagagcgacttcccggaagtctcattgacgttgatgtagcctgaatattgctgtagcttcacgtccggtggctggcccggcagcgcggcgatcttgtccgcttccttggagccctcgccggcggcgagagcccggcatgattgcacggagaagacgattgcgacggagagccacaaccacaacgccctgtagttcatcatcatcattgggaaacagaggaagaggaaaaaaaaataatggcgaatgcagattattggcaaacagcggatttatagcaagaaacaaaattttgtgcctgttttctggttattcagttgaaccgcggatgccacgttcgtctttgattcttctctttcaagaccctcccaaatttaaggacgtccttgccgataatagactgttctttcctgatgagctggttgactattttaagcactttattgcccgttaaactttaccttattatcactccaaattaaaattttaaatgtttagttcaaaaattttaaaaatgtggataaacaatactactactgatttgttagatcggaaaggaaaactaaaggcccatagataatgagatcaagcccggcccaaattcgccagacaaccagaagcctaggccctagagcggcgagctgacgccgtgacgcggcgacgaggtgagcgcacgggcgcacagcggaggcgccgatctctctctccctcccagaacccgccatggggagcaggaagaaggcgaagccgagcaggagcaggaagaaggcgaagccgagccccgaccaggccgtggccctcgactacgtccgcgcctgggcgcatcccgctgcctccgcgccgccgccggagccctcggctgccgatgccgccggggacgacttcctgccgcaccaggccgcgcgcatggcctctggaggcggagggagcgtgctgttcgagctccactcccactccaaccacagcgacgggttcctctccccctccgagctcgtggagcgcgcccaccgcaacggagtaagtacacgatctggactctcctccgtttgcctggtagccggtaggtgtttgaggaaatgcctgtgaggtctgtaactcgtatagcggttatattgtgcgataaatgggctcctcagagctgcttcgttgtgtaagggagtaagagctagtttaacagtgagaactaacatgtattagagctgacatgtacaatggattagctataaggttgcctctaattctcttctcctctctctttttctcacttatgtaattaatgcatttaccttggagcatatatagatctagatcttgcatgagagctagcacccttttttttttgggttctttctcattcatataagtttatagatggcttatatagcctactagtaattaaacgtgctctaagggaccaagggttgcacttccaagcatcaccttgacaccttccaatctgttttccagtttcctgtgaagcagtaggtaatgtgcctactgggttcaatattggatgccagccgcatagcctccgtgtttccttaatctgttaactatatttaaatgctgtgatcactcgtactcttggagggtacttatgcccttgaatcagtaccccttcaatgatcatggaagcggccatcggctgattgcgttgggtagttcagagttcagatcgtgctttgcttgacagtgcagcatccctttttctagtgaagtgatcttcatgtatatgctatatctcattgtcccaaagtttgtcttatgtattgggtgcttgttcagatgttaaatcttaccatgtgcatgccacaattttgaatggtagaaaaagaagaagagttagaatggctaaattgtatatgtcggtactacaggtgaaagtacttgccctgacagatcatgataccatggctggtatacctgaagctgtgtcagcggctcacagatttggcatgagaataatcccaggagttgaaatcagtgcactatattctccaaagtaagatatttcttgtttcccatccatcttttgaataaaaaatagcaatgcgatggaattttaacaaataatcgtagttggttcatgccctcataactcaggaactatcatcgcactatatgcctgttccatcttataatattctgttatgttactttgttgtaaacaacatttaagtaatcacaatacgagtgaagttgtttcgttcagagattcctgtaccattactgataattgtagtgaacaagacttcattgtcgcatcttttccgtaaaattgtgctagctagtctagtacctttttgacatatcattgagctatcttgattctaaagaccaagagagttctgttggtgtttacatgtcagcttaacagagcaaggtaaaatcaagcgtgaggatcaagattaatcaccttataaaaatgcgccaaggaatactagctcctctcatctattcaccttatataaatgactattaactacaaaccaaatatgccaatctgttatcaatggtcactttaaccgagcattatatatgttgcattttgtccttgtatgttcatatagctgtccctgatcttcattgtcttaaagggaaatcgctggtactggtgagcatgttcatattcttgcatactatggtatgtgtggaccttcaaggtttgatgatctggaaaggatgctatcaaacattagagatgggcggtacttgcgtgcaaggaatatgctggcaaagctagatagactaaaggtgccaataaagtgggaacatgtaactaaaattgctggtgagggagtagcacctggcagattgcatatagcaagggctatggttgaaatgggtcatatagagaacattaggcaagcattcaacaagtacattggtgatgatggccctgcatatgccacgtaagtgctattgataatgtacgaaaaattcatcctggtgattgtttcacgcggaggaatgtctttgttaaataacggggcccatattttgtgcagaggaagtgaaccattcgctgagactgtggtgcagttgattaatcgtacagggggtatatctgcattagctcatccatgggcattgaagaacccagatgcagtcatccgagcattgaaaggtgctggccttaatgctctggaagtctacagaagtgacggaaaagttgatggtatgtctcttgtaccatacataaatcatttcaaatcttatttgaaagcagcatatgtttgttatttgttagttcatatccaattacaggatcgttgctgacacgtatggactctattccacaggatttagtgaattagctgagaagtatgaccttttgaagatcggaggttcagatttccatggaagaggtggaaaggatgaatctgatattggaacagttaagcttgctattactactttgtgttccttcttgaagatggctcggcctatctggtgtagtgccatgaaagacattctactgaagtttgcagaggaaccatctacgactaatctgggaaagatggttttgtttggagaactcattaattttaatggtttttcatcaacgggttctggtatggatattgttaatctgtgcttatcttcttggttaagtaacaatggcatggaagaagtggaacttgaggaggtaagattgaagcttgcccattgcgtaggtaaaagataatctcaaatgcatgactaccttgaacaatgggtgttccctttatctggaatgtgttttgcaactcaacatttatattttgctatgttcttaacagcccatagacctaatacatattttatcagttagtgatggtgttgctaaaagtagagatgatatagaattgataagtcattaacatttaatcaagaatgaatattcctttggtaatttaacagcttgtcaagagctgcacataattagagcatgcaagtatgctactggttttttaatggagaatactcatttcttcacgggtgtatcagtgaagcacacatatactctcctgtatatgtctccttttcaattctaatcagaactgtcctgattgcttatgtacattgtgtgtgttgtcaattgtgaggcccagtctatgaattgagcctatatggtccatgctgtagttatgagtgcaagtggtaggagggagggtagttccactttgctagttgagtgtgaggttcataccctgtccattggaacagacctgtccataatatccaacttaaacttatgaccattataacaagaagctaatatatagttaatggatatccaattcgatctgatacgtatccattgaccagaaattgtatggttgatgatattcaattcctttgcttcttggaaatgtgaaggtcggcatcagcatgatattgcagttattttgatttttttaacaggaacatgctttcttttcttatttgtcaacaataaaccattatatgcaatttcacgtttgattgttcatctattttcccacagaaatgaaccagggcaaaagatctctgtttgctatatttaattttgaatatctcatgggtttctgtgacatggtaattttatagtcgaaaaaaaatgaatcttccactggattcatctatctatttatttttgctcccatatttattttatacaacgtgatcttggcttcttcctgtcattgtcatggtccaacctaaagatgtgagcgtttcgtttatatcagcaatggctcctgtagtccggtgtctgatcacttcgctctttttgtttgtttcttttttttcttttctttttgactgtgtacgtaaatgtaaacatctaattaggttgcagttcttaactgtgcaaaaacagagtaaattgtacttcggaccacaaattcttaccaaagtgaagtactacccttacaatgtttttttcactttacactaggtattgtcgtcaaataggtat

SEQ ID NO: 6350 - DNA, 3865 bp, Oryza sativa
  unsure (1)..(3865): unsure at all n locations
attgtgctattggctatgagcatggctactaagttggtcaaagtgttacctttttatttcttcctcgtgagaagatcagagaaataactctaacgcctcctttggattgaaggattcatgaaaattttgaaggtttcaaatccttggaaattttttcatatgaggtcatctggaacaaaggaataggatgttaaagttcctattggccttctatgcctccagttctataggagaattattcctacgaggaagcaccaatgttgtggtggtagagttgtgggtgtatgactctatccaccagggttcacaagaaatcctagtgctcacaagaaatattacacacatgtggatgagctttcaaaaaggatttttctgagatgagagatgtgtcgctggtttttatctactaaagcatgtgttaggtttcgtagaggatttttttgagatcagagatgggtcgctggtttttatctattaaagcatgtgttaggtttcgtaggggtgtgggtgtgatattacatgtgtagtgatgtatgtatgcatctgccgtgtaattgaaaaaaacaatcctatgcctaggtttcaaagagccctaaagaggttcatcctctaattgtttgagcatatgaagtcatttctataaaagaaaaaacatttttagatttgggtacccgttctctccaaccttacaacaaacaaagatcttatcatcttaagctaaagatgatgacaatactacaagacatacctcatggttaggcaatttctcggatcgtggatctgaaagaaagccactaacgactcgttctttcaagccctaatcctgccgatggaagccagacacgtggatattctccctcaccaaatcattctgtggctcttgattgctccagcctctttcttctccgatccctacctccttttttcttccccttcgtcgccgatcgaccattctcgcagcggccagaacacgcgtgctgtcatctcatcttgcccccaaacaggagctccatgaccaattttgcaaaagccactttctgcagcgacacaacgttcgcaactgcactgatgtttgctttattgttattgtattccttttctctggattagattgcaccgaactgtttggttgcccaaacggaagaggctgtaaacagtgagccactgttgctgatcgctttgtttgcttggtcacaaaaaatggctgcacatgctaattgccaggccgttactatccaacccgttggcaagtgtacagtgttgtttctggaagagaaaagagaatcgtttgcctgcaatttttttttcgctccacacaaagaaaagggaaatgggtcatgaatgaatagtaagtaaaccagacgagcaaatcagatgtgtgctggcgccatcgctcataaataaatggccttgttggatcaaatcatgaaaccgaattgcctttaacatcgcaatcgtatctaatagtagtagtagccagtagagtaaaatacacaaatacacagagtactagtagtacgtactcactcggtactcgtaaaggaagtcatttagaacaatgtttaagtcaaaacttaagaatataaatcataaataactcttaagttattgagtttgaaaatgtaaaaattatatgaatagatttgtattgaaaaatactttcatagaagtaaacatatatcacttttcaataaatatttttatagaaataaaaagtcaaagttgtattttgtagaccgtgtcgctgtgctaaaggacttcctttacgagtatggagggagtactagcactacttttatattgccacacatgacacatctctgactatgtgtaatcattccgttacaatttatacttatcaatttagaggtttgttctaaattaaacttatcttggccattaatttttaaaaaatcgtgtagtaagaattatatgctatagaagtatttataatggtgattggtagatcttatgatgtttgttaaactgtgtgaatttttaaaaagtagtcgttaaaaatataaatatttaaattaggataaatttagaacgatagctgatttaaaatagaggaaatacttcagctttgtttgcctcgcaaatcctaggatctgactggctgaagaaatatggttttttagctcgatcacggcgacgagatctaacactcctcggcgagctcaccggtggcacgcaggttgccgcgtagttcacgcccattggccactggtatactcacaaccatgtgacagctagatccgtgtgatttaccaggtcaaaaccacttctcgaccaatcagcatccgccaggtgtccaccgttttaccggcacctgcctggagagccattgtcctagtgcggagaaggatcggcaggtggcggtaacaaatcagcgtggacacctggcgtcacgccattggctagcacccactttcccgccgctccgcgtgcttataaaagagcccggccatggctgctcttgctcatctaccatttgcctcttcagcaacagcttagaattcagctcagtaaatctgttgattgctcgtttcaaatcatcatcggtgtttcgtttcttgatttcttgatccatccaggcgacgacagtggattggtgtggccgtggcagcaatcttcctgctgcgatgtatgacatggtggtggatagcaaggagctaatgggcgcgcttgctccgtccatggtgtccttctcctacccgtgttccgagcagagcgcgagctcgcttcttgctggcgccaactacctgactcccgcgcaggtgctccatgtccaggcgcagctacagcgcctgcgccgcccgggccggcgagcggctgcctcgccgggcgccgccgctccgatgaagcggcatggcgcggtggcggtggcggcggcggcggcggcgcgggcgccggtcaagctgtaccgcggcgtcaggcagcggcattggggcaagtgggtggcggagatccgcctgccgcgcaaccgcacccgcctctggctgggcaccttcgacaccgncgaggaggccgcgctggcgtacgacagcgccgcgttccgcctccgcggcgagtccgcgaggctcaacttccccgagctccgccgcggcggcgcccacctcggcccgccgctccacgccggggtcgacgccaagctccacgccatctgccacgggatggacctgccccaaccccaaccccaaacccagagcaatgcgacgacgacgacgatgtccacgaccgcgacgaacaccccaagccccttcttctcctcggagagcccggtggtcaagagcgagcccgtctgctccgcctccgagagctcttcctcggccgacggcgacgtgtcatcgacgggctcctccgacgtcgtcccggagatgcagctgctcgacttctcggaggcgccatgggacgagtccgagagcttcctgctgcacaagtacccgtcgctggagatcgactgggacgcgatcctttcctgatgcagtggctgaatcttcttcctctccctgttcttgatccagctcttggtgtcctgaacattttcacaactcagagagtgatgctctccttgattagctacatgttaatctaggttttgggtttgatcatgccatcgattctgtagcatcaacccctggtctgcttggttttttcaatggcattgccaggaaggaggtctcagtgctttggtttctgcgagttgtgcaaccctgcatgcaaactcttcattgtatataccaaatatttgaactctacattgtagtagttcatatatccaataaagaaccattttagcacattcaaacgtctaatggatcatattctgtcatatatatgttgcagttcaaacgagagatgg

SEQ ID NO: 6351 - DNA, 4076 bp, Oryza sativa
aaatagcagacagtttgccgtttcgcctatttgaagatatgacaaaccaaattcagatttcttctcagtatgatagagttaagtcccagtactcacctgcgcagatgtcaactgaacttttctgaaacaaaaaggtgcttgctttttttctctagagatgttgcggttctttgaaatgtacaaaagtacgtaaactttgatattcttctacaaatgtaagcttcttagacatcacttggcaattatctttacctttttttttccttgatgattcaagcatgtcattcctatggtgctatactgctatccgaatctctgtccgctggaactatacgattccaactagactagtttcattgttgcgctttctttacatttgatggaggctataaaatttgaattcaagactgaaaacctagtctaaatgctggcttgttggccgttgtaacaaatgcacttaccttctgattaacagtgctaaatatttatctgtgactgcagagaagtgcaagcatctggatctctgttttgcttatgattgtctaggactaacgagtcatgtgggcaagtcagttctccacgttatcactactttgctttggcttaatataatgctaatccaattccccaacacgagagagaagctaagttgtcattagctgccaataaccacaacggacatagttcctctcctagttcattgtacttgtacactgttcagagttcagcttaactttgtcgttgctgcaaaacaattgcttgcttttggacgatgcatgaaccttgagaaacgcattcgtgaagatggctgttagctctatctttgatgcattggaggacttcacatgagtttgatcagcacccttgtcttatctgtaatatcaaaaggagagtttaatttcttcccaaaaaaatagtttaattaaggaaaaacacatttacataataatattgtgtctactttcagtaatcacaatcttagctacaacaaagagttatattttacagccataaattctagccctactgagaaagtgagaaggtgtgaacatcaacatcaaggcccttacgagtgatgatatattttcttaattgtaaactactaatgctcaacttacatttccggctggtatatgtcactttacagatcagtatggtctatctcaaactttcttttggtggtcattttcatgctttagtccatcatggaatgaacctttcatgttttttttatgcatatcctctcatggcgctagccagagattgcagaaaagcattaatgctcagccattgtcaggtcaacccccataatcacccatggcccaaagtcaacacggtgctatattagcagagctgcagaggcactcaaggagattggacagagaagtccactatgttgccacctgccactgccataccaatccctgatggtccactgtcacagctttgggttgacttgttgggtgatttcaaagggcagaatatgaaaaaaggaaaaggttatgagctaatgcaaggattagttcaacgcttaaataaatgatctcttgaaaaaggtagctgctatggagggagaagccattacccaaccatgatccagaccaggccatgagttggtcatgacaagaagatacacttgacaaaggaaaaggctaaccttagggatgatgtatctaattacaatttacaaattatctgatcacgacataacactacaacaacagtgacacagtgtacctcagctcagtagccgttgactctagtgaacgagctctgcatgctttttcttcgaataagaaaaaggaaaaggagagatgttcattcttttcagttttttaatcataatgttaactgttaagctaggactccataagctgtttggatttgatttgcctggttgaccagatcaccagtgagagattggcgcagcaaccggcggattttgatctcaggtttgtggccggaactgcgaggagcaccagccggagaatgttgatctggtcgactagctttggtttccactagccgaactctgaaagtcagagaaaaaagagagacagtttatatgcgttttcagacttcagagttgtccttaccgtctctccttctcatacattagaaaggggaaaaatgtaaattcagtagtcggatttgcttcaagattcagaatgagacaggtgtctgatgaaatgggataacctgaaagtgaagcagtgaccatgatgatgcatgaacctcagctatgataaactctgcacctgcagattggaacagtgaacctgccatcatgcgcgtaccatgctgctgatcttaacaattatcatggtcctggacaaatacacgcatatcaacgtcgatcgagagccatcagccatccatgtcggcagcgcataaattttactgtcattgtcagtcaccatgccggcagagcaaggcctcgcatggttcctgacaaggcgatcgatcgatctattgcatgcgattcttgttgcttcgtgttgggcctgaatatacttggtatgccaggcccaatagctcaggacctcgcgaactgactgagctgaaaagcaaagtctattttactttccttctttgttgttccgattgaatcgcctccctcaatactaaaaaggggtataatgcctcttgcatctctgaaaatcgatacaaatcgactcattggatagtttaaaaagcaatttctgctcacgtgatatgttaacgtgctaagtcagtacgtgagacccacacgtttgttccaactaaaaactacacgaatccacgaagaaccaaaagtagtatttcttttcgataagccaaaaagggatcggatttgctatactactttttttttacgcattttttttaaaaaaaaaatttttgacgcaaaactatactacttgtgacagcatttttgctaaaaaaaacttccgaattgtgaactacccacgtgcttattccaacttaaaaactacacgaattcacgaagaattccagcccaaaagtagtctttcttttcgagaagcccaaaatggagcggatttgctaatactacgtacggcaattttttccccttaaaaaatttcgaattgtcgaccgttagatcgtgtctacgattcgtgcagatcggcgtgaggaaaaaagatcacactgcccacacgaggaagggaatcaatcctgcgaccttagatacagagcctgcgtgggctaaccacttggccacgaacgcttttcatgtaattacatgctatttatatataagttacaatgtaattacagtcttagttacaacataactacacctataatcatactatacttatatttagaggttttctaactgaaaatttgtcaaaagtactatagctacttccaaacggagcggagtccagcctagcccagcgtgtaattgaatcgatgctttagtccccgagttgaacataagcttgagaacatttgtccaaaattcacgccaagtcaagtcccagaatttggttcgtaaacaatttacacgcaaatctcatcaaagagtctggcaatttttacacgaattcgtatgaccctatccaagctcgttgtacatgtcgtcagtttccaaagcggctcttgcacgtttgcgaggagatgtgcacgtctttcctcagcccggcggcggtgatgtggcacgacacggccagcgtcctccgctcgaagccgagcgcgccggcgtgcacctgcacggcgaactcgacggcgaggtcgagcgtcacggcgcccttggagccgcggagcgccttctccaccgccctgggcgtgcggccgtcgcgctgcgtcccgtggagcagcacgttgaagcccatggcgtcctccccgccgtcctcgggctccccgacgccgcccttcgccagggcgttgcccttgtgcgccagcctcgccgtgccgcggccgccataccacagcgcggtcaccttgttcgggttgatcgccgtgaggaagaagtcgtaggccacgtggtgctgccgcgacgcgttggtgtgcacggagaggttgtcgacgacgaagctcggcgcgtccggccgcagcacgacggcggacag

SEQ ID NO: 6352 - DNA, 4744 bp, Oryza sativa
gcccgcccgaccgagtacgtacgtggtgggtgggttcggagcttgggatttgttcgctaaattcgttttcggcccagcccaatagaaccaagcccggcccagcaaagcttgtgggctgtaaatccagggatgagcccaactttgtgaaatctggtaaaagttggttgggctgagtctgcctgagtgcctggcctgagtcctgttatcagcatacagtggaaaaaaccggaccggaccggcggttcgaccggaaaaaatcggaaccagaggtgaccacggttcggtttcctttaaagaccgaacatgcaatcgaaccgctctgaaccagatgaaccggccggttttcggtgaaccggacactaaaccggcactggttggaccggctagccatactaatgggccacagtcggctgtttaaaggcccatttggtgcagctggtggtctttttttttttttggcaaaaatagcaagaaatggtgcgctacgtgggattcaaacctgggtccaaaggttacaagagcaaagagctagccatcaggccatccaacaacatgtgtatataagtgaatatgtaatatacatgtactttgtgaaccgcggttcgaccgcccgagtcactggttggaccggtggaccgttgaaccgagaggttggccggatcacttaccggtccggctttttttactatggttatcagggtttactccaggtatgtctcgttttagggacaaattaaacctttccaaaagttaatgtagctaaattttagtaaggattcataccatgagttttggtaaagttaagactgtaggagtcatatgtgggtatgtgtggtttgttgttgttttttttttgtgtgtgtaggtgatagatagatgttgaatcctggtaaggtattggttattcctcacgaaaattgataaattgataggttggaaatgtagtaaaccaccctagtcatatatccaaccgcgcctcctaattttccaccagtagatttagcatcacctatacgcatggtacggtccagtgaattggattgttgttccattatttttaaaagctacctgtatatataagaaaagttatatataaaaggagtactgtgtttgattgccagaaaatgaggctcttctcgcggagattttctggaccatgataatccactaattttaaggagcgctaaataatcattggataatctgtacttaggcggaaaatccttctataaaatactcagggcagggttaagaactcatgatatatgctatatgagcctttgagaggacaattcgatgtctccatactaactttagcctttgaatcataagaatggaaaaaccgagaaatagaaaaaatatatgattctaacataaatataaatataaaacagagaattgtaaaacacagaaatgacattttgattggatcacaggaaaaacatatgaatcagatgagatgatagatttaaaggaattattttaagaggattgcccatttcataggaattttgaaggatatgatataattcaatcctttgtttctaaggttttcatagggtttcttttcatatgaatgaaatcttttaaattttctatattttttctataaattaaaggtcccttaaattatttaggtccaatagaactcataatatttatattagacaatttagtatgaggcaagataccccttggtacggaagggcaagggcccacatatcgtgtgttatgcatcagcttaattacgagtggtcgtaattatcccgccaaaaactacacacatagtctttacgtgataccaaatactataatattgatatataggtaatcattgatgtatttttttttcgatgtatgataaagttttggtttataatatatttcttactatagaatttagcacaaaactcagcacgcggctattcacatactatcgccaaaagcctctccttcatgttaggcttctcatcagtaaatatatttttcaaacaaaaatcgtgaatcacgttttagatgccaagcatatgttagctgaatcttgtaaaacagtaataatcttcaggtctgatgcctcctacaaactcgaaaattccgatagaaagatctcagatattttgttctcatcacctcaaccgtatgtgtacgtgcaacgccgtataataacggattgtatcgttatacgcgtatatcggccgcggagcggaggcaaccccaggcatctcgggggggttggggggctatataaacccccccgccgctagtgcggcacggcgcatctccccttttgcatgcctcaccggcctctccacctccccctcctcctccgcctcccaatgctctagctgcttgctcccgattgatttgatttccccccttctccgagtctacgcgatctgcggattggccgtctccccactcttgattcagtccagggagttttgatctgaccggattttgcggtggggttttcttttttgggttgggttgatcttttgggtggtttgatctgtggtggcgatgatgtgtgcgaaggtggtggcggcggcggcggcggaggagagggagatggagttgctgctcagcgagatccctcaggtcaccgcgccgcatgggcagcgcggtggccgtggcggcggcggcggtggtggtggtggtgctgcccagtgctacggcttgcatggacctacgcgttaccatgcgcacgcgggggcgcccgcgcgctacggcggggatccgtgcttccccctggtcttgaaccgtcgcgacgatggtggtggccagcagggcggcgctcgcggcgccatccacgtgccgctatcggggggcttcgcgtcgtcgccggcgtcgagcacgtccgccggtagcgcgccgtcgccggggtcggaccggttcgtcggccgctcgccgtcgccgatggtgcaggcgacgaccgacgaggacacggagaggctggcgagccagctcgacggcttgcttgtcggggacgcgcccgccgcggacgcgctcgccgcagcgctcatgccgccgcagggctcgccggcgtccgccgccaagaacgtgtacctgccagatgtctccgcggtgcacggtgcgtataacaatggctacaactttggggagccgggttactcgcttcaccatgagcccggcgtattagctgatcaggccatggcgtccggttatgtcgccccatctcagtgctttccagtggacgtcggcttggatggctacggcggcttccctccaagcttgggtaccagtgttggcagcttcatgtacactaggactaggaacagctccggcattggttgggaacaagggctagtgcaccctgatcatgctcgaccggtcttgcttcctggacagtctggtgcagaacacaactgggggtacgctggtacgggtcagatttccctggactcccgtggcagaagtttgccaaaatcgccctacgaatacagtgttgcagcagcgagagacattgggtacatgaaaggtggtttcaatcaaatggagccattttgtgatgggaggaagaatgtgccttttctgaaccgtgcaaaggagaggagatttcagcagcatgtcaacaataggtcagttgagctggggagtcctggtatgctgatgtatgagaacatagttgagctggagagtcctaggatgctgaggtatgagaacatggttggagccaagggctatatctacttcatggccaaggaccagaatgggtgccggttcttgcaacaaaagtttgaggaagggaaagatcaagccgatctgatatttgaaggtatcatcgaccacattcctgaacttatggccaactcgtttgcaaattatcttgtacagaaactactagatgtgtgtgatgaggagcagaggctgagaattattgctgtactgactgaggaccctgtgaagctgctgagagtctctctaaactcgcacgggtaatgatcttttgttaaaaactgatatgtacttcaatatgatctgccattattaacttactaaaagaaagcgccgattgttgattggagaatgttgtaactttaggcaggaccaagtgtactttgatgctaacattgtaatagctactggacacaatgaatggtgatgatttcttttcatttatttcaggacaaggtcgatacagaaattgattgagactgttaaaaccaggaagcagatcatgctcattatttcggctctacaaccaggctttattcatcttgtcaatgatcctaatggtaatcatgttatacaaaaatgcctgaaaaattttgatgcagaagagaacaaggtactttggcaaatatctagtttgcaaactgatttttgttaactcttcttgactactacttgttatgccattgatttgagaattatctgttgtagttttgacagttgcacaccataagttagagcaacattctaaacacatggaatttattggctgtgtcctatcccatacaattttctcagtctgcatacaattttctcaatctggagcaaaacatttctgaaactgtagctatacctagcatcatgttctgaaacttgcatcgatactctatcagattgaagtaaagtaatttggtgttgtagatgtcactatatctttctataaacttggtcaacttaaagaagttgacttagaaaaattataggaacaaacatattcatactgtttacatagaaacttgctcatggagcaaatacaatctcttaccaattg

SEQ ID NO: 6353 - DNA, 3084 bp, Oryza sativa
attcctgcaccccgaatcgtcatgtagtttttgcagcacgccggcaacgctgtagcgttgtattttctttaaaatttctagttctttctgaactgcctgttctgtatcttctgtaatactctttttggttgtgctaaacggagtgaccattacatttcgtcaaagttgtcatacctgtgttatattacatagttgcatcttccaagagcatttcctcttcaatttggttaaatgaaatagatgcttgtgctattgggactttgaactgtgaagagtgactcatcaccatattttggtagagaaatttgcctcgtcaccatattttggtagacaaattttaggtacttgagaaaacatctcaaggtatttaaattttgaacttttcttttgaacgaacgaactaaaattatgcgttttggtaagagtacactttccaaaacatctcaagtcatcgttggaaatgttgtgtgggtcggagaaattggcatgcttcactctcgtcgaacgtacttctggtgttttgtgtgtaagtagtgttttgtgagtaagtacgacttcttgctatgcaaaggtaccctgaaatcctgaatcctgacgctcatggagtcatgactgtttcactctggtatccctttgacttggcatttgttttatgtgtaagtacgacttcttgctatgcaaaggtaccctgaatcctgacgctcacgagtcatgactgtttcactctggtatccctttgaattggcattttagccggctgatgcatatagggtgtgtttagttttttttttttttttggaaaattggaaccatgccattataattttgcgttccaattttccctagtttttttggcgtaaagtttttaaagtatatagacacacatttgaagtattaaacgtagaataataacaaaacaaattacagattccgcttgtaaactgcgagacgaatttattaagcctaattaatttgttattagcaaatgtttactataacatcatattatgaaatcatggcgtcgtctcacaattacatgcgaactgtgcaattggctttttctcccacatttaatgtcccatatatgtgtcaaatatttgatgtgatttttggctaaaagttttttaatctaaacacggccatagatggggaaatgaatccaagatgaacgtgactttcgtgtgctttgtgtatagtcaaccacctactttggatgcaaaggcaatgcttacaatgtaaagtgttgacaacagaaatttttttttttaaaaaaaaaaacagataaagagagtgaataaaaagaagaacgactccactggggatcgaacccagaatctctggttccgtagaccagcgccttatccattgggccatggagtcgctgatgggaggagcacaaatagttaataaataaaatgtagtgagatattttcaagtcaagcacatcacaaaataattaattaatgaatgaatatattttagagaacccatgttttatagtcaatagttacatagcaccctaaatattatgactagtggtgtatgaccctatatattatggcccaccccaatacatgtaaagtacagtagctgtttacttaaaatttgaaaatataaagtgtttatgaaaattttaattattcatttcttgattaaggcagttggtttttaacgactcttcactactttaaaaagtattgtttcatatatcctaaaactaattgagatttaaatgaaatattatttcataatcctaaagctaagttcttgtgctttgatacgactagaaggaaaaaaaaatatcatagtattgcctaaaataaataaaatcataattttcatgaaatttgtttccgtctttttgttatagagaatactcaccttagtttgattttatatgtaactatccatttatagttagttggtatgtaatgttaaatttgttgacctctttttgttatagagaatactcactttagtttgattttatacgcaactaaccatttagagttatgttaaatttgttgcccacttttttgttatagagaatactcactttagtttgattttatatgtagctatccgtttatggttgccacaaatcataatatatcctaatatatatggtattttaaacttttggcacaacttataggttctctgaaatttactttttaaaaaacttcagtacagaattacagataggttttctatataagcatgtttatttttttccaaaattaaggacaattacagttctttgtccggcacataatgtcgttgtagtatagtggtgagtattcccgcctgtcacgcgggtgacccgggttcgatccccggcaacggcgatttttattttattttaccctttttggggtgctttggccatagattatgcggtataaaacatagaaacttcagggaatttttgtctgtttcaaacctagatgccgctgttaaaaattacacataaatattctctatactcgaatcggcactgacaatccaagctacctgaaattcactgtgtgtactaatttgaagtctgaactctgaagcgacctcgatttccctgaatacaaaactctcagcaggaacaaccgcctgctttctgttcttcttgtgcttctgcccctgaaggtatttgcccggaggcagcaggccgtaggtttatgtccaccatgtcttcctgctttgccgatgagagcgcctccattccaggcagcgatgcagcgatcttgcgaaacagtggctgtggttcaagttttcaatcagttaccatcaggtgttttgagcaatgatggacaagaacagtggtagatttgcttgtcaaagtgaaacaaagtaaaggctggagaccttgatgttgaatccagcttttgcgctggtttccatgaacatggcgccgtgctcctgtgccttggcttctccttcgtcagtggatatttgcctgttgacattccaatcgacagaaaggagtaggttaactgatatacctcaattttttaatatatcacaccgttgacttttttttttaaaaaaataattatctttcgtcttattcaattttttttaaaaaataaa

SEQ ID NO: 6354 - DNA, 9085 bp, Oryza sativa
aattcctgcagccctatttaattttgggagcagctggtacttttatgtaaacttaatgaactgctgatttaagaactaaataccgacagatactaacctcttgtcaacaaggtctgttttatttccaacaaggacgatgatcacatctccgcctcgttgtgtatttacctcttcaatccacttcgatatactcaaaaaggactgcctgtctgaaaacaaggacgatatgagaccacaaaacaaatatacagtggattatattatattttctgataaatttgtattccaagggtatcggcaattcgccaatccctgattcagtgacatgttcagaataggtgccaaccttgttagagcaaaagcactgtagtttacaagagcactggagggcaaaggatcacaaattctttctagttacaacagcagagagaaaagggtgtagatgaagttaacttgccagtcacatcgtaaacaatcactgccacagaagaatccctgatgtaacttgggatcaagctccggaacctctcctgcccagctgtatccctgcacattatcatcaccataaaactctcccggtttttactagctgaaaacctcccagttttcactagctgaattgtcttgtgcgcgtgatttcagttcaccaggaaaggataaaaaaagggcaacaattgagcattaatattgcctccatcagcaaaacgaaatcaacgtaattgagggtggaactgagactaaaaatcaagacttcgaaactagtaggcactaggattatatggtaataaagcaggttgtgcagagtaaaatcggtgatcggacaagtaacagcagctaagctgcaccaactgaattctcgtaagcaggacaagcttgataagcagagtatgatgataggggaaaaacaaagagagagagttttcagaatctcagataccaaagctgcagccgtacggttcggtcttcgaggtacatcgtcttggagaggaaatcgatcccgatcgtcgcctgcacgccgccgccgccgccgcaacaacatgaacaccgtcaaattcatcgaacaaaccttgcccaaaaaagaaaaaaaactggaactctctccagcgcgtaagatcgatcgatcggggacgcgcgcgacatcaacgaacctggtaggtggcgtcgaacttgtcgtacatgaagcgggtgatgatggccgtcttccccaccgcctggtcgccgaggaacaccagcttgtacttggccagcgccgacaccaccggcgccatcacagcacgccgacgcctagcctaccctgcgctgcgctgatcgattccgcgtgtgggaggagagaattggggcttcgaaaatttcgaaatcgagtttgagctttcttgtttcggagtttggacgaacgcgtgcagatgatggaaaagaggaaggtgtaaaggaggaggaacgaggtgggcttgctttgaacggagaaggaaagaggcgacttttgcgtttcgaagcttttgtttttgttttttttataataaaaaaaagagttggtaggtcgatgtaatagagtgagaatacgttcaaccttggggagtccgggcgttgactctatctatgaaccatacgaaacgttacatgttcatgtttgaattctcatgaatttctttcaaaaacagttggttttcagctgtaaccgccgtaagacgacagtttcttcgtttccagagatgctgcttgcgtgtactacaatcgcagcagcctactcgaccaagttgatcttttcttccgatggctgaccccagcacatatttttcagccagcaagatatatataccatgaaaaagaaaataaactcaaaaccctcgtgccaaaacggaccacaactcgtgcgggccaaacgggccagcccaaaactctaagccgggcccgtccaaacgcaccgtcctagctgggccggaaaatgagcccgtgtagaatgccagtggatgtcaaacaggccgagcgaaagtacgagacggtcagcgactcgaatttttttcatttttaaatttttatttttttaatatttacagaaatattgtaccggtgaaaatatttacagaagtagaccctgcagccctcggggagggcggcagggtgacgtgagggacgcataagatgaaaaaaaaactagaaaaatacatttttagcatagcgaaattacatttgcccccttgcaacccttgtagagggcggcaagggatctcagtgcaacatgcgcacaccttgacgccctccacttgagcggcaggggccatttctgtaaatattttggatggtacaatatttctgtaaatattaaaaagtaaaaatttaaaaatgaaaaaaattccagcgactcggcgtgtacagaacagaactaccgaggcgcgccctgcctaactcagaagtcttaactgatttggcaacttaaaagtcttaactgattgagatccactccggtgccttctacttgtagtagaaaataatctgaaccgttgatctcatttgatcatagggttcagatctatttctactaccatcacacttaatgatagtagaattgtagagggatatttttgtccataaaaaattatttgcatagggatattttcgtctttcccgggctccagctgccgccgccccgcgtgctgctcctcctgctggccatccatgtcaccaccgccacccgctcgccaccgcgacgactcgcaaggggaagcttcatgaactggatcgctggaatgggtttcacgcagaattccagcgagatggccctattcacgttacattagctcgggtaaagaggaagcaaaccacaaatttaatggaccaggctcacggaagtttagctacttcttttcatagcaaattcaggttcttgattctggtatagcaatagagcatactgtccatgtccaaattaaattcttattcagattcagaatcagattcttgattctggtgaagtcatccacgaaaattaacattaccgtgcctgctgatgctgaggctacagaaactcctactctcccgcaccagcctcctcaacagccggctccacgcacgcctgtagctgtcgtcgcagttgccgccgccgccggcggcgtcgcgcgagaggaggtagaaccatgcggggctcctctgcaccaccgcccctgtgcgcacgccggaagtcgtcagggcggcgccagaagctcctgcggcggggaagcggacgccggcagagaagggaacagaacaagagggggcgccggagagtattgccgccggcggaagggaacgtgatgcacaagcgccggcagcggaaggagtcgctctctccacctccgctcgaatgcgatggatgaggaagcggtggcagcgctgcttttcctgaaacatccgagcgatccacgacgagaaataaattaagtgccaaatttatcccaaatctatctcagaactttactaatctacccttaaaaatagacggttcagattagttctactcgtagtataatactaccagtagaaagcaccggagcattgctctaactgatttggtagggtctcaataaaaactgatttagcaggggaactgtattaagctagcgttacagctgacagatacacttgacagtaaataaactgtgcagcataaaaacggacacggacacgggtggattaattggcacgccaaagtagatgcacatatacgtctatatactttaactagctagtcgggcctgataacagtgacacaaacagtgcgttagcgtaacaacataggggcaaaacggcatctcaaccatcgatcaacagtaacagtagtactcagcagagtaactagtatagacgtagtctactagacaaatactagtactatgagcctcactccggtgctttctacttgtagtagaaaataatctgagccgttgatcgtatataatcgtcaggttgagatctagttctactaccaccacgcttagtggtagtagaaacatggaggggtatatttgttcatagataataattcacgtaagggtattattgtaaattattattcagtaactctacaccttcgcccttctcaagcgcctgaccccatccatcgtcgacttcgtcgcctgtgcatctccctctccgcctccatcatctccagcgcgatcgacatctcctccctctctagcgaccaagggtggcccttctcctcttcgccgagccgctgaaggtccttgcccacggcggacgactagtcctgccatgtagctttgaccaagacagaggagatagccgggcaattggacagcggacgacgttcgacgggttccggcgaacggctgcgaggtaggaggaatgggcaactgtgaatgaacgagtgtagtatggggatgtggtggacggctcggattgtctaagaaatgagctacggcagccggcgatgtgcggtggcggagctcgagtgaggcggtggcatttggtcgccgccggcgaccgtacgagcggctaagggacttgggaatgaggcgtttggatgctacatgaatagggactgtgcatgacttcactagctgccgcggagctaatgcaaatgcttttgcataaacacgacagtagaccagggagtttgcagcaaagagtgaatcaagatgttctaagcccccattagtagacattgtcctatgacttgaaaaaaaaattcaatctagtggcaattgagcgcttagctacccccatatgagcaaaagaaaggaatcatgtagcgatgattcagagcaccagaatatgacaaaatgcaattagatgtttcaatggtatgaaatataaaacaaatcctgaattacagctctgactgaaatgcaatttacatatgggcaaaactctgatagtgaaaaatctcatttaagcagtttatcagattttttcagtctcactttttcaggagcaaaacaacttgtttactgatccaggagcaggatggcatatttcagttcaaattgcctggactcttctcaccccatcacagttgcacacaaaaaaatgcacaacacactgacatggtcaacacattgacattactagtagtccctcactattcaccttttcttttttacttgaaccattactgaacaatgaatatattgggacagtcacaagatccaataaacaacaatatctcaaacctcgtcaattagtcaatgaagtattcgacacataacaccatacaactgaatattacaagcagaatgaactgggcaggccttcttgttgtcactgaaccactttgcagtgttgcaatcctcgtggaagtcatgcccgcaggagagcgtgcggacatcatcgccggccaccatcctgagctagcagatcgggtatgccgcatgcatcgttcagcgcccgatccagtgtcctgacgccgccgagagcacggatgtgctgaaacctctgagcattgcggtctatcaggttcgccggcgacgccttccacggcagcacgcagcgagcgacactgttgcatattctgaatctcatgccttgctcgcggtcgaggaggtgctcgccatgcaagccacaagactcgggcacgcacggaggggaaccggggagccggaatgtatcgcagttgcctcccaagtggccgcagcccacacaatcggggcaacacggaatggagatcactacccgccggcggaatggattgaatcctccaaagtgggcactgccaagaatctcaggtcttgcgcaggggctccggtggaatcggacgcgcgcggaaggccactcgcagcggacagaaggccacgacggcgaaccaggatgccggcgtggaatacaggagaggagggggaacggatagacaggtgagaggtgggaggaggggacgcctgagggtttcgccgcgccgcgccgcgccgccgcgtgctgggaggagtagtgattagcaacgtgcgtcgggcgagatgttgtgcttgcgtcggacctgacgcgatcaagccaagaccgaccgagacagagaaaattgatccggccaaaattactcctaatatatattaggagattactaatctaccctttaaaatgaacggtcgggattaattttacttgtagtataatactacaagtagaaagcaccggagcattgctcctagtactatacattatacactgtgctccacattatacgcccacgcatgttgacacgccaggatgtacaatcgatatagatataggcgagccagagagagtgggtgtgagggtgatcgatcgatgcatgcgtgtattccatgcattatccgctgctgcaactgcaagcactcgattgatcgattcacagtcactagtcgcgtccgtatcaacagtgcggcgcaggcacacattgcaggtccgtaggaggtgccggcgaagaaggagatcatctaaaatttaattacttctccttaattttgagttactgataaaatagaggatttacatgccagtgacctcgtcagaaaatcttaatatccggtgctagtcggccggctccgttcgccgacgaagttacggcgggcggcgggggtcagtgtacgcgcgccgtcgacgagcgcggccggccggtgcacgtacgcgtacggggcgccgtagttatcgcagccttaaatacggcaacccaacttaagcctctgaccggccggccacacccggtagctatagagctagcttgcgctgtacgctgtgcatgcagtgtgtgcagcaacggcgacaagtaactagccactcctccgaatttattgtctctcgagtataattgagctctcctactcctgcactgcacacaccagtcgtcgttcgtacagtactatcatcaagttattagcagcagcagtagtaattgatcgcgagtaaatagtattgtacgtacgtggggaattattgtatttggagaggaactgatcggagtgtacgtcggtatcatgtctcctgtttgtgcgatacatattcagagattcagtcgtcgatcgtgttcgatttcatggcatctacttactcatctgcatgcgtcggcaggtcattggcagtccaaacctaattaattaatggactgttaagttcggcaggttcatgctcgatcgcgtacatgcatgcatatatccctagatgcagtagaaatgctggctagatcgacttgctaacagaacatcattggcgtgtgcatatgcatgcatgcattccagcgtacacagtggctagctaatagcaaagctatcattgatagagagtactagcgcgcatgagtagtacttgcgtttgcgacatatttccgtacgcagaaatttcctatggattgatttctactgtgtgcatataaaaaaaacagggcttaattagtttttgtcgctaggtcgtgcagcagttaatatgaatgtttcagatcaacgtcggtacctacacaagcgccggtcatccaaaaactacgtacagtaaaagcatagtactacctctattctaaaatataagtataattaaaaatgtttacattttaagacgaagttagtggtatctataacctcgaaggctcgcgatcgaaccctccatcgtaatggcattgagagtagtattatattgcaacaatggatgagtggaagaaaatatgtaattttttattatccatcacaagaacaggaaactgagagtgcaatcaacgccatcatctactccagttcgacacatgcgtgaacaggagtcatcaggagagagatcgatcagatcagatcagatcatcagagcagcagctagcaaatctagctagcgcacgtgcgatcgtggcacggacatgcatgggcgcgctccacgacgatgatctattgatctgagacggccgcgacgcatcggacggtcaggattatattacgtggtttctgcctctctctggttagcgagatcaacgtcgtcgatcgtctcgtcgccatgccatgttgcgttgcgtgctggcaggttgaatggggcgccgacgttgcgtgcgcggacgcgcattgaagcgagaattgaaggggaagttaatgggagccggtggactcggagcagcagcatgacgccatgacctatatacttccagcatttaaatgttgcgcgagagaggggggtcgagttcttaatttcccccctcttgacgggccgagtttagatcgaaactttttctttaaacttctaacttttccatcacattaaaactttcctacacacacaaactttcaatttttccatcacatcgttccaatttcaaccaaattctaattttaacgtgaactaaacacttttgttttctcgtaaggatgcaaggttcaaaaatatccccacttgtacccaaatctaggctgttctcatatgcatatatatggtcccggtatacctgatcacctctcctcctatcttcttcctcatcgatgaatttcatgccaacttcctacacatggcattttcggtcgattttgctatgctatattattattagcatgttttagatatatagttcacggctacgaatttttttccccgtctataacaattctaatattttcctttttccaaattttatactactataaaggaaattaactattaatcatgactttttattccatagtataactgtctatttgtatccctattcactaccgtgcttatggacttatccctaaggcttgctatcgccctaccttattgcactaggagggatcacatctcttcctatattaagtttttttttatggagagagtaggctttaagcctttaaagattgtttcttcctcccatccccacctactctaatcccttgtaaggttgtcaaaaatcttgattactttacgacttctattacgatcttaattaaggtggctgattttaagattttatatttgtcatctatacgatttcacaatttttgatatacaattatatgattacaatcataactaaaaatttcatttctaattaatttaggatagtaattttaacaaccttgctcctttttaagtatatcgagttgcagtcatacagatatatagttacagagagtacaacttttatggtctagaattttttaaaaacaaatatttgagaaat

SEQ ID NO: 6355 - DNA, 1042 bp, Oryza sativa
tttggccaaattttgttctctaacacctatgtactgagttagtcctacagtatgtatgtagcttcttgaaatgttcctacttcctcaacacttgtatatgaattagaacttcaaaatgtagattatccatataccatgtcagtgctttatttctttttaatgctgtagctcatttctcacattaaaaagctattttttctgtttgacaattatgtataacaattcaaaacttctgaacatcccaaaccactctgatagcagcttagccattcacacgtgttgttgaaaaattactcataactcatgtatatatgcatgttaaattctcagtgcttgacgtaatctgttgcatctcacaaacagatcatttatgacggtgctgacactcactacaagaattctctgaatgttttaacgtgtactctttgctgacttgagttgaaaacatctgcaaccaaatctatcttgtagtcattagtcaaggactccacataaaggatttttatttatgttcgtactttgagattagtttattgatatttttatgatgttcgctgacatgtaaatccacaaactaaaattctttcctgtttccccttattacaggaattatgtgatccaatatgtcctggatctgaaaattccttttgcaaatgcacagctggcatctctgtttcaaggaaattatgtgtatctttcgaagcaaaaggtgggcagcaatgtggtggagaaatgcttgaaggttttcccagatgatgacaaagctgccataatatgggaattaatctcagcctcccattttgagcaactgctgcaagacccttacgcaaactatgtcattcatacggctcttgtgcagaccagggtaagtactagttcttttgaatttgacagcgcattatgttcaacatcttctaatcttactgttcttgatagggccatctccgcagcgctcttgttaacgcaatcctcccccatgaggaagctattcggaccaatccctgttgtaagagaatctctaaagtcctctctaggaggtaag

SEQ ID NO: 6356 - DNA, 1043 bp, Oryza sativa
  unsure (1)..(1043): unsure at all n locations
cttccaaaggtccgggtcatctcgtgtaaccagggctttacctgttcatattctgagaagccacgcatgccgatcgttctttaagctccggaatttgtgagcaaggtaggttggcttccagcgaagcaagaatccacgactactatgcttaggtcaaggcttttatctgttgattagtttgggtggaatccccggacttcaagagtgttgcaatggctttttcgacttagagcatcgcggaccacgttggcctaaccaggatgatagtgaattcccacatcataatccttgatgagttctaaccatcttctctgccgaagattcagatccgactgagtgaagatgtatttcaaactcttatgatcagtatatatttcacagcgattcccaatgagatagtgccgccagatttttagagcatgaaccatcgcggctaactccaaatcatgggtagggtagttgccttcatgaggccgtagctggcgtgaggcataggccaccacatgaccttcctgcatgagcacgcaccccaatccttggcgcgaagcgtcacaatacaccatgaagtccttgcgagtatccggtaagattaaaaccggcgaggaaaccagcttttccttgagagtttggaacgccttctcgcattgcgggctccacacaaatttctcttctttcttcaacaactgtgtcatgggtcgagcgattttggagaagttctcgatgaacctccagtagtatcctgccaaacctaagaaactgcgaatttgagtgactgtcttgggttgcttccaatcggtgacggcggtcactgtttcggggtccacagcaactcatttagcagatatcacgtgccctaagaatttgacttcggacaaccagaactcacacttgctaagtttggcatacaattgatgttcccgcaactttcccaacaccagacggagatggtgctgatggtcttcctctgattgtgagtataccaaaatgtcatcaatgnnnnnnnnnnnnnnnnnnnnnnnnnnnnnntacncatcaactctctg

SEQ ID NO: 6357 - DNA, 768 bp, Oryza sativa
cggccccgtttgaaggttgaatcggcttcgtctgcaagtagttcatcattacctttgtttattgtgtgctccatgggttgtagagatacgcaacacgtggtgatagctccgttcatactttgtaatgattcacattcaggtacatcatagagctataggcctgattcgtttggcaaaccatggaaaagccagtgccctaagcaagtgatagagttttaccttaacttaattcaagattattaacccatctggatcctctctatccccctcctaccattaaattgttgtccctggatgaacctgtttccttgattttacacacttgttccctgagattcgatatggttaagtgctacagcagtatccgtgcgcttgcgtatttatctgtgagtaataaatatcaatataagaatttctggcggtgttactatggaacagttgttatattatcttcaaacctagtttgccttcttatcttatctttttatatttcttttcttttctttccataatggacaacttttatatgaattgttccaagggcagtttgtgaggcagcaccttataaaaattaattttaaattttgatttaaacttggcttgctttatagccatccagaccaatcctttcggggtgcgatggctaatgatgactacggaccatttgataaggccagggaaaagtggttctgggggaaattgtttccgttccaattccaacaaaacaagccgaaggttaatggaaagccgggggctagagagggcaac

SEQ ID NO: 6358 - DNA, 12113 bp, Oryza sativa
  unsure (1)..(12113): unsure at all n locations
cccttaagttccgcttaacgtgtggaacaaaggccccgccgggtgcgcgccggttgcgcccgtttcacgttgaccggtagcctacggcttggcccccaccncggtggaccggtcccgcgcgcccctccctcgggttgacccaataaatccatttttaatttaaaatttaaatgaagaatttcgcaaatattcatttaaagagcatataaactcaaatgggccaataattgggcaatttgaactcggaaattggaccgtcaagtcttctatttttcctttagaaagtcaagaacccattttttgtgcttttgtttttgcctgattatatggagtttattagagtaaaaacctttttttttccgttggtcgtgtagacgctgcagcttcggaagatccgctcttcgtggaagttgaagccgacgtttgggaaagcgagcaaggcaagtcacatcatcctataacatattgaatcccagtttataaaattattttgatttaaattattgcattatcgctttatttaaattcccgcgttatcactgttttatctagccatgcctatttacctttgttatgaccttattattgtgattgttattattaccttgttcaccctagaataaacaaaaccccaactagtggacactctactcatggtaccactagtatgattttaggtagatgcttcgctgtttaattaggtaacattaggtggttttacaactctagactttgggaatattctcatcacctggacacattggaattgttggattattgtggaattggattcacacctctccctctattcaaaatccccaaaatggttttaggctgggctcggggtgcatggttttgatagtagcaccacggccatataaggaccggtcttcgggcctctgttgcaaagcactaccgtacttccacatgtctagtgggtaaggcttagtttgtggctcagtctggttataaacaaaagtacacggagcaatgtacccaagttagtgttttcattcttaaaacctgcttaacaactaaaacgtggaacggttggccatggttggcttgggacgagctgggacccagggtcgggttgccagttcggtctgaatcatcgtaggccttgggttaaggcaggttcgtgtgggttcacggccttgataaataataatgtatagttctagaatcgtgtttacaaaatagctttgagcaactaaatgtctttaaatgctgtttactgcaaaccctaatcctttatattatgattcccttgtactcccttgcatttattctgcacttgtgggtgtgtcttgttgagtacggtggttgtactcagtcttgctcaatttttcccaaacccagaagaggagcccctagaagttgaaggctttggtgtctagctcgtgcctgccgtcaagcgcctgtggtcgtcgccctagtcttccgctgtttcccgtttgtctttgtgtgtgctgggccttcgtcgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacaagttggtatcagagcccccttgaccctaggacgagccgtagatcccaagccttagcaatattttcaaaataaaaatcctgtcttatttgtgaaaattctctagtctctctctgtcctgctgcttcatttattgtcaaaatctgacctttaaaatgttgcttttctttttgtttttgtttgtagatggccggtagcatcaaccgtcgtggtctggacctgactggcttcgttttggagctgcggggcatgtgcgttgtcctggggtatccgcatggagtggactaccagggcaggcagctcccggagcaggagggtgacgatgcagagctccacgctgcttgggaggttactgcagtgatcctcactggctcacccgagaggacttcgttgacagtcaccgcgggtggagattctttcttcgctgcttgccagaacgccgcactcctcgccatcggcactcttcaccagcgctacccggacgagttgcagcactcgccctaccgctaccaccctcgtcgcggaggagcccgcgactacgccaccttccgggatgctagctcggaggatgacactaccatcatgcatctggcgcgcatggtggaggcgtacgacgcggctcgtatcgacttccatcagatggtgcgccgtgggatggtcgagaacaacatgaagatcctggagctgcgtcaggagaatctgcagctgaagaaggatctagacgcagtggaggcgcagctgcatcagctcaagatcgcccagggagaggtctgtcgccccaagcgtcgccgcgtctgccgcagccagaagatcaccacccgcaagagcacctccaggcccgagcttgttcgccagtccttggcatggacctgcttcgtggagacccctcgtgccgagcccgcgcccgtggttcctcaggagggggaagcctccggcgttggtagcacggaggatgcgctgctgctcaccttccgtcctggcccgtcgcagcggtagacgagcagttagtaggcttgcgcgtgtgttctttctcgtttgtcttcttgttggagtcgtgtggggcatggttatgccggtgtgtggtataactgtgtcggagcctgtctttattttatttgcctaagcaacttgaactttaatgaaccaatttaatagcagtaataaattcaagaattatggtaatcgtgggtggttagctttaattgtcagctctctctgtttgctggttctgtgtggggttttcagatggtgacgaccaggagaaatgctaatacaggtgatggcaaccaacccgaaggcagcaaccacaacaaccatggcagcccacctctacctcctcctccgcctccaccaccaccaccagacaccaacgccattctcacccaaatcctcgcccagcaggccaacatgatggctgctttcctccaccacatccaacatccgccacaacataatgctccaccaccacccccacaacactccaaactcgccgagttcctccgcatccgtccaccaaccttctctagctccaataaccccgtggatgcgttggattggttgcatgccgtggggaaaaagttagacaccgtgcagtgcagcgatgaggagaaagtcatcttcgccgcccaccaactgcaggggcccgcatctctatggtgggaccatttccaggctacgctgccagaggggcagcctattacttgggcccgcttcaccgccgctttccggaggacccatgtgcccgccggagtcatggcccttaagaaaagggaattccgagagttgaagcaaggcaaccgcttcgtgatggagtatttgcatgagtttaacaacctggcccggtacgccccggaggatgtacgggaagatgaggaaaagcaggagaagttcttggcaggaatggatcctgagctgtccgtccgtctagtctccggggactatccggatttccaacgtctggtggacaagagcatccgcttggaagccaagcacaaggaactggagtcgcacaagcgtcgcttggcgagtttccgcaaccaacagggggctaaccaaagggtccgctacaccaatccctatccagggggatcctcttcacagcagcagcaacctcgctccgcgccccgacctcaattcgtggtgcgcgtcccacagccgcagcaacagcagagtcagcaagggacttgtgcgccccgtcctccaacgccagccgcgcagcttggtcaaggccgcagggacgttcaaggtccgcagcgtctgtgcttcaactgcttcgagcctgggcactttgcggataaatacccaaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcattcattccatccctgctaccattttgttcgactctggagcttctaactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttcctcggatctgattcttctagacaccaagaacttggatgtgatccttgggatgaattggttggctcaattccaaggagtagtggattgtgcaagacgcactgtcactctgtaccgagggccggaacaaccggttgttttctttgcacccccaacctctgtcagtagttctgtcacgtcctgataaattcatcccgaaataaaaatcattcgctaaaaggaataatagaattaattaaaattcgaaaagaaattggcaaacactaaaaatacgtacaagaaaaattcaaatgtggcccggagaatttttgttaaattctccttggtctaaaaggagccctcaaattttacttgaattttcagagcaccggaaataattattaagcaacaaaaacaattaacaaagtttattaaaaagaaaacctaaaaaataatcctcctcttcctttgggccaagtttggcccaaagtctcccctctctctctttcggcccgccgccgaagtctccctttcctccctctctttctctccctctccttctctccctccttctcttgggccccccttcccctcggcccagctccctcctccctctctctcccgggctgcctttcccccccctcccctcccggcctgcccggcccaagccgcctctccccccccctctcttcctgggccggccgcccgacccaagccgcccctgcccgagccgccccctccttccctcatgcacgcgcgccgcacgtgcgctgacgccgcgcgcctcccgcgtgggacccgcctgtcaggcgcgtccccgacctccagccgccggccttcttcctctccctcccgtgaaccctagcgccattcctcctctaaatccgctctattcaagccggctctttccaaattgattgggggcaattaatccccattgattcctcttcgatttcccccgttttcccccttgaatgccgcccccaatcgccgggaacgcccgcgtcttcctcggccgccctccattgccgccggccgtggttctcgccgccgttccgacctcccccgtggccggttccctctcctctcctataaaatagaaccccctctttgcgttctaccgttttggtctcttcccaagctctcccgtggtctctagccacctccccaccgtcgccctctctctcccacgttgccggccgcctccagccgcctgtgccgcctcgaccgtgcgccggccggccgcgccgtcgcctcctccagcgtcgccgccacctcctccaccccggcctgccctccgtttcgcgcggtgaccatcggaggcgcactcccgccgtcgcccttctcattcctccttgccggccacctccagccgcacctcccgcctcgcccgtgcaccctccggccgcgccgccacctctcccggcgtcgcagccgcctcctctttcccggcttcgcctccgtttcgcggggaaatcaccggagacgcgtcctcgccggcgtccagtggcgtcgccaccacttctccgcctccggccgcctctgccgcgtccccggtgcgccggccgacgtcgccgtctcctccgttgacgtcgcagtgccgtcctctctcccggccaggccacggcgtcgcccgaatttcgccggaacgccgtcgtctccgcgccggcctctccttcctcctcgtcggctcgccaccccgctgcaccaccaccttcaccaacatcgcagcggcgtgttccacgccgtcccctcctccgctcagccgctgctgcctgccatcatcgtttcatcgtcgtctccgatcgttctcgtcgtcgacgtcccatcggtcgcccggctcgtcgtctcgcggcgccgcctccgtcgtcggcatcgtagcggcgtgttcctcgccgtcctcgtccccgtgcagccgctgccggctgtcctcgtcgcctcctcgccggtcccggtcgtcgtcgtcgtcgtcgtcctctcgtcgttcccggtcatcgtggcgttcgtccctccgtcgagccgttctcgtccgtcgtccgcgtccgtcaagcaagccgcggcagccccgtcgtcgtcttcgtcctcggctccgcgtcgtcaagcctcgtgccggccgcgtctcgccttcgcccaaggatcgccaccgaagccgtcccctcgccgttcgtctccgttgtgcccgtctgtctccgccgcgcccgttcgtcgttgtcgttcccacgcctcgtcgcgtggtggtaaggttccctctccctcgctgctctgtcctcgtcctttcggtgtcgcccgtgcccgttgtgcggttgtcggccccggtacccgtgtatcggcgtcggcagtcgttcgcttgtgcgcgtggtgaccgtgttagtgtgtccgctcggtagccgcgtggtttccacgtgtgcagtccgtgtggtgtctagtggagtccgtttgtcggccactcgcctcggttgacacacgggatccgcttccgtcgacccgtggaccgactctgtgtactcggtctaccgcgatcctttaggttgacatgtggggtccgcatgttaacggcgcagccttcctgtcttttccaggctagcgcttacacctgttttatagttgcaaagcctaattataataatccgcaaatctccatataacagcattaaacttcggatgatcatatcttggtcatacgaactctgaatcgacccgttcaagtctcctaatgtttgttataacctaaagaaccctgtgctttctttttatgtgttgttattgcttctttataggcttgtagctttgcttgtgtgcttcgcgtagcttctgtcgttccggaggttcccgaagcgtggttcgtggtcgtcgccgtaggttcggaaggccgttctctctgagcaaggcaagtcacatcatccttgaacatattgaatcccagtttgtaaaattatgttgatttaaattattgcattatcgctttatttaaattcccgcgttatcactgttttatctagccatacctatttacctttgttatgaccttattattattgttattgttattattaccttgttcaccctaggttaaacaaaaccccaactagtgggtactctatttatggttccactagtatgaatttaggtagatgtttcgctgtttaataggacaacattaggtggttttataactttagactttgggaattctcatatcatttggacactatggaatggttggcttatgttggaattggatacacacctcccccgctattcaaaaccccccaaaacggttttaggctgggctcgaggtgcgtggttgggttttgttagtcgtacctcgggcactataaggattaagctcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcgtggcagagggttggtgccctgctgctagggggctcaatcctgcctacctgtcccgggggttccggccgtagggggattgggtcggtactcttgtttatggctaggatgggttgggaactatgtcacgtcttccgtccgtataccgtggtggtatgtggcacgtggtcgcacgtgaggaagatgtgtcttgtgggtaaagatgtacacctctgatcagagtataatctattcgaatagccgcgccctcggttatgggcaagccgagcaatgtacccaagtcagtgtttcaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctataggatcgtctttataaaatggctttggggcaactaagtgacttttaaaggctgtttactgcaaaacttaacctctatattattacccccttgtactcctttgcattaattgtgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggcgtgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagttcagaacttcatcagataggacagtcaaaaatccccatcgtcagagagttcggagacgtgtttccggaagaactacccggtatgccgcccaagcgagagattgagttccggatagatcttgctccaggaaccactcctctgtacaagcgaccctaccgtatggcagcaaatgaactggccgaagttaagaaatagttggaagagttgaaagaaaaggggtacatacgtccgagtacttctccctggggtgctcctgtgatttttgtggagaagaaagacaagacgaagaggatgtgcgttgactacagagctttcaatgaagtcaccatcaaaaacaagtaccctcttccccggatcgatgatctgttcgatcagcttaaaggtgccacggtattctccaagattgatcttcgttccggatatcaccagttgcgcatccgtgaagcaaatatcctgaagaccgcattcaccacgcgatacggactgtatgaattcacggtgatctcattcggtttaaccaatgctcctgccttcttcatgaacttaatgaacaaagtgttcatggaatacttggataagtttgttgtggttttcattgatgacattttggtatactcacaatcagaggaagaccatcagcaccatctccgtctggtgttgggaaagttgcgggaacatcaattgtatgccaaacttagcaagtgtgagttctggttgtccgaagtcaaattcttagggcacgtgatatctgctaaatgagttgctgtggaccccgaaacagtgaccgccgtcaccgattggaagcaacccaagacagtcactcaaattcgcagtttcttaggtttggcaggatactactggaggttcatcgagaacttctccaaaatcgctcgacccatgacacagttgttgaagaaagaagagaaatttgtgtggagcccgcaatgcgagaaggcgttccaaactctcaaggaaaagctggtttcctcgccggttttaatcttaccggatactcgcaaggacttcatggtgtattgtgacgcttcgcgccaaggattggggtgcgtgctcatgcaggaaggtcatgtggtggcctatgcctcacgccagctacggcctcatgaaggcaactaccctacccatgatttggagttagccgcgatggttcatgctctaaaaatctggcggcactatctcattgggaatcgctgtgaaatatatactgatcataagagtttgaaatacatcttcactcagtcggatctgaatcttcggcagagaagatggttagaactcatcaaggattatgatgtgggaattcactatcatcctggtaaggccaacgtggtcgccgatgctctaagtcgaaaaagccattgcaacactcttgaagtccgtggcattccacccaaacttaatcaacagataaaagccctgaacctaagcatagttagtcgtggattcttggctacgctggaagccaagcctaccttgctcgatcaaatccgcgaggctcagaagaacgatccggacatgcgtggactcctcaagaatatgaaacagggtaaagccgctggtttcacagaggatgaacacggaaccctatggaacggaaatcgggtatgcgttccagatgtcagggaacttaaacagctgatacttcaggaagctcacgagagtccttattccatccacccgggcagtacgaagatgtacttagacttgaaagagaaatactggtgggttagtatgaagcgggaaattgcagagttcgtggccctttgtgacgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggaccgattaaccaaggtagctcggtttattcctgtgaagaccacctatggagggaacaaactagccgagctctacttcgctaggatcgtgagtctccatggcgttcctaataaaattgtatctgataggggaagccaattcacctctcacttttggaagaagctccaagaagagctaggtacccgattaaatttcagcaccgcgtatcacccgcagacagatggacagaccgagcgtctaaatcagatcctagaagatatgctccgtgcatgtgtcctagatttcgggaagacctgggataagagtctcccctatgccgagttctcctacaataacagctaccaagccagcatacaaatggcaccttatgaagcgttgtatgggcgcaaatgccggacaccgctcttgtgggaccaagttggggaaagccaagtgttcgggactgatatactgagagaagctgaagcgaaggtcagaaccattcgggataatctaaaggtggcacagtcccggcagaaaagttatgcagataaccgtcgccgtaacctggaattcgcagtggacgattttgtgtaccttcgggtcaagccattgcgaggtgtacacaggtttcagacgaaagggaagctcgcacctcggttcgtgggtcctttccgtatcattgctcggcgcggagaagtcgcttaccagttggagctgcccgcctccttgggcaacgtgcatgatgtgttccatgtgtcgcaactcaagaaatgccttcgagtgccgtccgagcaggccgactcagagcagattgaagttcgcgaagacttgacctacgtggagaggccagtgaaaatcctggacactatggagcgaggagcaggaaccgggtaatccgtttttgcaaggtccaatggagcaaccacgccgaggaagaagctacttgggagcgtgaagacgagctgaaggcagcccatcctgatctcttcgccagttcctccgaatctcggggtcgagattccgtttaaggggggtatgtttgtcgcgtcccaaaacgactctaaaatatatcttttaaattatgcctagaataattaaaatctgtgtgcaagccttcaacaattaaaatgtgcaaagttaaaagtcaaataaggcttggaggatttttgtatatttcctaaaagcctaaaatgtgtaaataaattttagtggaattttcagagcaaaaataataattattaagaaataaacaaagttaaaatggttttataaaaagaaaaactctaaaaagtcttttcccccccctctcccctctttggggcccccgggctggccatctttntcctctctttctcttcccgcggccattcggctnctcccgcgcgcgcgcgttgacggcgggcccgcccgccttcctcgctgacgggggggcccacccgtcattccctttctccggcgtttccgncgcacgcccgcgccctagcgccgncaccgncgcgaatcccgccgcctcccgg

SEQ ID NO: 6359 - DNA, 40015 bp, Oryza sativa
  unsure (1)..(40015): unsure at all n locations
ccggcaatataaggaccggtttttgggccttctgttgcaaagcaccacggtacttccacatgtatagtgggtaaggcttagtttgtggctcagtctggtaataaccaaaagcacccggagcaatgtacccaagttagtgttttcatttttaaaacttgcttaccaactaaaacgtggaacggttggccatggttggcttggacgagctggaacccagggtcgggttgccagttcggtctgaatcatcgtaggccttgggttaaggcaggttcgtgtgggttcacggccttgataaataataatgtatagttctagaatcgtgtttacaaaatagctttgagcaactaaatgtctttaaatgctgtttactgcaaaccctaatcctttatattatgattcccttgtactcccttgcatttattctgcacttgtgggtgtgtcttgttgagtacggtggttgtactcagtcttgctcaatttttcccaaacccagaagaggagcccctggaagttgaaggctttggtgtctagctcgtgcctgccgtcaagcgcctgtggtcgtcgccctagtcttccgctgtttcccgtttgtctttgtgtgtgctgggccttcgtcgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacactgttgcatttaaaacattataggctttcttcctttatattctttgctttctgcaagtaaacctagctctacaaaaatattaccatttcatgtatttattgttgatcaatataatagcttgctgagtacgttgtactcacccttgcttcaaccccctttttcagagtcaatttggagttcttatcgaagccgggagtttaatcatataagttagtctcattctaacttaattctcaagtataaattagataaatggtttaagtctataacaaaacactagaatttagtcattctatagcttctgctgtaatagttagccacaatcttgtaaataccctattattttttgtaagagaatccccttggaagccttgctcaaatgtatgcaatgaagatccagattgttgaacctgtatcaatctactgatccagggcttgatacagttaaacatgtcggtttccgaatcattagttttgggacccgacaatatgtatgtgtgtgtgtgtatatatatatatatatatatatatatatatatatatatatatctgtgtgtgtgtgtgtatatatgtatatatatatagaaaaactattctataccccttttttttcaacccacctcctttccttataagggcccaaaacccacctcccaccttagtcaaaggctagtcaaaggtaccccacgtcagtcaaacccgctagcagtgacttcccccaccacccccttttttcttagctctcgtcccggaacgacgtagtaatgtcttcttcatcgtacagtgtcacgtcctgataaattcatcccaaaataaaatcattttctaaaaggaataatagaattaattaaaattcgaaaagaaattggcaaacactaaaatacgtacaagaaaaattcgaatgtggtccggagaatttttgttaaattctccttggtctaaaaagagccctcaaattatttattaaacaacaacaacaattaacaaagtttattaaaaagaaaaaagctaaaattaatccccctcctccctttggaccaagtttggcccaaagtcctccctctctctctcggcccgcggccaaagtcctctcttcctccctctctttctctccctctcctcctctccctccttctcttgggcctcctctccttcccctcggcccagccccctcctcctccctctctcccccaggtcgcctctccctcctctcctcctgggccggccgccaggcccaaaccgcgcccccctgcttgagccgctccccttccgcgtgcgcacgtgcgttgcacgcgcgctgactgcgtgcccgaccggtgggtcccacccacccgatcatctccttcctcccgcccggcatcctctctctcttctctctcccgtgaaacctagcgtcgattcctcccctaaatccgcgcgattcaaaccgggaattccaaaattgattagggggaattaatcccctttccttcctcttcaattccccctaatttcccccttgattcgtgcccccaatcgccgggaacgcccgcgccaaccccggccaccttccatggccgccggccggcttttccgccaccgttccccgctcctcccgtggccggctccctccccacgcctataaaacgaatcccctcgctccgttctatcgttttagccccctcccgcgatctcccgtggtccctagccacctccccgccgtcgtcccctctctcccgtgccgccggccgtcttcagctgcccctgccgccgcgttagcacgctggccggctgtgccgtcgcctcctccagcgtcgcagccacctcctcttcgccggcctgccctctgtttcccgcgaagacctccggaagtgcatccccgccggcaacagtggcgttgccgccactgttccgcctccggccacctctgccgcgtcccctgtgcgccggccgacgttgccaccacctctcccggcaccggaatgccatcctcttccccggccaagccacggcatcgctcgtatttcgccggaatgccgtcgcgcgcgccgcctcttcctcggtctcatcggcacccactccggcagcccctttcgccgtgccagtgcgccggccgacgtcgccgtctccacctccggcgtcgcagcggcaagatcgccctcggcctcgcctccccttcgaccgaacccctctgcggtccatcgtcgtcgtctccgttcgttctcgtcgtcgacgtcccgtcggtcgcccagctcgtcgtctcgcggcgccgcctccgtcgtcggcatcgcagcggtgtgttccacgccatcctcgtcttcgtgcagccgctgtaggctgcccacgtcgcctcctcgccggccccggtcgtcgtcgtcgtcgccctctcgtcgttcccggtcgtcgtggcgttcgtccctccgtcaagccgttctcgtttgtcgtcctcgcttcgtcaagtgctgcagcctcgtcgtcgtcttcgtcctcggctccgcgtcgtcaagccttgtgccggccgcgtctcgccttcgtccaaggatcgccgccgaagtcgttccctcgccgtccgtctccgccgcacccgttcgtcattgtcgttcccatgcctcgtcgcgtggtggtaaggatctctcctctcgctgccccgtcctcgtcctttcggtgtcgccccgtacccgttgtgcggttgtcgaccccggtacccgtgtaccggtgttggtagtcgttcacgtgtgcgggtggtgaccgtgtagtgtccgtgttagtgtgcccgctcggtagccgcgtggtttccacgtgtgcagcccgtgtggtgtctagtggagtccgtttgtcggccactcgcctcggttgacacacggggttcgcttccgtcgacccgtggaccgtctctgtgtactcggtctaccacggtcctttaggttgacatgtggggtccgaatgtcaacagggcagccttcttgtcttttccaggctagcgcttacacatgtcttatagttgcaaaacctaattataataatccgcaaatctccatataacagcattaaacttcggatgaccatgtcatggtcatacgagctccgaatcgatccgttcaagtctcctaatgtttgttataacctaaagaaccctgtgctttctttttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgaacatattgaatcccagtttataaaattattttgatttaaattattgcattatcgctttatataaattcccgcgttatcactgttttatctagccatgcctatttacctttgttatgaccttattattgctattgttattattatcttgttctccctaggataaacaaaaccccaactagtgggtaccctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgtttgtcgtacctcgggtactataaggattaagctcgggcctctgttgcaaagcactaccgtacttccacatgtctagtgggtaaggcttagtttgtggctcagtctagttaaacagaagtacacggatggagatggacgaagtcgggggtcgatggacatctctaggacaaatgaaggctacacgagctgcggctcggtagtcgagatgttatggcacagggctggtgtcctgctgctaggggctcaatcctgcctgcctgtcccgggggttccggccgtaggtggggttgggtcggtactcttttttatggctaggatgggttgggaactatgccacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttagtgttttaattctaaaaatttgcttaacaactaaaatgtggaatggttggcctgggttggcttgggatgagctgggacacagggtcgggttgccagttcggtctgaatcatcgtaggccttgggttaaggcaggttcgtgagggtgcacggccttgattaataatattgtgtagctctaggattgtctttataaaatggctttgggcaactaagtgacttttaaatgctgttcgctgcaaaacttaacccctatattattaccccttgtacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagtgcctttgtaataatgtaaatattatcgatataataaagatgtgccttttgtatcatgtttgtgtggtgtaccccggcttttcctgggacggggattaatacactagcgttcgggaaaatgcaaattttctcggtcgcgacatgcagtaacaccgtgttttacttgtagtaacagaattgaaattcagtcatagtatagtcatgatggatctacttttgataagcactttttttcgaacatcatagtgcaaacggtttttaaaagtagtacatgatatgagagatattgcccttgaaagatttgtttttaaaaatttaactctccacaagtagtaatagtatatcaaaagtgttactagtgcatgttttgcgttaatgcaatcacatcatgtcgttactacaagatgtagtaacgattataagttttatattaacatagtgtgttactgcaattacttgataacattactacaagaatatggggaattggctcggtttactcgtgtgttttaatccatgttttttttatttcaggtttaccacaatttcaccacgatgttactgccaaatatgcagtaacgttctatacgttctacagtaacaaagtgttttactgcagttcttggatagtgttactgcataaacatgcggtaatgtataactggcaggtggtaatgtgtatatgccgtgcagtaacacttttacttttgtgcagtaacaagtatatagttagcatatgagactttgaacccatatattttttgtttcaattcctgatttattgtcaaaagtgcagtaacgtcatatacatgcatgcagtaacactatattagagggagaagaccggttttcttaagaagagagaggaagaacgatttcttgaggggagtatgtagatgcattttgaagttctattctccacatgcagtaaccctatagcatcattgtgaaaacaattttaaaaaataatacatatcttgtgagatattgcttttcaaatattggcgttttgaactttaacactccatatgcagcaacagaatatgtaatttgcagtaacatgggtatatatatgcagtaacatagttttaccaaatgtataaaattgttgaaaacactcctacatcaatcagaccttactcaaaaccacctacagactttacctatagcccacctattcgaccttcatctcgtaaaacagacatagtaaaactatgattatcgtgcagtaacataactacttggaagtggtaacatgcacatattatgtagtaacacttctacttttgtgctgtaacaagtatatggttagcatgtgaggttttaacccatatatttttggtttgattcctggtctactaaaattttactatgacattactgccaaaagtgcagtaatgccctatgtgttctacagtaacgtcacgtgttactgtacttttaccacaatattactactggagcataataacatgttatgagtttcggtagtgaaagatattagaattgataatcatattactttctcacaaaattcttgaaacaaataaaatcattagataaattggttagaagaatgtgctttgaactatgaggtcatgggttcaagtcttgaatttagcaatttattttttatttttctagaaaagagaaaaaatgtttcaggaagaaaaaacagaaaaaaaggaaaaaggaaagagagagatcgggaggaggaagggggagcgaaaaagaaggcgggagggggaagcgacgggaaggggggatcgggagggcgggagggatacgggataaaaagggtaagggggtgtagaatagttattctataccctgggtgtagaatagtctcaccctataatacacacacaatctacaccgttgatgtgttccaagattcgtgctgcaaaatatacctaaccttaaccaaatgaatgcttactatagggagaaaagattaggattgggttggttcacaatatatataacatgtgtgttgcattttttaccaaataaattttttcaataacaatcatatatgacatttatatatctagtgcattgtatttctctaacccttattttgtttagtcaaaatgagaaaacaatatatctattatatcaccaaattgtcatcttgcaaaaatgatacttccaaaatgatatatatcctaccatcaaaaactacataaacaaggtaatttatataaacaaggtaaactaaataaacaagttttgcatactagaaatacaaaaattacaataaacaaggtattttacacttgtaaaaaatatagtataacgtaaacatcatgcatggtacattttattagcacctaatatactcaccctaagattcgtgcaagctatatatagggtgtatattgtgggtacatgtgaactcgcgtgcaaaaaaatccaactcatatatatatatatccataagagacaccatagtgcccgggcaccatggtatcaaatacacaaattcactcaaaattttcaaaattttcaaattgtgagtatatacctagttataagaattcgattcatacctatacctatcaaaaaaaaacaactcaaatttaactttatttaacaatccatgattacatacctaactaattatatgtttggatgctatatacctagaaccaaaatctaacaaaaacaagttcaaattcaattcaaacaagttcaaaatctaataaagtagttaatgttaatacctaaatatttgaaaaagtttcatactcatttgaattggatatatactcaatttcaatcatggtgccgggcaccatggagtcccatatgggtaccctatatatatatatatatatatatatatatatatatatatatatatatatatatatataaatatatggattgtggttcatatgcacctcaatccgcttgttgacacgtgtacacatggctccggtgcaaccgtgtgttggaaactttttgtgacaagttgacaagcacaatcgcagcacataaacaccttgcggtgatcctagagtcgccaaccacctcgatctagcaaaagctaaactaagattggtttttataactaaaccggctagcggagcctattatagataactacccgtctcgtgggcaaaacggaaggttttcaggacaaacctaaaaagaggtgtcacactctcgcagtggcggcggacgatttacggcgcaaatcgacaaagatggacaaactaagagaaaactaaaagcaatatgaaaaatgattcgattgattgattgtagattggttgttacaataaaccggccttacccccttatataggggttggtcttgccctctacagaccctcctccacgtccaactcgggatagaatccaaaaaaaacccaaaacatgccttcccgagcaagtaaactttgagacccggcgaaactgacccggactcggactctgccggtcagaccggccacacaccgccggtttgacaggccctcaccaggcggtctgaccggccaacacacggcggtcagaccggcctaatcagaggaaaccggcagacttccaaactttggcgatataaatcttcatgcacttctcccatagccactttagattgatcattatctaaacacttcaatagaactccatctatattttggcgatataaatcttcatcaagcaatgtatatttgaatgcttgccgccgaattttccgatcaaccttaagtttaggatctttcaaatatctaatcaaaggaattctccaatccacttctgtttcctgggcacaaatgtccgaatttacaattaattcggtctttgaatcaattgcggcgtgccaccagcgctctgtccagagccggtcagacccgccgtgcaaggccagtcagaccacccggggtggccggtcagaccagcggtatgtggccggtcagaccgcccctggtcaccgatcagactggccgtgcaacgccggtcagaccgcccctggtcagaccgcttagcaagtgtgagttctggttgtccgaagtcaaattcttagggcacgtgatatctgctaaaggagttgctgtggaccccgaaacagtgaccgccgtcactgattggaagcaacccaagacagttactcaggttcgcagctttttgggtttggcaggatactaccggaggttcatcgagaacttctccaaaatcgctcgacccatgacacagttgttgaagaaagaagaaaaatttgtgtggagcccgcaatgcgagaaggcgttccaaactctcaaggaaaagctggtttcctcgccagttttaatcttaccggatactcgcaaggacttcatggtgtactgtgacgcttcgcgccaaggattggggtgcgtgctatgcaggaaggtcatgtggtagcctatgcctcacgccagctacggcctcatgaaggcaactaccctacccatgatttcgagttggccgctgtggttcatgctctaaaaatctggcggcattatctcattgggaattgctgtgaaatatataccgatcataagagtttgaaatacatcttcacccagtcggatctgaatcttcggcagagaagatggttagagctcatcaaggattatgatgtgcgaatccactatcaccctggtaaggccaacgtggtcgcagacgcgctgagtcgaaaaagccgttgcaacactcttggcgtccgtggcattccaccggaacttcatcaacagatggaagccctgaacctaagcatggttggtcgtggattcttggctacgctggaagccaagcctaccttactcgatcaaatccgcgaggctcagaagaatgatccagatatgcatgggatcctcaagaatatgaaacaaggtaaagcccctggtttcacagaagatgaacatggaaccctatggaacttaaacagctgatacttcaggaagctcacgaaagtccttattccatccaccctggcagtacgaagatgtacttagacttgaaagggaaatactggtgggttagtatgaagcgggaaattgcagagttcgtggccctttgtgatgtgtgccagcgtgtcaaggcagagcatcaacgaccggccggacttctccaacctctacaagtaccagaatggaaatgggatgaaattgggatggatttcatcaccggacttccaaaaacccaagacggttatgactctatatgggtagtcgtggaccgactaaccaaggtagctcggttcattcccgtgaagaccacctatggagggaacaaactagctgaactctacttcgctaggatcgtgagtctccatggcgttcctaagaaaattgtatctgatcggggaagccagttcacctctcatttctggaagaagctccaagaagagttgggtacccgcttaaatttcagcaccgcgtatcacccgcagacagatggacagaccgagcgtctaaatcagatcctagaagatatgcttcgcgcatgtgtcctagattttgggaaggcatgggataagagtctcccctacgccgagttctcctacaataacagctaccaagccagcatacaaatggcaccctatgaagcgttgtatggccgcaaatgccggacaccgctattgtgggaccaagttggggaaagccaagtgttcgggactgatatcatgagagaagctgaagcgaaggtcagaaccattcgggataatctaaaggtggcacggtcccggcagaagagttatgcagataaccgatgccgtaacctggaattcgcagtggacgattttgtgtaccttcgagtcacgccattgtggggcgtacacaggtttcagatgaaagggaagctcgcagctcggttcgtgggtcctttccgcatcatttctcgacgcgaagaagtagcttaccagttggagctgcccgcctcattgggcaacgtgcatgatgtgttccatgtgtcgcaactcaagaaatgtcttcgagtgccatccgagcaggccgactcagagcatattgaagttcgcgaagacttgacctacgtagagagaccagtgacaatcctggacaccatggagcgcaggaccaggaaccgggtaatccatttttgcaaggtccaatggagcaaccacgccgaggaagaagccacttgggagcgtgaagacgagctgaaggcagcccatcccgatctcttcgctagttcttccgaatatcggggtcgagattccgtttaaggggggtaggtttgtcacgtcccaaaacgactctaaaatatatcccttaaatgatacctagaataattaaaatccgtgtgaaagcctccaacaattaaaatgtgcaaagttaaaagccaaataaggcttagaggatttttgtaactttcctaaaagcctaaaatgcgtaaataaattttagtggaattttcagagcacaaataataattattaagaaataaacaaagttaaaatgattttataaaaaaaaaaccctaaaagtcccccttccctcccttgggccggcccggcccatctctcctccccccctctctctctctctcctctaaccgcggcccactcggcctctccccgcgcgcgcgtcactgacgggcgggcccgcccgccaccctcgctgacgggtggggcccacccgtcatccccttcctcccgccgctctcgtcgcctcccccgcgccctagcgccaccgccgccgcgaatcccgccgtccccacgtgcaataaagtggggggaatcactccccgtgatcccctctccctttccccccatttttccctctctctctcgcgttcaaacgggcggatttgcccccgcaaatctcgccggcgccattgatggcggccggacctcccgcaccgatttccttcccctccggccgctctctcccccttccaaccctatttaaaccctccccgcgcctccctcgcccgtttccgccccttgtcgcaccgtctccccgccggaatcgagctcgcgccgtcgccctctctctcctccgtagccgacgacctccggctggccttctccgctcgccgggaccgtctcccgccccggagtcgcctcctccggcttcgccgcaccgccgtcgaccccgtccaccccctcgccgagtccgccgaccgccggaacgccgtcgaccccgtcgacccgagccgcgccgccgccttcctccgctccggccgccttttttgtcgtcgccgtcgacctagggtgagccgtggaccgccgtctcttttcccccttcccttcccctctctcggccgccgctccgccgtgcctatggccgccgccggcgaccataggggcgcgggcgccgcctcctaccggccgcgccgagtggccgccttcgggcgcgccgagtggccgccgcgtggggcccggctgtcagccgcccgcgccctcgggtgcggctgacgcgtgggacccacggcgccggccggtgcgagcccgggtgcgcccggtccaccgtggaccgtgaggctgccgcgtgggccccactcccgtggacccggtccgcgcgccccctcccctcggctgacgtaataaaccctttttaaattaaaatttaaatgaaaaaattcataaatattcatttaaagagcatataaacttcaaattgccataacttggccatttgaactcggaattggaccgttcatgtctcaaatttttccttaagaagtcaagaacccatttttgtgctttgttcctgcttgttatatggagtttattagagtaaaagcccttttattttccgttggtcgtgtagacgttgcagcttcggaagatccgctcttcgtggaggttgaagccgacgtttgggaaagtgagcaaggaaagtcacatcatccttgaacatattgaatcccagtttataaaattattttgatttaaattattgcattatcgctttatttaaattcccgcgttatcactgtttatctagccatgcctatttacctttgttatgaccttattattgttattgttattatttccttgttcaccctagaataaacaaaaccccaactagtggacactctactcatggcaccactagtatgattttaggtagatgcttcactggttaattaggcaacattaggtggttttacaactctagactttgggaatactcttatcatctggacactacggaatggttggattattgtggaatgggattcacacctcaaaatggttttaggctgggctcggggtgcatggttttgatagtagcacctcggccatttaaggaccggtcttcgggcctctgttgcaaagtactaccgtacttccacatgtctagtgggtaaggcttagtttgtggctcagtctggttataaacaaaagtacacagatggagatggacgaagtcgggggtcgatggatatctctagggcaaatgaaggctacacgagctgcggctgtaacatcccggcctagggcttaataggattaatagaatactcatatcaacaagttacaactttttttccggaatccaatctccaaagaactccagggttaagcgtgcttggcctggagcaatttgggatgggtgaccgaccgggaaattcttcccgggtgcacacgagtgaggacaaagtgtgcagaaaagacatgtgttgatctgtgagggcagtctatgacctatgaatgaaagctatcagatgtaagcgggcccggcctgggggaaggcgggacgttacagcggcccggtagtcgagatgtcatggcacaggaccggtgtcttgctgctaggggctcagtcctgcctacctgtcccgggggttccggccgtaggtggggttgggtcggtactcttgtttatggctatgatgggttggaaactatgtcatgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaatttagtgttttaattcttaaaacctgcctaacagctaaaatgtgtaatggttggcctgggttggcttgggacgaactgggacccagggtcgggttgccagttcggtctgaatcatcgtaggccttgggttaaggcaggttcgtgtgggttcacggccttggttaataatattgtatagctctaggaccgtgtttacaaagtagctttgaacaactaagtgacttttaatgctgtttactgcaaaccctaaccccctatattatggctcccttgtactcccttgcatttattctgcacttgtgggtgtgtcttgttgagtacggtggttgtactcagtcttgctcaatttttcccaaacccagaagaggagcccctgggtgatgaaggctttggtgtctagctcgtgcctgccgtcaagcgcctgtggtcgtcgccctagtcttccgctgtttttcgtttgtcttcttgtgtgctgggtcttcgccgcccatgtaatagattaattaattacgcttccgcttgttaaactctgaattgtgtcaacttttggtgtaccttgcctcctgggacaaggaataatgcatgcacgtaaggaacgtccgttgggttatttccggtcgtgacatttcggcatccaaaagatggcggctcaaatacgtaatgatatattccttgccatcttcctgttgtgtcaaaacagcaccaatgactttgtcttcggaggcaatatataaccgaaacggctttccggctttaggtgcccgcaccacgggtggatgtggacccccgtttttataacaagaatcaatcgtgtaaacagtaccatttccctggatcaagtagtctggtacacacgaatttatagctgaaataccaagtgcacatacacgagagtctagtacgaattattacatcataagcccacaggcgcagtcttaaatcatcggaccgagcggtccgggatacattccaaaaaacagaagtaggtaaggcagcggaattaaggcagtggcacgccattgacataggcaacgaccgtaactaagacctactgggcgccatcgtcttcatcaccctcctagtaataggcatagggatcctccgaagcttcatctccggcctctgattaagtttatatttgcaagggtgagtaccaaccgtactaagcaagccaccacagcaacaatgcatatgatagggatattcaaaagatggctatggttcttttgcgcaaagcaagttttgtaattcttttcacaaacctaagacctagcatagactgatcaaattttagttccagagttcatattaaacaacgacggttctgtccaccatccattgtaatcccaaggatagcttcccgccattgagtcgtcatggttttctgaggacgtccaccttcccgcctctcaggaagtggctccatcagcatagaaatcatcatgcatcatcccatcacacacaagttaagaatttagagtctagccaagtgtaacacatgtcccggtgctcaataaccacgagcacggctattcgaacagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccgatgatgacaccgatgtagggcacgcctctcggccctacctcaacggctgtcccaccgtagtgcacctgcctcactcaggggtgaaccatctatgcagggatactgcctccgctcggctatctaatccgctaggtctatacccatacgagaagtacggttgtacgggggtcgtttcatgcttaacttcatggctcggtccttaattgaccggggacgatattagccttttcccgataccacccaaatcctccgtccgccccagttgaaaacagttgtttaattctatttctcctttcacaaatcatatcatcaacatcatggcaatgtggcgctcatgtctccacatgccgcatctcaattaccttcccaaaggtaattgcccaagcatatagcatttgataaatatgagtatgcataaatctagagtagcatttctaagcatttgtcatagttgactagggacttatacgtagatcatggttacaaggatttaagggtaaacaatactcaaggcatggcataatcacaagtaggatgttcatcattgcatgcaatttttatttgtaaataaaaataatttcacaattgggatcaacatgttcaaagaatagtgatgacttgccttgctcaaagtcttgcgggtcttggccttcacttggatccaccactccctcgggctctatagttacgtgcgaaaattgatttgaatttggttagaattcaaataaaaatccaaataaatccaaatgaaagtcgaatgcgaaagtcgatttctttatattaactttactattcgcgaactaaggcaaacccaatttcgattcaaactattttgcgggtataaatattttgttgtcataagttttttttttaatttaatctacccgagcattatatacatacaataggttagaaatttctatcgcgagctaaatatcggacgaaatcctaaaaatattatacgatttaatttagtctataactaaatgattaaatataatacacgggtaaaatccctagtaattaaatccgaatttctaccgtgaatcgattacttatagggattacccaaaaataatctataataatatataagaattcatctaattgtttagctattaattacatctaaattactactgcgaattgatttcttatagaaattaccaagaataatccataatttatattaaattttgcaattctacgactataataaatctataattaaattctaattattttaaattttctaaacttccctaatctccctctaatttcctatttatttcccttttctttttctccctttctttttctttttccttcctttctttttcttttctttttcccccttttattttctctcccagctcctttcttccttcctctcttcttttctctctctccctctcggcttcttcctccctccctctttctcggctttttgccctcccggcggcgacggcggtggacgcgagggggaaaaggcggcggcttaccgacagcgacggtcggcggcgacgacagcgacggcggcgcaaggcggcgacgcacggcgcggcggctccgggacgacggcgcggcggcttctaaggtggcggcgcggcggcatgacgacggcggaataatttaaattgaaaaaggtttttaaaagtcttcttttggctttgggccgaaagtcggcccaaaaccccctctctctccctccccggcccaagtcggcccagtccgccgcagccgcgcgcgccctcgctcgctgacaggtggggcccgcctgtcggagtcgtcgtctacctccggccgccgccgcccgaaaccctagcgccgcgccgccgctgtttccttccaaatccggccgctcctttccttctccggagaaatcaaaagaggggaaatgtttcccgagatctcctctaccttttcccttttggaaacatcatctatttcggtttggaaatcgatggattcaagatcgaatcggattcctctctctctcccgaacccgaggtttccttcgcgtcgccggtcgccgtgggccttcgccgccgccccctagcctctttaaaaggatccccaagtccgccgctacccgtcgccaccttcgccttcatctcttgccatcggaagcgtcctagcgccgtgtgacctagcgccgtcgtcgtcgccgccgctccagccgtgcgccgccgtcgttccagtcatcgccgtcgctcgggaaggtcgtcatcgtggtcgccgtcgcttcgccgtcctcgtccgccccttcgcagtcgctgttgaccgccggagcaccgtcgccgccgtcgacccgatcttctccgccgcttcaacctcgtcgccgtcgccatccgttgatcttccgccgcttctttggtcatcggtgagttcgccgcgtcgcgctctacgtcctggtgctctccgttcgtgccgaagcgctgttgttcgccggcgagcatgcgtgcccgagccgccgagccgctgccggtgctgacgtcatcgatgacgtcaccgctgacgtcatcgtggcggtttgccgtgagccggtcgtggaccgatcgatctcggccgtccgttttggatagggttgatctcggccgtccgttcccgtggaccgctgccgtgcgcccggtctaccgcaaaccctagccgctgacgcaataaatctctttttccttttcaaaaataattcattattgcgtcataattcaattaaaatctatataagtgttttaatccgattaaatcttcaaaaattcataactaattcatcttagctcggatttagttggttcaagtctctaaatttttttaaaattgagatctacatgttaaaaatatccacatgtactgttcatgcttgtttatgtgctgttttggtgtttttgctcttttctgtttagattccgacgtttccggagagtccgttttcgcaggagaagattttgaagagttccaaggccagcaaggcaagtcacacagatcccaaacaaccctttgagcatgttgatcctatttaaagctattgtttctattcaactattgcatctattttcgaatgtcattgggtggaattaacctattctttgttatggcccttttgtacttgattactttattccttgataccttgggtgattataattggactagttgagctttatatatattggttcaactagatattagatataattgcttagccatgcttagaaacattagcacactattgggataacttatgactcactattatttaatgatggcttaatggtagttcacgatggtcaatcgtgatttgttaattaattacttgccaactaaaattttataatggtgggttgtgagcacatggttttgatggtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatctaggaaaggtgcgctgtagtggattgtgttgtgcgaggggtattgccacagctcctttccgaggtaccgtggtggtattgaggcacatggtgacatgatgtggggctgtgtcttgtgggtacagtgatacacctctgatcagagtaaaactattcgaatagccatgcccgcggttatgggcgggcctaataatgtctttcgtgattagtctcacacttctcaccataataaataatgctataattggtaataatttgattagctcctggtttggaatggtatattcctggtttggggatagaactgtgcagccgggatggttgttcagaatggttgggcctatgcaatagggtatgttgtatagtgttggattaatattgtttaattatcactgaactgttttataattctcaaatgtttgctaaatgctgcttttgcaaatgagccctatactatgccatcctttgttatcctgtgcacttgcatatttgctgcgtgacttgctgagtatgtcatatactcaccttgcaatcattcatcagaggaagagttctacagtggtgctgatggtgtggaggattaggtgtagccttggtcaagctgcttgtggagtggagccgtctgcgccgtttatcttttattttccgctgcttagatctttattgattgagaggaactatctacctctgtaatgacattttattcgcttattaattagagtaataattgtactctattatcaatttgttattgtgtgcctcggctgattcctggatgagggttcacacacatgtaagcgtttggaattttggatagaaattccgggcgtgacagacgcgcgcggcgttgggacgtcgatggcgacggcgacaacggtggcgcgcggctcggggagggacgcgatgggcggcgacacaacggcatggcgcaacagcgacgatgggacggcgcggcgcgggcttgacggcgacgggacggctgcgcgaggctcgaggcgacgcggcgacgagacggcagcacgcgcggcacgggggtggcgacgttggctcgagctcggggcggctcggcgatgttggcgcggcggcaggcggcgatggcgacaggcgggcggtgtggcgcgggcgcgtggggcgcgaggcggccaggcgcgacgggcggcggcacgtggtgacggtggcgacagagagaggggaaagaggagggggctgggttaggggaccacgtcaatcacctacgccataatgaacagtgtattttcctatttatcccgattttagtttatttccaatataaatttgattctataatttctaaatcttgcataaatgaagtttactcaatatttgtgttatcttaactaatgaattcaccctagattaatattactcatattttatttgtataatttatttgaatttttaattaggattaattcttatcccatcgcatttaaattcaattgatccaaatatggtcgcgataatattttatttatttctatccacacctaatctttattttaaattatatttattttaccaatttatttttagggtttattcctaattaactattctttactcacgattaatgaacttcgaaatcaaatccaaataaaataagcgaataagatcggcatgatgcaatcaatttaaaaagtttttgaaaatccatatttttagagtttagctttttgtcggtcgaattttcatggtgttacagtggagtagaaaaatacttcttcaacccttcaaacccctttaatagttcgattattttaaccttataatcggctctcatgtttttgtttacaaaagtcggccttggcttagttccatcacctatgtttacttcttccaatggattggccgatgtaaatccttgaccaagcttttttacctcatcaaaatcttcaatagtttcaccaatatcgttctttgtagaccgatattcttgcaccctcttttgcaaccactctaaattatcttctctactcattacataaagtgatatgacctagccgtgctaaacctgccggctttacggagatgggtacaaatttgccattggagatactaaaaaagtcatagctagaaagatccatccctgataagcattgaatattccaatgacgccactcaaatattgcatcggccattgcaacctcggtcgatgtatccgcttgaacaatttcaacatcatcgccgtcccattgaattaaacattgatgcaaggtagaaggcacacaacaattggcatggatccaacaacgacccaaaataacattgtaggaaccttgcacatcgacgatgaagaaagtggttggtagcgtcttgtttcccatggtaagctccaccgaaaagatacccttcgcctccgttggttcaccattgaagccattgagaatcatgttggtcttcttcaactcatcatctccacgccccaacctcttgaacaacgagtatggcatcaaattcacggcggcacctcgatccacgagcatcctagagaccggcttcccatcaatatgacctttgagataaagaggtttcatatgacggtttgattcatcgggcttctcaaaaactgcatttttaggacctagtgaaaattgagcaacttcgtctttatccatagcacaaaactccataggcaacatacataccatgttgacatccatctcctcctttggagatgactcatctttagcaaccaattattcttctttctcctctacagcaatcgattcttcaatgtctatggacttacacctccacatcttcgtaggtggtggtcgcaactcattgaaccttgtatccctttgctcttcggcctctctttccctcaattcttgggcccaaagacgttgcaacctcctcttttgagtagccgtttgttgatgtgaaaaacacgaggcctgggggatctgcttaactccagtgcaggtccaaaagcttgcctttatgtgtgtgagcgtgccagttgatttgatcctataaccaacaagaaataaagacaaagaaaacgcggttaaatccacaaatgatagccgattggctagctgtcgatgacgtatcatttatctttgggccgatgtcacatatagatcgatcggcagtcatgaataagtaagaaagaactaaatctactcgatcggctgtagatattaacaatatataaaccttatgtcgatatatagttaaatcaagtgattgggatagatcggtcgccatgccgagacagtataaatcacttagatcgaaatatatattaacaacaaaactatatatgttcatagcatagccgatcagatagatctagcatgtatcggctaatactccgataccactctattttaagatattaaagcaagcagaatatatcaaacaaaagcctaatatacttaaatgcaacaagatcataacataaagagcggatttaacatgtcaatcaagcatataagacataaagtagttaaatcaggtaagattggctgaaaccccgatactaccctagtcggcaaccagaaagtaggctagagattgagattctaatcacgacttataaggtcaaactcaattgatacagctataagtatgaaaagaaggacaatatccatacaatcaagccgctggttgtttcatagagtggtggatatcctatataatctaagccaacattggtatttaacctaatcggctgccttctaatgatagatgttagccgattggaggctatataacaatattgtcaaagattatataggatatatgataactcgacaagttacacaaacaagattagagtatcataaagatggaagcactaatcccgagaacgcaagccgccataacaagttttacctctagtagaagatcgaaaccgatgcagctcaactcgaaagcaagaaatcatcgaaacaaaatgaaagtaaaagggtggcgatgcgtcgagatagtactgaacgtgtcttgttgtattccatggggctcggggtctatttatacacgagattacaaaatatgttcgtgtcggacacgactcttatctctaacaaactctaagataccataagtctttgcgacagacttttgcccaaatatatctataaagaaattacataaaatatcctaattaacagatacaattgccttcttaggactcaatccgtgcatggcaatcctcatgaagcacattaactcaacccgacaacgtgtatcgcaccatattgtcggtatcggctcaatcgaccaaccttgtccgactcgaactctgccgatcctgctcgtagccgattcttgctctgtttccggaacaacttctttcttggattccgcttcgattcatctccatctccgattcttcgattaccaaatttcgttgttaacaccgttaaatccttaggcatccaccttggtttcggctctgttccaggaagtaaataatggcccctgttgagtctactcgaagatgacgaaacacccgcactacttcttgcaaatctcttgtcgaaccggcgctagagcccaatcagaccggacttagaccaccggtcagactggccagaagcgccggtcagaccgacattggatcggcggtcagaccggcctgatggcccagtcggaccggcagtagagcggcggtcagaccggccagaaggcctagtcagaccgactgactgcgatgagctagtcccggcttcggatttgttgctcgaggactctccaacttcgtttctagaagatactggcacatcatgagaacccactttggtggtaatcacctccaaagtcctcgcctccaccttaacacgctttccttccctcttttctttattgactcgatttttagcataaaaccggctattgtttggtgaagactaatgttcacgagctggcctcctaggtcctccccatccttggttgaattgcattggaggcatatgattgaacatggcggtgttgccccccatggcatgtagtaaggaaaaggataacccggcggcggcattggataaggcccccatgacatgtcttgagaacgatgatatgtaggtgattgcgaccgtcttggtgtcgaaacaagatttcggcaatacaaaaagggggtggctatcaagcaggaaaagtggatgggtttggaggcaatgaattttatacaggttcatgtcctctcaatgagaagtaataccctactcctatccgggtattgatccgccgagtgtgttattgatcgtatgatctgggagaaaagttatgccccaaaaggcacccggacccttccttatattgtgggaggagtctgtattacaagatacagcccatattcctaacggaataggcaaataaagataaaatacaatcgtaaccgactaggaccccgggtatttcctcgatacacaagttaggaatttaacccaagtcccttaaagatattttatccgcatatggtatccctattcccagtcagatacacaagccgtgtgggtatggggtatccataatctccacagtagcccctgagacctttacagtcgacgaaataatcttctctttgagtcttcaacatgatgatcccgagtgcttcaattattcctgccttggtgtcccgagtgcttgaatcaaagactgtgaagggctaaaaaataaaaagttaggtgcatcgactagatgcacctaattagatgtagctcccgactatgtgattagttgaataaaactaaacatatagtcaaggtacattaaaacatccatccgagtggttttatgaataaattaccgaagtaatcatatagctaagcatatgcgacctttaattaaacattaagcctactgctttagcttgattattatacccaaaaggtatataaaggtccaagtaaaaacactctaaagatctgtcaatcaatatatgcgataaaaaattcgagtaaaaactcttaaaggatttataaaatgtcgcataaatgataaatgacaagtctagatagtctaatctatgacttatgccattatcgaattaagcatataacaagccaagagaatgacaattttaaattggtcatctcaatataatccgaacagctttgcagcctaaaaagggcagcaaaattagtatgacacttttctgctgggcacctttttatttgcattgtagcaattccaaagaattatctaactgcttcaaaaagtattttaacggtatttggctattttgttgtgagcattatttgccaaagcaaaaaatatgcctaagtccctaaggatcacaaacaaccacaccgaaagtgaagttgggctgaaaatactgttaaggcccaggccgataagtatttcccgataccctagcgaaataatcgcaaaaatataacgccgcttcgtcttcctcattgcgatctccttcgttttccccatttttcgctacagtgccaaagctgcgccagcgaaagctagggttcgcaaacacacaccaatccacctcttccgaagcttcatgcctctgcgaaaaatcctccgcacaaccacttcatcaatctcccctccaatctccgccacccttgctcccaatttcatcatccatctcgcatccatggcagaggagagagaaagctttgagagtcaatgggccccctccaatgtcacggaggaaaacttgaaggaaatggtggtgcacggcgttctcccggcaaaagaaatcatcggatggcgtccagcgtacggcgaagccttcccgacccccaacactcatgaggtcgtcgtatggtggttttgtccttccaacttcgaagttctttagggggattctagaattttatggaattagtttgcatcatcttaaccccaactccattgtacatattgcaaactttgttcacgcatgtgaagccttcctggggaataaggcgcattttgccctattttgtcgcatcttctttttgaaaccccagccaaacaaaaacaagctatgtgtcatatccaaaatcctaaaccagcgcttcccgagtactcttgtcttcccccaaaatatcaggaaacatgaaactcacttccaatggaagatgaaaccgctcaagccctcaccttgttaaatcgtatcatgaagctcaaggagcaaggtctgcaaggggaacagatcactcggcactttatcaaaagctgactggcacccatcaagaaaaggtctcgtactgccttcgagtttgatggaaanaatgatcccaatcgtgaagatcccgaatccctcgaattcaaaattatgaaggagagaatgtacaagattctcatctgccatagtggtcagttattcacatatactaccagtggtgccatattacgcattcaaccctcctcctccagtgagtattgaaaactctttaatctccttgcgatatctgctcttctttgtaatgttcttgactaagggtttgaaatgtcatcctcaggaatttgctttgatgaagtctgatccatcgactgctcaacgtcgttctcctcgccatcattccagtcaaacctctggaggtccaaaaattcaacatgtcgcacaaacgagtagcccaaagccgactgatcagacgggccccagaaaaaggaagctggtcttgagtgacaatgatggtgatgataccgaaaaagccagcaacaaagagatgactggaaaacagcctaaataggctaatccgccaaagaagaaaacattcagccgtccaatacccaaaatcagaaagtaaatccatacagcaaatgtaagtatcatgtctatagtttcacttatccaatcggcaaatccactgagatgctcaagtatgtaatgtagagaatccatcttcaaaatgaagcgaaaaccgcaaccatcgagaagctagttccccatcttagtactctggatgaaaccagggaactagctaggaaaacataacatgatctcagggaacgggttgctgagcttcaaaactccaatttcgaattgagtgggtcttcaaaaggtaactttactcctactcgacccattctgacttgatgttgtgtttaaataatcattgagtatatgatagtccaagctgccaagattgccgaattgaagaagcgaattgaaaccctcgagaaagacaaaggcagtcttattaaagagagggaatcggccatcaaagatgttgaaggtaattgtaatagaaatccaagataagcttgctgatgcctcctagtcctgatctgaatataactgttcatgtagatcgcaagatcaaatctcaagctcaattcgacatcttggtgaataaaattaagaatcttgaaggggctagagatgaagtcgccaaagctactatgcacttaatccaagccatgttctataataacaacggtccgagtacaattgatttagttgaggtcttcgacaaattgcgagctgctccggacacgtgctttaaaaatatcaaggaggctggaagcatgggagcaagcatggcgttggcgatgactaaatccttgtatccgaaaatcgacattgatgccattgatggctttgcagaagaaacaagtgaagaggatgccctttgatctcatcaatgatgcctagaaggacgccgacaagattgcgctgatattgttgagagatttcaagataacaatcttggtccgactgggtttcatgattccgatgatgaaaaaactgagtctgaccgaactttgtaattcaaacgatgtagtctttgatgatggagcctcaatttgtacaatactgatatatttatgctgtgcttgataatttaaattcggtctctgatttcttaaaagtttttgtcaaaccttattgagcctaaaacccgaaatgttatcaaaaaactctcagtcctcattaaccaagctaaaaaatcaaacaaggcaatgataaatcaagtaaacaaattgaattgataaaaatcacactccattattattatgatagcccccgactgataaatcaagaagaaacttgatgttggcagtcaaagaggaaaatagtgtacaaaggtaatgcctaagcataaaacgacgaagatgctcgatattccaagagttttcgacgaccgaaccatcttcatgcttgagtcgataagaacctggccgagtaacttccgagatgataaatggtccttcccataagggagataacttatgcctatctcgcgtagattgaatcctcctcaaaaccatatttccgactaaaaatgcgcgtgatctgacattgcttgtaaatatcgagccgactgaattaatgctgcttcttgggcttcttccaatcggttgaggtcatctactcggtcgtcttcatagtgctcctctttgaaattgcgaaatcgtaaggattcaaactcaacttcacttgacaacattgcttttgctccataaactaagaaaaacggcgattggcccatagcccgactgggtgtagtgcgaagagaccaaagtactgatggtagctaatcaacccatttgccggcataagggcgcagtcggtcaaaaacccgtgctttgatgccttgaactaccataccattggcgcattcgacctgtctattggtcatagaatgtgctacagaagcataacaaatcttgataccaaagtcttcacagaagtctttaaacacatcactagtgaattgggtaccatctataatgatacgattaggtaccccaaaccggtgcacgatgttgatgaaaaaatctcgagctttgtcggtagtgattgtgacgactggtttagcttcgatccacttggaaaatttgtccacagctacaaaaagatgagtgaaaccaccagtagcccttttgaaaggaccaaccatatcaagcccccacaccgcgaacggccaggaaagagggatagtttacaactcctgagttggtaagtgaatctgtatgggaaagaattgacaaccttctcatgttcgcagaactctctcggcatcggatactgcagtgggccagaaaaaatcctgtcgataagccttgccaaccattgttcgtgcggcagcgtgatttccgcaaatgccagagtgaatgtcctgtagcaattgtcttccttcttgcaaagaaacacaacattgcagaattcctgagggacttttcttgtacaactcagcctcgatcatgacataaagcttgctgcttcgagaaatccgctcagcctcgtcattgtcttgaggaagctcttgcttagtcaaaaatttgatgaagggctctctccaatcggtgtcaattacactgacttcttgagtacctgccgtctcgatcacatcctcccttggtactgtcggctcataaaggtgctcaacaaaaacatatgaaggggctacttctcgctttgaaccgaaattagctagtctgtcggccgcttcattgtcgtgcctaagcacatgagttaactctaagccatcaaatttgtcttccaatttaagtacttcctgtcgttatgcagccatattatcatcaaggcaggaccactctttcataacttgattgacaaccaattgggaatcaccgcggaccactagacgccgaatccctagagatactgcaatcctcagtccatgaagaagtgcttcatattccgccacattgtgtgacgcagaaaagtgtatccacagcacataactcaatctttctccagtcggggaaatcaaaacgacccctgctccagtacctgaaagcctcttcgacccgtcaaaatgaatagtccaatactccagcttctccacaggtgtgtcttcttggcactcggtccactcggcgacaaaatctgctaaagcttgggacttaattgaagtacgcggcttgaaggataaatccaaagacatcaattccagggcccatttcacaattctctcatttgcctcgcgattgtgaagtatatctccgagaggaaatgatgtgaccattgtgaccgagtgactttgaaaataatgggataatttcctgacggtaattaaaacaccatataacaacttctgtacctaaggatatcttggtttggagtcggccaatacctcgctaacaaagtaaattggtctttgaactttttgaacatggccatcctcctctcgctcaacaaccagaactgtactcatgatttgcgatgtcgccgacacatttaacaatagcggctcttatggatttggtgaggccaggaccggaagagttgtgagaagtttcttgaaatcatcaaaggcttgctggacttcaggtccccactagaaattgtcagtcttcttgagtaacttgacaaagggcatccctcgctcaccgagtcgtgaaataaaccggctgagcgccgccatacatccagtcaatttctaaacatctttctaggaactaggcggtttcatgttaaggatggcatttattttttctgggttggcttgtatgcccctacgagacaccataaagccaagcagcttccctgacggtactccgaaggtgcatttttcaggattcaacttcatcctaaaagcacggatgctagcaaaggtttcttctagatcagcaattatgtcatccttctgcttggtcttgacgactacatcatcaacataggcttcaacattgcgaccaatttgagttgaaaaacatctctggatcatgcgttgataggttgctccatcattctttaatccgaagggcatggtgatatagaaataagctccaaacggtgtgataaatgaggtcttcaagcagtcgaattccttcaagttgatctggtgataacccgagtaacaatccaaaaaactgagtagctcgcagccggctgttgaatcaaccacctggtcaatgcgaggtaacccaaaaggatccttaggacatgatttgttgaggtcggtgtaatcaacacacatacggcactgtcctgtcttcttccaaaccaaaactgggtttgccagccagtcaggatgtaaaacttccttgatgaagcctgctgctaacaacttggttaattcctccttgattgcatatttcctatcttgcgcgaaatggcggagtcattgtttgatgggtttagcgtcttctttaacatttaaggagtgctcaattacctctcttggaataccaggcatatcagatggtttccacgcaaaaatatctttgttaccttgaagaaaggtgatgagcgcgctttcctattttcaatctaactcaccgcctattacagtagttttggagggatcagatagatcaaagggaatcttcttggtcttggcgtcgtcttctccggtgatgtgaccatggctaccatggatgcaaccattgctcacatcatggatgaacaagaagataccgagatcacgtcctccaagtgctggaatccgattcggccacctattacaccgccgactttaaacggcggccgaatctgcatacgacctccgttttcggcccgtgactacttgatggaaagctctcggagccctctttccaacggatccagcatcgtctctgaattccatctcgtgtggccagaatcacaggaacaaggtgttgcgtcacctattatgggcctgtgagcttgtaacttcatttgggaccctggcccaggtggggcctatgtggggtgcgccccaagctggtgcagcacgccactaggcacccctaggtcgtcctcccacccctatatatagctaggtaccccttcagggtttctcggggttttgtttagatgaaagtttagccattgctacttccttgcagcgcgtgtgtcgatcgctaaggcgcaacacaacgtctcgtacggatgtagtcggatcgtcaacgtgtctcccaagtcgtagttatcatcaactcaccgaaagatcggccaacaatagccttgagtgtcgagaggagctcaggattcatcaggtggtatcagagctttcgttgctcggtgagtttttatctacctataacctgaaaattgccatacaaaaaaaattgtatcctgtacctagccatatattgtgccattgcattgttcttttcagtttttgctttgttgagtttgtgttgcatcgtcgagtcgtgttgctggtcttagcgtttagtctgtttagagtttcgagttctggtcacatttagtaccactgtcgtcaccatcatcgtgtctttgttgtcgtcgggacctacgaaaacactgccacggttcaatttttgtagttttcagaagtttctgtcggttagtttagcagttgcatcttggtctctgtggtctggtttgccttgtgccgtggtcgattgcgctcttgcgcctgagttggatggaaggaggctgttgcgcgtgagttggatggaaagagattaaattggtttttgttgtgcttggaaagaaaatagtagattggatcagtttccttttttcctctcagcaaatctggacgtgtgcagtatccttccgctaccgcccaccaccacgctgagtcgactccctccatctactctcggttccacctataccgtgagttgctagagagcttggtaaaaaatttttgagtgttggattcgacatctgtttgcaaaaacagaacctatgggacgagcgcattccatttttgtatagtccaaatttttgggtttgcacttttgcatttgagtccctgtaatttgtatatttacagttgagtccttgtaatcttgcattaaggtccttgagttggcttttgctgaaaaaaaaattaaaaaaaaagaaaaaaaaggcagaaaggtgctaaaaagaaagaaaacaaaagccgcaccaacaaaaaaaaaagaaaagaaagaaagaaaaagatagaaaaaaaaagaaagaaaagagaaaaatcagttgtatctttgagtttgctttcacatatcagagcgtgcttgagttgtttctagtactatcttgtggtatcgtttgtgtctaggctcgcgtctctcgtacgttctagcctaggaccagcacggtacttaactttaaacaatgatcttcgataacttcgttgcaggcacttcttcggttgcggttgatgtggccagtcggatctcgtcccgagcgagtgtaatctcacatgtctgagccatctcacagctttctttgtcgcaggtgatagcttgcttgatgttgctccgcaaagatatgactcctctaggtcctggcatcttcatgatcatgtaggtgtagtgtgggactaccatgaatttggctaacgccaggcgcccaagtatagcgtgatacaccgtctcaaaatcagcaacatcgaagcaaatattctctgtgcgaaagttctcctgagtgccgaaggtgacgagcagagtgatctggccgagtggagtagaggacaaccctggatgactccatgaaagggtgtgctactcgtcttcagctcagtacgagggatctacatatcgtccagagtcttggcaaaaaggatattgagtacactgccaccatcaatgagggatcgtcggagcttgaagttgtgaaccactgggtccagtaccagggggtaccaccccgggtggaccactcgattaggatgatccgagtggtcgaacttgattgttgtctctgaccaccgaagatattgaggcgtgtcgggctggacggcgttgatctccctatcaatcagcttttgcttccgttttgactcataagcttggggcccaccaaagatatggttgagctctttgcgagaatcttgaaaaccagtcggtccatcgtctttatcatctttcttctttgaggtgctctgatctccatctatagccttcttcgcttgcttggcgtatttctccgcaaactgcttgtagatgaatcaatctttgggaggcttgtgtctaaatttgccgactaagagttcatgacagacacccttggtgaaagcggctatgatgacgtcatcggtgatgtcagaaatctagttgcgttgctcagaaaaacgtcgaatgtagtcccgaagggattcaccgggcttctggatcacattgtagaggtcgaagtgggtgccgggacgttcaaaggtgccttgaaaattggtgatgaagtgctcatgaagctctgcccaagatccaatcgtgccacggggtaacccataaagccaggaccgagcagaatctactagatctaatggcaagtaatttgccatagccttgctatctcctcccgctgcgtggattgcgaggccatagacggtgagccatgactcgccatttgttttgccgtcatacttctcgataccagtcagcttgaaactagccgaccaatccactcgacacaggtcacttgtaaaggatgcgactccatcttcatcgtcgtcgtagcgatttggtgaacggtatggttggtagcctctttctgcaaggtgtcggttgagtgtttcgcgaagatcgacgggttgccgacgacgtggagagcgaggctgttcaacacagcgttctctgtatctatcagcaggcgagtgaacagaacgttcggcataatccctgctcctgtgattagatcctgaagcagtcatgctaaggcttggttggtgataatcttgagatcggagaggcggaacctggctgccagtcggcgtgcaaacgcttgctaagttgactgggtccgaggcggcgatcatggtcttcatctggttgataatgttgaggacgtggttgggcgcatcttcctggagcagagtatcccagagagtgattgctgctattgcattctgctgtggggtgagaaaaaacgctgtcccttcgacgtcctgctgtccaatgagttctcgtgctcgtcgcccggcttccggtgtgcgttgtcatcgatcttcagcctctttcgcggcccgctcgtgttgctgctgctcacactgcagccggtctcactcttgcacttgtcgctcttcttccaatcaacgccgctcggcttcttgtcgtgtacgttgttcttctgcttcatggagttgacgctgttctgttgtctcattatcggccatgaaaacaccgaaaaagagaggcgtgtaattatcttcatagccatcatcgaaatcgtcgaggttgctaaagtcgtagttgtacctgaagtcatcgtagtcaaggatctctgttggctgtgaatcaacgcctggagagctgaggtagctatccaactcttctgttgaaaccgtcccgaggggctgaagtatgacgccgacttccctgaagcaagattgcatcgaggccgaggccaggtcccatctagacctatgagaagaagatgcctttgtggtgaaaacaacagccaaatcgtcagggagcttcatcaggatcggtggatagccgcatcgtcttgatttggtcgtgtcgaagtagatgagatctcgtccgagtggtttgaggctaactcggataagatagtcttgcggtagatctcgaccgagttcgggagaccgaacgggctcttcccaactattttgaatccgagtcgaggagagaaatcttgccgaagtcatcggtgatgaagttgaggctgccgaaccggtatgcctgaccgggagggaaggcaaagtcatcgatgctagaaacgaatcccatcgcactgatcggcgaaaagcttgatgcaacccctgcctggcgcgccaactgttgaaacaagatttcggcaatacaaaaaggggtggctatcaagcaggaaaagtggatgggtttggaggcaaggaattttatacaggttcaggccctctcaatgagaagtaataccctactcctgtcaggggattgatccgccgagtatgttattgatcgtatgatctgggagaaaagttatgccccaacaggcacccggacccctccttatatagtgggaggagtccgtattacaagatatagcccatattcctaacggaataggcaaataaagataaaatacaatcgtaaccgactaggaccctgggtatttccttgataaacaagttaggaatttaacccgagtcccttaaagatattctatccgaatatggtacccctattcccagtcggatatacatgccgtgtgggtatggggtatccacaatctccacacttggtgaatgaccaaatcgctccccaggaggcgatcttggtctttttcctttgttgcgagccttctcaccactttgcttctcatacttatccaaaagcatatcgaaggtcaccttagtcttactaggagctttagaacttgaagcttcactccgattctccttccacacaccaacctccggattctttggcaccatcatctttggcctaggttctccaatgaccactcctttccccttagtagattcggcttgctccagccgaatcaacaccttcttatcatcaaaattaattgtgttcaccggaaaaagaataatgattaagcttcatcttggaaccatcggtaaatttcaatcgtccttcatctatggccgattgaacctgtcgtcgaaacacattgcaatcattagtagaatgagaatgagaatcatgccatttacaataagctcgacgcttcaattcttcttgagatggtatgacatggcctttaggtaatctaatttgtttttcatgcaaaagataatcaaagatcttatcacacttggccacatcaaaactatacttaagctcactttgccgatctttacgaggagtcggcattaaattagaacacacaataggcttatttttgttagtccatgaccactcggcaacatacatatcatgatcaccctcaccatcactatcactagcctcagggtaatcaatcaaattaacattagacttcttctcatatggtctaacaaatttctttttttttgaaagaaagcactgtaggggaagcccccacagtttaaattttataaaataaaaccaagatatttacaacagattaatccaatttacaagtatatctctctcaaacaaattaagcctatggactaaaagggagagttcattcttaaagaaagctctccaggaggcaatggaaggtacaacattattaaaaattaaaccattcctttgcttccaaatactccaagcggcatagagcaccttctccacaaagtgtatcaaagatccatctacttaatccaatttgtacaaccggggaaaaagtatatcaaagatccatctactccatgtttcagaatatgccctcgcactagataagcctaatcaataaacggacgagcagctgagataaaagcaatttggtcgttaacgacccatagcccttttgttatccgagtaatcagagaagtgcactcaacaggcgcagagaattttatactttctaaccattgccttatcatacatttcacaggagcaattttgataatcaattcatcccccctaatgggtctcagatcacttctaggaaacaaagtcatagcaatccatttgtgcatgagcctaagtgtaggattatggatatcattccttttaggtttcttgcaaattggagcaccagaaatgtcttcccaaaacctatttttctcgaacccagaaattcctttctggagatcgattttacaggaatcgtgaaaaccaagaagtgtacttaagcctttccatgtaagtgtgtactccttatggaaaaagtgaaaggaaatacaatcttctatttctttcaaagtgcacagaaattgcaaagtaagcaaacgagaaccaggctcatctaccacagcaaatctctgcacatagtaggcttgcctctcccgatcactgacaaggtcgaggtcggtgtccttcaagagttgtcgcggagcttcggcgtcttccatcgagacatcaactgatgaacgagtactagtctcttcatgatggcttggtgaagagctggaccccttgaatagacgagacaatcaccttctcattctgtacaatggagcaaggacggactaactcggcgggggttaggaatgacaagaattttacccgccggttagtttcaccaaagcaacttgtatatatgcaactaagtgtttgaatttgaaggaaactatcaaagcttgaatgaacttgagagcaaactttggagagggaatgaaaatgtgttgaaatggggtggaattccctctctcggccggctggcttttatagggtacccacaacggtcataaatgacatgtgggacccactagccgttgccctgccaaaagtggcaggtagccgttgccaggccggttcggccgaacccctggtgggcccaaccggccccacttttggccgttggattccaacggtcagtgtggttgtggcatagtgaattttcgttgaaaaatttattttggtttgctctaaaaaattcatttgaagaattttctcaaaattcaaaaatcctaaatgcaattttgaaattcaaacatgtggtgatgcaaaaattcaaaatgttgaaagcaaatatgcggatacataccaatttacctgttggcgaaggtcgcgtcatttaaagtccgacgtgcaagaccgtacctccttccttgctagttcgcggattttccacccgtctccggaggtgatggagtgggcgtctttggcttcttcctccacaccttccttgattttggtgcggacagcggcttcttctgagccgactgctctagcttcttggccggtattgaggattttatcggcgtctttcaataacggttcctgggcatcgttgtttccttctccaggaaattctgcatgaatttcaccaagctatccgttttgggtggctccacttcgaccacttgaatattctgcaggtttggcccgtacttgattctgaccatggagcactgttccgtccttggttgaaactcaaacttttcctccttcccgttgatatggaaacgaatacttcctgttcccacgtcaatgttggctctcgcggtgctaaagaacggatgccctaagatgagcggcgtctccttctccgtgtccatatctagcactacgaagtcaacaaggatgaagaaatcctgtatcttgactggcaaatcctccgctatccctgccaggtaacggactgacgaatcagccagttgaaggcgcatccgtctcagtgccaacaccgtgaagttgagcttgtcgaagacgtccttgggcatgacgctgacactggctcctaggtcgcacaaggcctgctcgaactgttgtgccccgatcgagcagttgatcgtagggcaccccagatcttcttctccgggagcttgtggagtattacgttgctgcattgctccgtcagcttgaccacctccgttgttgggagtggtctctcgnnnnnnnnnnnnnnnnnnnnnnnnnnnnnnnnntccatggggccg

SEQ ID NO: 6360 - DNA, 838 bp, Oryza sativa
  unsure (1)..(838): unsure at all n locations
cgaataatatataggggttagttttgcagtgacagcatttaaagtcactaggtgcccatagcattttataaagcgacccaagagttacgcagtattattaaccaaggccgtgaaccctcccgaacttgcattaccacagagcttacgatgatctagacgaactgggcaacccgaccctgggtcccagctcgtcccaagccaacacaggccacccattccacattttagatgttgagcaaattttaagaattagaacaactgacttgggtacattgctcggcttgcccataacagagggtacggctattccaatacattatactctgatcagaggtgtacatcttaacccacaagacacatcttcctcacgtgcgaccacgtgccacataccaccacggtatacggacggaagacgtgacatagttcccaacccatcctagccataaacaagagtaccgacccaatccccctacggccggaacacccgggacaggtaggcaggattgagccccctagcagcagggcaccaaccctctgccacgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgagcttaatccttatagtgcccgaggtacgactaacaaaacccaaccacgcacctcgagcccagcctaaaaccgttttgtgatgngctacaacgagagagtcaaatcacggtcgcggc

SEQ ID NO: 6361 - DNA, 5756 bp, Oryza sativa
  unsure (1)..(5756): unsure at all n locations
nnnnnnnnnnnnnnnnnnnnnnnnnnnnnnnnnnnnnnnnnnnnaaaataataaatagaaattagagggagattagggaagttagaaaatttaaaataattagaatttaattatagatcaattatagtcgtagaattgcaaaatttaatataattatagattattttggtaatctctataggtgctcaattcacggtagatactcggattttattaataggaattttagacgtatattatatttaatcgtttagtcatagactaaattaaatcgtataatattataagataattttaggattccgtccaatatttagctcgcgatagaaatttctaacctattatatggatataatgctcgggtagattaaattaaaaacttatgataacaaaatatttatacccgcaaaaatagtttaggatgtataaatcaaaattgggttagccctagttcgcgaatagtaaagttaatataaaagaatcgacttccgcattcgacttctatttggatttatttggatttttatttgaattctaaccgaattcaaatcaattttcgcacgtaactatagagcccgagggagttgcggatccaagtgaagtccaagacccgcaagactttgagcaaggcaggtcatcactatcccttgaacatgttgatcccaattgcgaaattatttttatttacaaataagaatgcatgcaatgatgaacatcctatttatgaatatgccataccttgattattgtttacccttattcccttgtaaccatgattacgtatgagtgcctagtcggtcgaaggggaggcgaggccgagggcgaccttgccgctgcgatgccggaggagacggcgacgtcggccggcgcatgggcacggcggaaggggttgccgaaggaactccggcgaggcggagggcgagaccgagggcaggccggggtggagggcgacgcggcgacgtcgagggaggagatggtgacgtcagtcggtgtaccggtgatgaacagcagccggccggagacggaacagtggcggcaacgccactgttgccggcggggatgcacttccggaggtctccgcgggaaacagagggcaggccggcgaagaggaggcggctgcgatgctggaggaggcgacggcacggccggacggcgctcgggcgaggagggagaggcggctggaggcggccggcgcggggaaaagagaagggcgacagcggggaggggtgatacgaccacggggaggctcgggatgaggctaaaacgatagaacggaggatggggattccattttataggcgcggggagggagccgggcatgggagagggcggaacggcgacgggaaacatggccggcggccatggaacgcggccgggaatggcgcgggcgttcccgatgattgggggcacgaatcaagggggaaattagggggaattgatgaggaaggaatggggattaattccccccaatcagtttggaaagaagggcattgattcgcgtggatttagggaggaaacgacgctaggtttcacgggagagagaggatgccgggcgggaggaaggagacgaccgggtgggtgggacccaccggtcgggcgcgcagtcagcgcgcgtgcggcgcgcgtgcacccggctggctcggctcggcctggattggcccgggcggctgggccaaaagggaagaaggagggagggcggcccaaaagaagaagaaaagaagggaagtggcccgggagggaaaggggaggcccaagaggagggagagaaggagagggagagaaagagagggaggaagggaggactttggccgtaggccgagaaagagagagaggactttgggccagacttggcccaaaggaggaaggaggattattttttggtttttctttttaataaactttgatcatagttgtggttgcttaataaatatttccggtgctctaaaaattcaagtaaaatttgagggctctttgtagactaaggagaatttaacaaaaattctctggactacattcgaaattttcttgtacgcatttaaatgtttgccaatttcttttcaaattttaattaattctattattccttttagaaaatgatttttatttcgggatgaatttatcaagacgtgacaaccccagtgggacttagaaagcctatgatagtacactcacctgggggcgagataactgtgagtcatgcttgcataaacatacctattcgtcttagggatgtggtgtttccctccaaccttatggtattgataccccagaccctggatgtcatattgggtatggattggttaacaaagaacagaggggtaatcgactgtagacgtagggaagttaccctgaccacaccctagggatcggatatgagagcaaccatggatcaagatcctagactaaccgaacgtgccggaggcatatttaccatgctacccctaaaaggaatgcctgtagtgcaacgatttcctgatgtgtttccagaagatttacctaggatgccactagatcgtgacatagagttcattgttgatctgatacccggaactgctcccatatccaagagaccttatcggatgccagtcaatgagttggaggaacttaaaaagcaaatcagagagttgcaagaaaagggatttgtacgtcccagttcgtcaccttggggagccccagtgctattcgtcaagaagaaagatggtagcatgaggatgtctgtagactactgttcactgaacgaagtaactatcaagaacaagtatccactaccacggattgatgatctttttgatctactcaaaggagctaaggtgttctctaagattgaccttcgatcaggataccaccaattgaaaattaggaccggggatatactcaaaaccgcgttctcaacacactatggattgtatgagttcaccgtaatgtcgtttggtttaaccaacgccccggcatactttatgaatctcatgaacaaagtgttcatggattacttggacaaatttgtggtagtattcatcgatgatattttaatctactccaaagacgaggaagagcatgcgaaacacttgcgattggtactcgagaaacttcggaagcataagttatatgcaaaattcagcaagtgtgagttctggttaaaagaagtcgcctttctaggccacataatctcagccggtggagtagtagtggatcctgctaaagtggaggctattacggaatggaaagcacccaaatctgtgactgaaattcggagttttctaggcttggccggatactaccgaagatttattgagggattctctaagatagcccgaccaatgacacaactactcaagaaggaaaagaagtttgtgtggtcagaacagtgtcaggaaagctttgagcagctcaaagaaaagctgacctcggcgcctattttagttcttcccgacatcaggaaagactttgttatatattgtgatgcatcaaggcaaggactaggaggagtactgatgcaggacggaaaggttgtggcctatgcgtcgcgacaattgcgaccacatgaggaaaactaccctacccatgacctagaactcgcagctgtggttcatgctctaaagatttggagacactatttgattggaaaccattgcgatatctacactgacgacaagagtctgaagtatattttcacccagtcagatctcaacttgaggcaaaggcgatggctggaattaatcaaggattatgacttagaggttcactatcaccccggcaaggcaaacgttgtggccgacgctttgagtcggaagggccattgcaatcatctgagaacggaaggaatggcttctgagcttaaggaggaaatagcccaactaaacctacatatagtacctcatggacagataaacaccttggacattcaacctcttctgagaacccaaatagaagaagcccagaaggacaacgaggaaatccgagaggtgaaggaacgcctagctgcaggatttgcaaaggaattttcaaccgacgagaaggatgtcctatggtataaaaagaggatgtatgtacccgaacagagtggactgagaggattgatcttaaaggaagcccatgaatcggcatattcattgcaccccggaagtaccaaaatgtaccaggatctgaaggaaggatactggtggcccaacatgaagagagatgtggcagaatacgtagcactctgtggcgtgtgccagaaggtgaaggctgagcaccagagaccggcaggtttgctgcaaccccttaggattcccgaatggaaatgggatgagataggtatggattttattgttggattgcccaagaccgcaacagggtacgattccatctgggtgatcatggatcgactcaccaagacggcgagattcattcccgttaagacaaattatagcagtgccaaactagccgagttatacatgaccaggatagtatgtcttcatggtgtacctaagagaattatatctgatagaggcacacagtttacctcgcatttctgggagaaagtacatgaagccctaggaagttaccttgcgtttagcacagcttatcacccacaaacagatggccagaataagagaacaaaccaggtcttggaggacatgctaagagcttgtgcattggattttagcaaagattgggagagatgtttgccctatgccgaattctcctacaaaaacagctttcaagcaagcctaaagatgtcgccaaatgaggcattatttggtcgacgatgtcgtaccccactaatgtggtccgagactggagaacgggtggtatttggacctgacattgtcaaagaggccaaagaaaaggttcatctgatcacgtgaccgtttaaagatggtacaatcacgacagaagagttacgctgacacccgaagaagaaacctagaatttaaggaaggagattacgtctatttaaaggtttcttcgatgaggataacgaaaaggtttaaggtcaaaggaaaactagcgccaaggtatgtgggaccttttcaaatcatggctagacggggagaagtcatatatcagttacagctaccgaagaatatcgctgatgtgcacccagttttccatgtgtctcaattaaagaaatgcttacgagtgccggaagaacaagccccgctggaagagattcacattagcaatgatctcacgtatccagaacaaccgatccggatattggatgaagccaaaaagaggactaggagcaaagtgtggcgtatgtacaaggtacaatggagtaatcacactgaggacgaagccacctgggaaagcgaagaattcttgaggacagaatacccgcatctattcgaaaactggtaagaaatctcgggacgagatttatttaaggggggtaggtttgtaacaccctgaaaatttgaccaataaaaacaaaactctaaaaatacgggccttcgaaaacttttaaataaattgcatcatgccgatcttattcgcccactttatttggatttgatttcgaagttcattaatcgtaagtaaagaatagttaattaggaataaaccctagaagtaaattggtaaaataaatataatttaaaataaagattaggtggggatagaaatgaataaaatattatcgcgatcatatttgtattagttaaatctaaatacgacggaatgagaattaactctaattaaaatcaagtaagttatataaaaattaaatatgggtacaattaatctgatgacctactgtaccaatggttaat

SEQ ID NO: 6362 - DNA, 1478 bp, Oryza sativa
  unsure (1)..(1478): unsure at all n locations
aacaccgaataaaagtttactctatttaaaaccaagtagttatataaaaattaaaaatgggccaattaatatagagtggatccattggttgggataatacacatattgagtatactttatttatgcaagatttagaaattatagattcacttttatatgggaaataaactaaaatcgggataaatagaaaaaacccctattcattatggcgtaggtgtccaatgcggtccatagctttcccttctcctctccaactttggcgccctagccggcctttagccatgcaacaccaccgcccgtcgcgtcgccaccccgcaccatcgtcgtcgccatcgccgctgccgcaccatgcgccgtcgcgtcgcctcgcgccccacgcccctgccccgccgcgcgcctgtcccatcgccgcgcgctgccgttccgtcgccgcgtgcccgtcccatgtcccctgccgcgcgcgcctcgcgccccgagccgccacgcgccgtcgcttcgccgctgccgcgccgcgccgccatcctgccgccccgctcgcccacgcgccccgtcaccgcccgtcccgtcgccgcgcgcattccatcgccgcctcgagcccgcgccgctgttgccgtcgccatcccatcgccgcgcgccgagccccgcgccgcgccgcgccatcccatcactacgcgccgagccccgcgcgccaccccgagccccgcgccgccatcacgtcgccgcccgtcgcgtcaccgcagttgcgttgccgccccgagcccgcgccgccgtcgcgtcgccgccccgagccccacgccgtcgttacgtcaggccggccacccctccccctctctttcttccccctctcccctataaatactccacaccccctctccatttctcccactccatctccctctttctcccctcttccctctccaccgtgccaccgccttcgtgccgtcgcgccgccgccctcgcgccgctgcaccaccgccttcgtgccaccgcgccgtgcgccgtcgtcgcgccgccctcgcgccgccgcaccgccgccttcatgccgccgcgccgtgcgccgtcatcgcgccgtcgtcaccgccgccgccgtcgtcggtaagccgccgcctcctccccttgctcggtcgccgtcgccagagagccaagagagagagaagggagaagaagccgggagggagagaaaaaaagaaaagaagaaagagagaaaaaggagagaaaaaaagaaaagaaaaagggagagaaaggaagacgggaaaagaaaagaaagaaagaggagaggaaaagaanagggaataaatnataaaatggaattagagggagattatggaagttatgaaatttaaaatattagattttactatagatcaatataggcggagaatgcaaaattaatatattatagatattttgtaatcttatagtgctaaatcacggagaactcggttttataatgggaatctagacgttttatttgtatc

SEQ ID NO: 6363 - DNA, 4725 bp, Oryza sativa
gcggccgttgatcgttcgatctgcaagtatgttatcagtataatattataagataattttaggattccgtccgatatttagctcgcgatagaaatttctaacctattatatggatataatgcttgggtagattaaattaaaaacttatgataacaaaatatttataccagcaaaaatagtttaggatgtataaatcgaaattgggtttgccctagttcgtgaatagtaaagttaatataaaagaatcgactttcgcattcgacttccatttggatttatttggatttttatttgaattctaaccgaattcaaatcaattttcgcacgtactatagagcccgaggaagttgcggatccaagtgaagtccaagactcgcaagactttgagcaagacaagtcatcactgtcccttgaacatgttaatcccaattgcgaaattatttttatttacaaataagaataaatgcaatgatgaacatcctatttgtgaatatgccataccttgattattgtttacccttatttccttgtaaccatgattacgtatgagtccctagtcaactatgacaaatgcttagagatgctactctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggatgatttgggtggtatccggaaaaggctagtaccgtccccggtcaattaaggaccgagccatgaagttaagcttgaaacgacccccgtacaaccgcacttctcgtatgggtatagacctagcggaatagatggctgagcggaggcagtatccatgcatagtggtttcttgatgggtgaggcaggggctctacggtggggcagccattggtagaaccgcgaggcgggtgtctacagtggtgtcgccatcggtaagccatgagaaaatttaaacataattataacataatgcatgtgtgagtctttccttcccgtgtgcgccagaactcctctcgctgctagaaaccgtgtacgcctagagtgcatgaggatgtaaagttcatggagcgggtactgccaatgcgaggttatcgaaaagctttgccgtgacgcgtctcatgtgttgggacgaggctcatatgttggacagtcgtggagtgcgggtaaagtgtacatccactgcagtgtgagtaaaccaaatctattcgaatagccgtgctcgcggttattgagcactgggacatgtattacacttggctagactctaaattcttaacttgtgtgggatgggatattgcatgatgatttctatactgatggagccacttcctgagaggcgggaatgtggacgttctcataaaaacatgatgacttgggcgatggggggaagctatccttgggatcacaattgatggtggacagaaccgtattgtttaatatgaacactggtactaaaatttgatcagtctgtgctaggtcttaggtttgtgaaaagaattacaaaacttgctttgtgcaaaagaaccatagctatcttttgaatacccctgtcatatgcattgttgttgtggtggcttgttgagtacggttggtactcacccttgcaaacataaacttaatcagaggccggagatgaagcttcggaggatccctatgcctattaccaggagggtgatgaagacgatggcgctcagtaggtcttagttacggtcgttgcctgtggcaatggcgtgctcctgccttaactccgctgccttacctacttctgtttttggaatgtattccggaccgctcggtccgatgatttaagactgtgcctgcgggcctatgatgtaataattcgtacgagactctcgtgtatgtgtacttggtatttcatctatgaatttgtgtgtaccagactacttgatccagggaaatggtactgtttacacgattgattcctgttataaaaataagggtccacatatttccttataagtttgcatgtaggtactttcctaagaattagtatgaatgtgattgagtttcgaattttgagatcgtacaaaaatcaagcccactaatttcggtgtaattgctttatttccatcaataccgatttgtttccattttctatgtcattatatacttggcaacggtatcttctttgtcgctgccgccggtcgtctgtgatctgttgccttcgacgttcctctgcgagtttcttcgtcgccataactagtcctccacgctgttgtgcgccgctggacatccgtgagcgtgttcgtcatcgctgccgctagtccgtgagcttcttccagcctgctgtctcatccacagaggtcgactgcttctggcctggcagcatggttccaactgcatgccccccttccatgattggaggtcgaaggcttccggcctgcctgccatccaatcgtaatattcttttatagcaaaatacgcatggcttgagaattgttctcgctatggatacccttttttgaaggacgaagaatctcattcaattatttttcatgcttttggtcttttatggatacccccctccactcttcttcccgattcccccaccttctcgcgcggcctatccctcccaacccgagcgcgcgcccctccccttttttcttctgatcccccctccacccctcccctttcttgagaaggaaaaaaataaagggaaaaattgcatttaatgggaatatagaactcaagacctacaacttaaattaccacatggcactaaccagtaggctatgtctcaattgtgataaagttttcttagtaaaattttatcttctcatatgtgctaatccttgtagtatttggcacaaaacacgtagtaacgatactaggaaggttgttagtatacacttcaaaccatcttaatgcactatcacaaatcttttactacacaactacaatagcattaccatgagaattatagattactattgttaccatcatttaatttttatgagtaggggtcaccacgctattgattattgttcgtagaactaacgattcctaaattttagtatttactcttgctcgttactgctttgtactatgtgttactgcaaccccatagtaatattgttaaataaatatagtaacagtgtaactagtgtgtagtaacagaatagatataatcctagtctctctctccctctcatgatccctctgctttctcctctcccgatctctctctcttcccaaaaactaggccttcctctctcttctcaagaaaaccggtatccttccttcatgtatgtacttccacccttgtcatagtaacgccatcatgagatatagtaacgcgtccagttactacaaaatatataggttgttattacatttaactgactagtattactaggttaaagtctcacatgctaaccaaatacttgttaccgcacaaaagtagaagtgttactatataataggtgcatcttaccacttccaagtagctatgttactacacgataattgtagttttactatgtcatttttacaagatgaagatcgaattggtgggctataggtaaaatctatagggggctttgagcaaggtctgattgacgtaggagtgttttgaacaattttatacatttagtaaaaccatgttactgtatgtatatgtccttgttactgcaaattacacattctgttactgcatgtggagggttaaagttcaaaatgccaatctttgaaaagcaatatctcataagatatgcattattttttaaaaccgtttgcacagtgatgctatagtgttactgcatgtggagggttaaaacttcaaaatgcatctacgtactcccctcctcaagaaactgtttttcctctttctcaaaaaatcggtctgctccctccaatacagtgttactgcatgcctgtatatgacattactgtacttttgacaataatattgtggtgaattgcagtaaatcaggaattgaaacaaaaaatatatgggttcaaagtctcagatgctaaccatatacttgttactgcacaaaagtaaaagtgttactgcacgacagatacacgttaccacctgacagttacacattaccgcatgtttatgcagtaacactatccaagagctgcagtaaaacactttgttactgtaggacatatagaacgttactgcacctatggcagtaacatcgtggtgaaattatagtaaactaggaaccaaaagaaatatatggattaaaagtctcacatgctaaaaatacttgttgctgcacaaagtagaagtgttactacatagcaggtacattttaccacatgtttatgcagtaacactattcaagaattgtagtaagacacattattactacaaaacttatggtctttactgcacacttacagtaacgtcgcgctgagattgtagtaacgtataagatagtagtaacgagcagtaatgctatagtattactacttgtagagagtcaagatccaaaaaccccaagcttcgaagaacaatatctctgatgtgatgtatgatttttttaaaaccgtttgcaccatgatgttaggaaaaaaagtgcttatcaaaactagatccgtcatgactatatttcaactaaatttgaattgatgagcgactgtacaatctgtaaggcgaatgggagcggcg

SEQ ID NO: 6364 - DNA, 37746 bp, Oryza sativa
ggcccaagtctctttttccctctcctgggcctgctcgcgccgggccgtttcagcccagtccaccgcgccctcctccctctttttctctcggtgccgttgacaggtgggacccagctgtcaggtcgtcttcttcctccagcctctaaccgccgcttgtagcaccgcaagccaccgccgatctccttccaaaatccggccaccactttcctcctctggccgaattgattgaggggaaataatctcctcgatctcctcttccttttctcttttggaatcctgggctaatttcgtttggaaaccggcagattcgagttcaattcggatcgatctctctcctctaaccctagactttccatctcgccgccggtcgccgtgggcctccctcgccgctcctagcccttataaaaggatccccgggacctcctctatccgccgccaccttcgccctagcctgtcgtcttctctagcgccgcctccgcgtggttctttccatagtcgccgccggcgagtgtctagtcggtcgctgctgtcacttcggtcgtcgccgtcggtcgccgttttcttcatcagcatcgtgaggtcgtcatcgtcctcgtcccgtcctccgtttccgccgtagcccgtcggagcgccgccgactccgtcaacccgaagctctccatcgccgccgtcagtccagccgcgtcgcgtcgccgttgcagccaccgccttcagttgtcgtcgccaccgtcgggatcgcgaggaggagcagcgcctcgtccaccccttcgttgccgccgtttcccgccggagcatcgccgtcaccgccgacccgaagaccgccgctgcttcaacctcgccgccatcgccgttcgttgccgtccgccgtcgttcgtgacctcggtgagttcgccgcgtcgcccgctacccgtaggtgtcctccgtttgcaccgccgcaccgtcgttcgccagcgagcacgtggtcccgagccgccgccggtgatgacgtcatcgctgaggtcagcgccacgtcacccgtagacccgcggtagatcaagttgatctcggccgtccgttttggtttagatcgatctcggccgatcgttccgtagatcgtcaccgtgcacccggtccaccatgagcctgagcctgctgacgctataaatcttttttccttttcaaaaataattctttattgcgtcataattcaattaaaatccatataaatgctttaatccggtttaatctttaaaaattcataactaatacattgtaactcggtttaatgtggttcaagttgcaaaagttgtataaaataaagatctacattttaaaattatccataaattgaattaaatttatttaatcttttttaaataggctttaattagattaaatcttgtaaaattcataattaattcatatgaagtcagaatgaggccgttcaagtctcataattcatctaaaattatgatttacatgattgtttactttatatctattgtttatttggtttttattagtctttttcctcgttttgcgtgttagcttgtcgtttccatcgttccgaaggttcgcgagtgcgccagaagtgttcaagaagattaattgaagaacgaatattgaaaggcaagtcacacagatcccaaacacaatcctttgagcatgttgatcctatatttaaattctttatttatttcaactatgcatttattttcgaatgtcaccgggtggtgtgaattattcctttgtatggccaatttgtattgattactctattccttgataccttgggttattataatttgactagttgagctttatatattggttcagctagatgttagacataattgcttagccatgcttagaaacattagcacacaattgggataactaatgtttcactattacttaatgatggatatttaatgatagctcacgatggtcaatcgtgattggttaattaattagtgtgccaactaaaacttgataatggtgggttgtgagcacatggttttgatggtcgtgctcatgacaattaaggactggttcacgagtttcgattgtgaaacattaaccgtgccgaccacaagccagcatgggcaacggctttaccttttgtatagcatggttcattgcggggcaccagactgagaagtggcggagataagccgacgggggtcgctggggagtccatgccttgtttataagggggtgattatgatccaggaacggtgcactgctttaagttgtgtcacgcccggaaattcattagtattttccgaactaatttgtgcataaaatcctcgtccaggaatcagccgaggtacacaaactgacaatttaatatacagattcatcaaaataactaaaacgataaatacttacataagaggcacttagtcctcaccatgaagaaaactgcagcggaaaataaaatctagcgaagcctcagctccactcctacaggcagctcaactgggatctaagccaaaggtcttctccttctggatcctttttcttcaactgaggtttgatgattattgcaagaatgagcatatgacatactcaacaagctacataacaaatatccaagtgcataaggataccaaaggatggcataatataggctaatttgcaaaagcatcatttagcaaagatttaagaatagtaaaacagtagagtaattaatcatccatattaatcaacactgaacagcaccccaatgctgcacaggcccaaccaaacctgaacaaccaaccccggtcgtacagatcaaacctccaaaacaggaattaaccattccaaaccaggagtcaaattaattatcacattactaccattaatgagtagtgtgggactaatcacgaaaacattgctcaaccctcccataaccgcgggcacggctattcgaatagtattactctggccagagatgtaccactgtacccacaagacacgattccacacatgtcgccatgccccgaagtaccaccacggcactgcaaagggggaaatcgtgacaatacccttcgcacaacacaactcaccacagtgcaccattcctggatcataatcaccccctcaaaaactagaggcatggactccccagcgacccccacggacttctcgccgcttctcagtctggtgccccgtaatgaatcatgctatacaaaaggtaaagctgttgcccacgctggcttgtggttggcactgttaatgtctcacaacagtagctcgcaaaccggtccttaattgtcacgagcacgaccttcaaaaccatgtgctcacaacccaccattgaaaagttttaattatcaattaattataaaaacacgattaaccatcgtgagctaccattaattataaccataaataataatgtagtataattcatcccatttgtgagctaatgttcctaagcatgactaagcaactataaataacatctagctgaaccaatccaatatataaggtccatgctagtcaaattataacccatagaaaaataaagtcatgtttggccataattaaatgggaaaggctcaccacccgatgacattctaaaataatgcataagttgaaataaaacaatagctttaaacgggttcaacatgcttaaagggttgctcgggatctgtgtgacttgccttgcaaacaagcgtcttcaattcgtcttgaggaacatctccaacgaacgaacgatcctccgaaacaacggaacgcaaaacgagaaaaacactaataaaaaccaaataaatagatagagcttgaatttagatgaattatgagacttgaacgacctcattccgagttcgtatgaattagatatgtattttacaagatttaattccaattaaacctatttaagaaaagactattccaaattgattaaacaatttacaaatgatttatagctgagacaaaagattaaaacattctccggtaaagaatagatcatatttggtaaatgacatatattaaaaaggaataatatgtcattaaaaagagatgataaatttatattaattttggatggccaagatggctctgatgtcagcgatgacatggctgtcatgcaggatcgacgccggcgagcatgggaacggcggttaccagagaaccacgatacaatgacgcagacggagggcaccgggagagagaggagatcaaggcgacccttaccaccatttacgcgacgacagacggcgagggagatggccggcgacgagctccaaagggtggcaaccttgggttgacaatggcgacggctttccggcgacgggcggcagcaacggaggggtggacgagcttctcctcacagctacgaatccaatggaagcaacggcgaccgaaggcgacgatagacgacgacgaacagcgtggccggagatagattagatcggcttcacggtgacgacgacgctccgatgacttgcggcttcgtggaggtggctgccgggcttgctgttatcgctgcgatgccaacggaggagacggcggggttcggcgaccacggagtcgacggcaaagcttcgccggagatcaaaacatggcgatggttcggccttcacggtgacggcgaattccggcggggtttggcgcaaaggaacgggtggccggggtagctctcacccttgcgaagccgagggaagcgacggcgcaggtcggggacgaccgaagaggcggcgcgacgtggctggagtggcagccggcaaaggagagagaagccgagcgtggcggcggcgctagggctagggaaaaattcgggaaaaaggaggaaacggaagaggagacccggggcatgctatttatagccaaaggaggaggagatcggctgggatacgaggggaaacggcggcggattagttagggttcgccggaaaaacggagctcgaaaccgcgtcgaattcacgcaatataccacgggattcaagggggtttcttggggataagatagaggagatcgaggggaatccgttcccacaactaatttgagaagaggagcaacggagaggatgaatttggtggggaggtggcgctgcacacgggcacggcagggaggagatcgacctgctggaggttaggggcgacactgtagcagaaggatgaaaacagacttcttaattaattcatacgaagtcagaatgaggccgttcaagtctcataattcatctaaaattatgatctatatgattgtttactttatatctattgtttattgggtttttattagtctttttcctcgttttgcgtgttagcttgtcgtttccatcgtttcgaaggttcgcgagtgcgccagaagtgttcaagaagattaattgaagaacaaatattgaaaagtaagtcacacagatcccaaacacaatcctttgagcatgttgatcctatatttaaattctttatttatttcaactatgcatttattttcgaatgtcaccgggtggtgtgaattattcctttgtatggccaatttgcattgattactctattccttgatacctcaggttattataatttgactagttgagctttatatattggttcagctagatgttagacataattgcttagccatgcttagaaatattagcacacaattgagataactaatgtttcactattacttaatgatggatatttaatgatagctcacgatggtcaatcgtgattggttaattaattaatgtgccaactaaaacttgataatggtggattgtgagcacatggttttgatggtcgtgctcatgacaattaaggactggttcacgagtttctattgtgaaacattaaccgtgccaaccacaagccagctgtcacgcccggaaattcactagtaatttccgaacttatttgtgcataaaatcctcgtccaggaatcagccgaggtacacaaactgacaatttaatatacaaatccatcgtaataataacgttacacacttacaaaagaaaagatcaagcgatggcttcagctccactgtcacgaccggaaataacccaacgggcgttccttacgtgcgtgcattaatccttgtcccaggaggcaaggtacaccaaaagttgatacaattcagagtataacaagcggaagcgtaaatagttaatttaatacatgggcagcgaaggcccagcacacacagagacaaacgagaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggaattataatataaagggttagggttgcagtaaacagcgtttaaagatatttagttgctcagggctattttgcaaacacgaatctagtactatacaatgttaattatcaaggccgtgaacccacacgaacctgccttaacccaaggcctacgatgattcagaccgaactggcaacccgaccctgggtcccagctcgtcccaagccaacccaggccaaccattccatattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctggccatagacaagagtaccgacccaatcccacctacggccggaacccccgggacaggcaggcaggactgagcccctagcagcaggacaccggccctgtgccatgacatctcgactaccgaaccgcagcccgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagccgaaaccatttttggggattttgaatagaaggagcggtgtgaagccaattccacaatagaccaacaattccaaagtgtccaggtgatatgaatatcccaaagtctagagttgtaaaaccgcctaatgttacctaattaaatagcgaagcatctacctaaaatcatactagtggtaccatgagtagagtgtccactagttggggttttgtttattctagggtgaacaaggtaataataacaataacaataataaggtcataacaaaggtaaataggcatggctaaataaaacagtgataatgcgggaatttaaataaagcgataatgcaataatttaaatcataattttacaaactgggattcaatatgttcaaagatgatgtgacttgccttgctcgctttcccaaacgccggcttcaacttccacgaagagcggatcttccggagctgcagcgtctacacgaccaacgaaaaggaaaaggcttttactctactaaactccatataacaagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaatttaaaatcggatttattgcgtcagccgaggggaggggcgcgcggaccgggtccacgggagtggggcccacgcggcagcctcacggtccacggtggaccgggtgcacacggcttacgccggctggcgccgtgggtcccacgcgtcagccgcacccgaggacgcgggcggctgacggccgggccccacatggcagccgcggggcgcgcccgaaggcggcctcgccggcacagccgacgggaggcggcgcacccgcgccccgatggtcgccggcggcgacctccggcgcgacggagcggcgcccgagagaggggagtgaagggggaaacgaaatgggcggtccacggctcaccccgggtcgacgacgacgacggaaacggcgaccggagtggaggaaggcggcggcgcggctcgggtagacgaggacggcggcgttccggcgatcggcgaccgaaacggaggggtggacgaggtcggcgaggacacggcgaagccgaaggaggcgatgccgaagcgggaggaggtccggggcgacgacggcagcggaccggagctcggcggcgacggcggagatagagagcgacggcgcgagctcgattccgacggggagagagagcggcgagcggcggaaacggaggagggaagcacggggagcgtttatatagcgttgggagggggagagggcggccggaggggaaggaaaccggcgcggcgatctcgggctccatcaatgacgccggcgaggtttgcgggagggtttccaaacgaatccgagggagagagagagggaaaagtgggggggaaagggagagggaatcacggggagtgatttccccctctttattgcgcgcggggacggcgggatgcggcggaatccgcggcggcggcggcgctagggcacgggcgaggcggcgggtgcggcgcgaggtaggggatgacgggtgggccccacccgtcagcgagggtggcgggcgggcccgcccgtcagcggcgctcgcgcgggggaaggccgatgggccgcgggggagaggagagagagggagggagctgggccgagccggcccaagaggggaagggggggaaaaaggacttttagggtttttctttttataaaaccattttaactttgtttatttcttaacaattattatttgtgctctgaaaattccactaaaatttatttacgcattttaggcttttaggaaatatacaaaaatcctccaagccttatttgacttttatctttgcaccttttaattgttggaggctttcacacggattttacttattctatgcacaatttcgaggatgtattttagagtcgatttgggacgcgacatccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatgtcataatataggctcatttgcaaaagcagcatttagcaaaacatttaagagaagtaaaacagtggagtaattaatcagaaattttaatcaacaccgaacaacacacccatgcagcacaggcccaaccatcctgaacaaccatacccggctgtacagatctaactccaaaccaggagctaaacaaattattaccagttatagcatccataattattgtgagaggtgtgagactaatcacgaaaaacattgctcaacccgcccataaccgcgggcacggctattcgaatagttttactctggccagagttgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggacttcccagcgatccccgtgggcttatctccgccacttctcagtctggtgctccgcaatgaatcatgttatacaaaaggtaaagccgttgcccacgctggcttatggttggcacggttaatgtttcacaacagtagctcgcgaaccggtccttaattatcatgagcacgactctcaaaaccatgtgctcacaacccaccattatcaagttttagttggcaagtaattaattaaccaatcacgattaaccatcgtgaactatcattaagccatcattaaataataatgagtcataagttatcccaatagtgtgctaatgtttctaagcatggctaagcaatcatatctaataataattttgaatttaaatataggatcaacatgctcaaaggaattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacatataaagtaaacaaacatgtagatcataattttagatgaattatgagacttgaacggcctcattctgacttcaaatgaatttataacgaattttacaagattaaatctaattaaagcccatttaaaaagaattaaataaatttaattctatttatggataattttaatatgtagatctttattttacacaacttttgcaacttgaaccacattaaactgagttacaatgaattagttatgaatttttaaagattaaatcggattaaaacacttatatagattttaattgaattatgacgcaataatgaattatttttgaaaaggaaaagaggattattgcgtcagcgggctcgggttcatggtggaccgggtgcacggctgcggtctacggaaacgaacggccgagatctaccctatccacaacgaacggccgagatctaaacggtctacgaccggtctatggcggacggcaacgatgacgtcagcgatgacgtcatcaccggcgacggctcgagcggcgcatgctcgccggcgaacgacggcgcgacgacgcaaacggaggacaccaacgggtagagggcgacgtggcgaactcaccggcgaccaaaacaacggcggaagagcaacagacggcgccggcgacgaggaagaagcggcgacggtcttcggatcgacggtgacggcagtgctccggcggtcttcggcggcggcgaagcggtggacggggacggcgacgacctcgcgatcccgatggtggcgacggcgaccgacgacggcggctgcaacggcggcccggcgcggctgaaccgacggcaacgacggcgacggctagggctacgcggaggcagcgctagacgcgacggcgggctaaggcaaaggtggcggcggatagaggagagctcgggggtgcttataaaggggctagctagcagcgacggaggcccacggcgaccggcggcgagaaggaaagctagggttcggaggagagaagtcgatccgaatcaaactcgaatccacggatttccaaatgaaattagccgacgattccaaaagagaaaaggaagaggagatcgagaagatcatttcccctctattgatttcaccggatcgggaaaaagacggtcggacttggaaggagacgacggcggtgcggcgctagggttcgagcggcagccggcgcgaggaggaagacaggcctgacaggtggggcccacctgtcagcgggagagagagaggagagcggcggctcggatgcgggccagcttgggccggggaggagagagggagcggttttgggccgactgggccggggagggagagagaaagagagaggttttgggccggctttcggcccaaagccaaaagagacttttaaaaacctttttcaatttaaattattcatgaaatgatattccattgattaaaaatacttccttggctcaaataaatcccagaaaaatctaggaactatataatcaagtaaagtatttaatgaaattttatctggccctattttatattggaatttattaattaaaattagatcttctcttttaggcttttaagatcatttctaataattccttttaaacaacaatttataatttaaggatttttaaacaagaaaagctcttaacataattataattagatcattaatgatcaaataattactgaactgttctttgtatcatttaggaattgagctccgaaaaatccgagaaaatttcagagagtatacttaatcatggagaatttaataaaaattaaatccatccatgctttatatttaagaaattttatttcccacatttaacttcacttgtaaattaaagaacatttaatataaattctaataataatttattaaataatttataaatcctgaaacaaaaatcaggatgtgacaccagcgtgggcaacggctttaccttttgtatagcatggttcattgcggggcaccagactgagaagtggcggagataagcccacgggggtcgctcgggagtccatgccttgtttataagggggtgattatgatccaggaacggtgcactgctttgagttgtgttgtaattaataatgatgtggtaattgatggtaattaattagctcctggtttggaatggtacattcctggtttggagatagatctgtgcagccgggtatggttgttcaggatggttgggcctgagcagcatgggtgtgctgttcagtgttgattaatattgatgattaattactctactgttttacaattctcaattgtttgctaaatgctgcttttgcaaatgagccctatattatgccatcctttggtatccttgtgcacttgcatatttactgtgtggcttgctgagtatgtcatatgctcaccttgcaataatcaatcaaaccttagttgaagacaagttgcgaaggagaagacgtttggcttataccccagttgagctgcctgtgggagtggagccggagcttcgctagaccataattccgctgctgttttctcttttcttttataagtatgtaacgttgtattattgatgaatctgtatattaaattgtcagtttgtgtacctcggctgattcctggacgaggatttaatgcacaaataagttcggaaattactagtgaatttctgggcgtgacattacacaaatgcagcggaaaattaaaagataactggagctaagccttgacttggactgcaatgggaacaccactccacaggcatcctcgacggctcggatgaagcctaatcctcggaaaagccaccatctgacgcatactcaaactctggggtttgggaaaaatagagcaagactgagtactacccactgtactcagcaagtcataccggaataggggtatgatgcagggaaatatcaaaggagagctagagaggtttatttgcataaagcaagcatttataaatagtagttgaaagcagtaaaacagttgtgataattaatcaatattaaccttccactgtccaacgctacaccacgttgcaacaggcccaaccatacacctagactattcaattccattaggctagactagggtgagactaatcacggtgaatctggttgaccgcccataaccgcgggcacggctattcgaatagttttactctgattagaggtgtacaactgtacccataagacacagccccacgacacgtttccttgtgccgacatgccaccacgacataccggatagaggccgtgacaggacccttcgcataaccccttctaaccaagcacaccacacctcaggtttcaccccaacgcctcgcaaggcagcgcgcagtctcctctcgtgcctacgtgaatccggaagtcgcataggccgttacagggcccatccaaactccatcacgcccacccttgcctggatgcgtcagctagaggaaagtgacactacaagcccagccgttgcccacgctggcatgtggtaactacgaggaattcttctagggtttcccgcgaaccggttcttaagtgccatgggcgcgaccaacaaaaccatgcacccacaacccaccatatgatttattttaattaagaaacgccgggacggtggctctaatccaacatcaacactagaacctgaagtctatacattaatatgatttcccccattgtgtgctagttgaactaagcatggctaagcaatccctagtccagtatctagtcatgttatatcccaagctaacaaaggaacatggtacacaaataacatggctatagcagtaggtaaacatcccatggtattaatgtaaaacaatgcaatatttgaaggaaaacaatagaacctttgcaatataggatcaacatgttcaagtgacaagcatgacttgccttgctctgctgctggaggaacctcagcgactatttcaaagtacaccggagcgtcgggagggccggaatctaagcgacatagaaagcaaacaatacaaacaggctataagactactgaaaaagagaacaaaaccatttttaatggattctatgaatttttgttgatttattgagacttgaatgggcttaaacggagctcggatgaattagatatgaattttataagattcactgtgtttttactataaatagaaaaatccttaattgaattattgcgcaataaataaatcacgggagagagaggggcagcgctgacatgcgggccccacaaggcagcgactcggggagggcggtccggggaggagcggcgcaccacgtggtgcacacgtggcgccgacgcggcgcacacgcggcggccacgtggcagccacgcgggcagccggaccgacggccccgatctaccgccaggtagattggacggcggatgcggctcgcggccggcgcgcacgggcacggctcaagccgatccgcggccatggcgcgaggcagcgaccggccagcggcggagggcggcggcgtcgcggtgacgcgggcggcgatagcggcggctaagcggttaggcagcggcgcggcggctaagcggcgcgggagtgagggagaaaggggaggaggggcctcaccgacgacaatcgactacggcgagcgacggagggcgatggcgacggcgggacgagcaccgggaccacctaaggcatcaaaagggatgagttagagagggagagtgaaaccatggatggctagggcggcgaccgaaggcgccggccatggcgaagctcaccggcgcgcggcgcggacggggttccggcgttgaatcccgacggaggaggggtggacgggacggcccgcacgacggcgcagacgacgacgtcgatggcgcggctcggcacggcggctagcagcggcggcggtagcggagacgagggcgacggcgctagggcgatagagggcacgggagctggcgattgcaaaacgaaaaagtgagaggagggaacgggggtgctttatatagacccacgagggtcgatcatggccggggagaccacgatttcgccgccggagtggggagaggtggggagaagagaaaggcgggattcaaatgttgaatccccgccgtcttgagcgcgggcacgggcggttgagagggggaagggggcgcgggggacgcgggcgcgagcgcgacgtgggcgacgtggcccggaagacgcgggagcagggtgcggcggcggttgcggggcgacggcggcgccggctggaggtgggagacgggcctgacaggtgggccccacctgtcggcgacccggggagagaggaggggtctcgggcgactggctgggccgtagccttcggccggcccagcggggaggggagagaagagagaatgggccggcggcccattcgaaagagaaaaaagggaaaaaggaaaagaaaaagaaggaaatgaattttcctaggattaaataatgcttgtgctcaattttaattggttaaaattatttctagagctctgaaaattccactaaaaatcttgttagcgtatttcgacatgtagaactcaagaaaaattccacatgccaattccgattattatttacattaattcctttagggtttctctcttgcttttacaccgatattttcttgagaccatttataaaatcaatttaggcttaggagaagaacttcagggtgtgacaacatgttactgcaccgtcctgggatgagagctgagaagaggtgggtggtggggggagttagtaggcgggtttgaccggtgggagggccctttgaccgaaatggaaggtgggttttgggccttggtaaggagggggaggtgggtgtgatccttgggagggaggagggtatagaatagctatattatacccggctgtagaatagtttttctatatatacatatacatatatgtatatattatagatatgtatatatatatatatatgtatatgtatatatatatgtatataagtatatatatgtatatatatacatatacatatacatatatatatatatatatgtatatatatgtatatatatatatatatgtatatgtatatgtatatatatatatatacatatgtatatatatatatatacacatatatatatgtatatatatatagcatcagttaatttacctatataggatacccatatgggactgcatggtgcccgggctccgaggtataaaacatacaaattctctcaaatttttaaaaatattcaaattgtgagtatatacctaggtatatgaatttgattcatacatataactaacaacaaaacaactcaaactcaactttatttcacaattcattattacatacctaacgaattatatgtttgaatgttatatacctagaaccaaaatctaacaaaaaaaagttcaaactcagttcaaacttgtttgaacttcttagtaaagaagttaatgttcatatctaaacatttaaaaaaatttcatactcattcaaattgggtatatactcaatttgaatcttggagcccatactccatgtagcaccagttaatttacctaacatcctgaaaatgtgtcaatttctaatcctgcgtcatgccgcttctcatgttcttaataacttcctaaacttaggacaatataattagatagacctcctagtactaactcacacaaaacctttctggtatttaagttcttttgtgattttcatttaaaatacatgtggttgaatcgagatatttcttgatttggtctaaaaccttgttttgactaaaatcgtttattcaaatttagtttgaaaactccttttattttcatgaattatggtccaagaaaccctccaactttacccttgaacctaaaccaaatccttgcaattccaattttattggaattaattgtcgacccatcccttacctatccttcgattccaaacctatccttagtcccctttccaaattcttccttttgatctagccactgatttaattcatgtggcttgatttccttctcggtacaaaaataatattacaaatattgtgaataattgctcttgtgctaagagaatagactttatccctccaccctaaattcaaaacctcatttagcccatatctaaatctctaaatttcataccaaatattttgggctaaaattctatttactctactccctccatattccctccacatactcaaaaatattcaaatctagagccatattatttatggtgttgaatattttgaatttctatttgagtgcattaaataaactccatctttaaaatattgcactcaaaccaactagaggaatatttcttttggaaattatatccaaatataatttccttctgaaactctctcattcaattttccttcaaattcaaactatgcaaatcctattccaaaatttagaaatcagttgtcttagtttgggccgaaaattcctcttttctccctttggtccatctccctccttggcccatgtcggcccagctgagcagaggcagccgccaattcctcctttgtgggcgcgcgctcgacgccgccgcaactgccgtaagcagctttgtcaccgccgcccacaatcttgccaccgccgctgccgccttgccgaccacgccaagccgacgccgtgccgtgcacctcttttgtcacgcccagaaattcacgaaccagaatttctaagttgaatgtgcattaaatccctgtgcaggaccagccagggtacacaaacgacaattgttgacatacagatccacgtcttacaaaaatagaaaagattacaaatgcagcggaaaagataaaagcgagctaaaccgggaagcttgacttcagcagcggggcgactccactccacaggcaatccttgacggcagcgacaaaaccaacttcaacaagacagctccaactagaaagatcttcagctctggtgtgggggaaaagagagcaagactgagtactacccactgtactcagcaagtcatactggaagaggaggtatgatgcaggatataaccgaaggaggctaggggttcttttgcataaagctagcatttaaaagcagtagttgaaagcagtaaaacagctgtagtaattaatcaatattaaccaatcactgtccaacgctacaccacattgcaacaagcccaaccaaccacctgaactacaccagttcattaagctaaactaggggtgagactaatcacggtgaatctggttgatcgcccataaccgggggcacagctattcgaatagttttactctggccagaggtgtacaactgtacccacaagacatgattccacacatgtcgccatgccccaaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccagccgacccaactccatcacgcccaccctcgccatcggtgtctaggaaagggtcgagctatacttcagatcaagcagttacccactcccgcttgtggtaagcacggtaggtctcccagggtttcccgtgaaccggtccttaattgccatgggtgcgaccagcaaaaccatgcacccacagcccaccattcagtgtattttaattaattaacaccattgcggtggcaccaatccaaaactatgctcatagtcaaagtctgtgtaataatgtgatccccatttgtgtactagttgagctaagcatggctaagcatttcctaaaccaacatctaataattttgatacccaagttatcaatggcatatggtaaacaatatgtggctgagtaataggacccatcccacatgacattgtaaaagaatgcaagctttagtagaaatgcgggatatttgtaaattgggtacaatatgatcaattgtaatgcatgacttgccttgctctcgcactgatgagaccacaacaacgtcttcgagaaaccgcggatcgacgaaacggcccaaatctacgcgacaaacaaagcacacaagcaaaacatgctataagactactgaaacaggaaacaaaaacatttttaatggattctttgcatttttatgaatttactgagacttgaatggacttaaacggagctcggatgaattacttatgaattttagaagataaactgtgtttttactaataaagaaaagtccttaatcaatttattgcgcaataatacccagggctgacgtcagcgaaggggggggcagcgccggcaagtgggccccgcttgtcagcggctcaagagaggggagggggcgccggcatgtggaccccacggcagtggctcaagggggaagaggaggtggcgcccggttggctcggctcggcttcaaagccgaccggcgaccagggcgaccggcggcggcgcgcgagcgccggcaacggcaagcgacggcgcgggagacggtggcggacggcgcacaggccggcggcggcggccgaaggcgatggcgagcgcagggagcggcagcgcgtgcgggacagaggaaaggatggaggagaggagctcctcaccgtgagcacggcggccggcgcgaaggatgaagacggcggcgatgaccggcgatgcggaggcacggacgggcggcggcgacaccctaggagaagatggggaggcgttaggagaggagatgatgaccacggcggcttgaattgccggccggagatggaggggagggaaaaactcaccggctcgcgaggggagaggcgctccggtgggattctggcaacgagaggcggtggccaggaaagctcttgcggcggcgaagctaacggcggtggtgggttggcgcggcggcgactctagcagcggcggcgcacggccgaaggcggcggctagcggcgcgagcgcgaaaggaggcacgggagagcgcggcgaatgagggaaatgggagaggaggtttgggggatcgtttttatgggcaagagaggggcggaaacggccggcgatgtggggagtggagggagagagagagaggtggattcgaatgcgaatcccgcccatttttaggcgggcgcgagagcgggaagaggttgtggaggggcgacgacgtgggcgcagggtgcgggaaaggcgcagaaggcggggaaggcgtgaggaccggcggtttcggtggtggttggcgccggggcgtgggcggctagaggtaggggccgactgacaggtgggccccacctgtcggcacccgaaagagaaagggagggagggaggacttcggggaggggaaaggaggagcgggccggcccagaaaggggcgccgagcgcggggagagagatgggccgatggccaatctagagaaaaaggaaggaaaagaaaagaaaaagagaaaaaggattttcctgggatttaaaattgcactttggtgatttttaattggttaaaaatcctgttaatcgattgcgacatgtggaacccaagaaaaatcccacaatgccatttccaattattaattgcatttattaatttgggattcaactctaggttaattagaacaatttctccggacgatttacttaacaaatttttaaagcaaggaaaagggagaaacttcagggcgtgaaatctttcctcgccgcctaactcctctgcggccaccacgtgcatgcgacgctgtcgccgaccaatgggacatctctttgtaggtttgtcctgaaaaccttccgttttgcccatgagacgggtagttatctagaaatcggctccgctagccggtttagttatcaaaacccatctaggtttagctccttgctagatcgaggtggttggcgactctaggatcaccgcaaggcttaaggtgctgcgatcgtgcttgtcaacttgtcaaaaaagttgcgaacacgattttttgcgactccactggggaagagatccgttcatcatcaactcgacttcgactttgccatgacgaagccgccatccaagacggaggtggagccatccaatgtgataccggtcacattggatgacttcgaaggaaaagatcgtcaagctatggaggagtacatcaacgagctcacacgtgaggcgttgatgagagcaagtactaggactcgtcaaggcgtgatcatcaagcccgggccacgtcccaagctcactcctgacgtggtaagcaatgatgaggtatcacaatctatccaacaacaaattgcatctacaatagattcatctatggttgcttttaaagatcggttagatgtaatgtttaagggtaaatttgatgagtttttaaggatgaagttcgattctcttatggacgattacacattaaaggataaagcctctaccactgctaaccaacctcctatagatcaaacgggtagtaaaaccgacggaacggcgttcacggccggtcagaccgggtattaccccggtggtcagaccgggtctcaagctggtccgaccgcacatcttgacactggtcagaccgggccctgggccggtcagaccggcgcaattgttccaatacagggaatagatccgatgactaatgctagttatttatatcactttagaacatttaatcctcctgtatctattgctacaagtagtccccaagttcccccacatgttcctaatgcttataatgatgtttctagggggtatcctcccgatactagacaaggccaatataatcatattgcgccacaaacacaacctattaggccaccaaatccaccaccaaatcaacatgggcctaataatatggaggatataattagtgatattattaagaatagattcgggattgaaactaggaatcgtgctagaacttacaaaaagccatatcctgattattatgataatgtgccgtttcctcgcaattatagagttcccgaatttgccaagtttagtggtgaggatggtaagaccacatgggagcatgtaggtcaatttttggcgcaatgtggtgaggctaatagtgatacttttaaattgcgcttgttttctctatctttatccggtaatgctttcacatggtttacttctttaccggcaaattctattcatacttgggttcaattagaagaacaatttcatgattatttctatactggagaaactgagcttaggttatgtgatttgacatcggttaagcaaaagtataatgaatttgtcattgattatattaagagatttagagatgttagaaaccgatgttatactttgaatatagctgatagagatttggctggtcttgcttttaatggtttagttgctcctcttagagaaagactagatggccaacaatttcttgatgttagtcaactcatgcaaagggctctggctcaagaaagccgggttaaggataatagaaaacttgctagaccatttgacaaaaagcctaatgttaatgtggttgattaccctgaggctagtgatagtgaggaggagggtgatcatgatatttatgttgccgaatggtcatggactaataaaaataagccttttgtttgctctaacctaatgccgactccttgcaaagatcggcaaagtgaggttaaatatagttttgatgtggccaagtttgataagatttttgattatcttttgcaagagaaacaaattaaattacctaaaggccatgtcataccttctcaagaagagttaaaacatcgagcatattgtaagtggcatgattctcattctcattctactaatgattgtaatgtgtttcgacgacaggttcaatcggccatagatgaaggacgattgaagttcattgatggctccaagatgaagcttgatcatgatccttttccggtgaatgcaattaatttcaatgataagaaggtgttgattcggccagagcaagccaaatctactaagggaaagaaagtggtcattggtgaaccaaggtccaagatgatagtgccaaagaagccggaggttggtgtttgaaaggggaataggagtggagcttcaacttctaaagcccctaggaagaccaaggtgacttttgatatgcttttggagaaatatgagaagcaaggtggtgacaaaattcgcaacaaagggaaaagaccaagatcacctcctatggagcgatttggtcattcaccaagacggtcgcattcaccttcatatcattatccacaagacatgtcatggggttcctatccaatgccgctgccgggttatccttatccttacttcatgccatggggagcaacgccgccaatgttcaatcatatgcctccaatgcaattcaaccaagggtggggaggaccacggaggccaattcttgagcgtttgtcttcaccaaacggtagccgattttatggtaagaattgggctaatgaagaaaaaagggaagggaagcgcgtcaaggtggaggagaggacttcagaagtgaatactatcaaagtagggtcttatgatgtgccaatacctatcggagatggagttgaagtgtccccgaacaaaaaatctgaagccggtaccagctcctcgcaataagccggtctgaccaggccttatggccggtctgaccgcagtcatgtgaccggtctgaccgttccatcaggccggtctgaccgccggccctatagcagtctgaccgacgccttaggccggtctgaccgtgctccggatgtcggtctgaccggtgcatctggctggtctgactggtggtctacggccggtctaaccgggctccagcgccggtttgacaggaggattgcaaagggcaatgtggaagcttcatcgtcttcaaataaagttaatagagggcattatttacctcctggaacagagccgaatcctaagtggatgcctaaggatttgacggctactcaaaagagaaggttgcaacgtcttcgggcccaagagctaagagagaaaagggccaaagagcaaagggataaaatgtttaatgagttgcgaccaccaccggtatggatgcctaaatccatagagaaggcataacccattgatgtagaagagaaggaagaacaatcggttgataaaggtgaattgtctccaaaagaagacatggatatcaacatggtatgtatgttgcttatggagttttgtgctatggatgaagccgaggttgctcaattctcattaggtcctaaagacgcggtttttgagaagcccgatgagtcgaatcgttacatgaagcctctctatctcaaaggccatgttgatgggaaaccggtctctaggatgctagtggatggagatgccgccgtgaacttgatgccgtattcattattcaagatgttggggcgtgaggatgatgagttgaaaaagaccaacatgattctcaatggcttcaatggtgaaccaacggaggcgaagggtatcttttcggcggagctcaccgtgggaaacaagacgctaccaaccgctttcttcattgtcaatgtgcaaggtaactacaatgttattttgggtcgttgttggatccatgccaattgttgtgtgccttctaccttgcatcaatgtttaattcaatgggacggtgatgatgttgagattgttcaagcggatacatcggccgaggttgcaatggccgatgctacttttgagtggcgtcatgggaatatccaatgcttatcggggagggatctttctagttatgattttattagtatctccgatggcaaatttgtacttatctctgtaaagccagctagtgtagcatggctaagccatgtaaatttgtataatgagtaaagaggctaatttagagtggttacaaaagagggtgcaagaatatcggtctacaaagaacgatattggtgaaaccgttgaagattttgatgaagtaaaaaagcttgggaaagggtttacatcggccgatcctttggaagaagtagatataggtgatgaaactaaaccaaggccgacttttgtaaacaaaaatatgaaagccgattataaggttaagataatcgagctacttaaagagtatgttgattgctttgcatgggagtatcatgagatgccgggtcttagccgtgagcttgttgagcatcggcttccaattaaaccgggttttaggccttataagcaaccatctcgtcgttttaatcctttgctatatgaccgagtcaaagagaagattgatcggttgttgaaggcggggtttattaggccatgtcgttatgcggagtaggtatctagcatagtcccggtggagaagaaggggagtggtaagattagagtttgcatagattttagagatttaaataaaactactcccaaagatgaatatcctatgcctatagccgacatgatgattaatgatgcctcgggtcataaagtgattagttttctagatggtaatgccagctacaatcaaatttttatggcagaagaggatatgtacaagacggcttttaggtgcccgggatttattggtttatttgagtgggttgtcatgactatttggttgaagaatgccggtgcaacgtatcaaagggcaatgaatttgatctttcatgatttgttaggtattatcctagagatctgtattgatgatattgttgtccaatcggatggtatggaaggacacatagccgatttgaggttagcttttgagaggatgcgccggtatggtttgaagatgaacccacttaaatgtgcttttggtgtgtcggcggggaagttcttaggattcatggtgcatgagagaggagttgagattgatcctaagaagatagagaagagtcgtgatttcaaagcgccgacatgcaagaaggaggttcaaaagttgctaggtaaagtgaattatttgagaaggtttatttctaacctagcgggtaaaatcgatgcttttgttcctatacttcgcataaaaaaagaagccgattttatttggggggggcaaaacaacaggaggcgtttgaagagttgaagagatatttgtctactccacccgttgtgcgagcgcctaaagccggaaagccttttcggttatatattgcctccgaagacaaagtcattggtgccgttttgacacaagaggaggatggcaaggaatatatcattacatatttgagccgccgtcttttggatgccgaaacgaggtatgtttttatagagagactttgtctattcttatactatgcttgtaccaaattgaggcattatttgttatctagcacatgcgttcaaatacacattgcctgatgaggatttatatcgccgaaatatagatgatgtcttgttggagtgcttagataaagatcaatctaaagtggctatgggagagatacatgaaggaatttgtggaactcatcaatcggcccacaagatgaattggttgcttagaagagcggggttctattggtcgaagatgattgatgattgcttcaaatattatagaggatgcaaggcttgtcaacggttcggcaatgtttaattggcacctgccgccgtgttgaaccccataattaaaccatggccgttccgagggtgggctttggatttcattggtcaaatatatccttcgtcatcaaaggggtataggtttgtgctagttgctacggattacttcaccaagtgggccgaagcaatgcctttgaagaatatgactcatatggaggtaattgactttattttgaagcatattatccatagattcggtattccacaaacattaactacggatcaaggtgcttcttttatgtcgaaagaagtgaagaattttgccgaatcttatggtattaaattgttgagttcttctccttactacgctcaggctaatggacaagccgagtcgagtaataaaacattgttgaagttggtgaagaagaagattgaggaatacccaaagaggtggcatgaggtgctttttgaagcattgtgggcgcataggatatctaaacatggtgccactaaagtcaccccttttgagttggtttatggtcaagaagccgttttaccggtggaggtaaatcttggttctcttcgtaatgtcaagaaagatgatttgtcaagtgaagattacaagacgttgatgggagataatcttgatgaagtcatcgacaagcgcttgaaggcattggaagagatagagaaagagaagaagagggtggccaaggcgtacaacaagagggtgaaagcaaagttgtttcaagttggagacttggtttggaagacaattttccctttgggtactcgatccaaggagttcggtaagtggtctcctagttgggaaggtccttatcgagtgtgcggcattgttcgagggaacgcatactttttggagacacttcaaggggagcgttttcagcgagcgatcaacgggaaatacttgaagaaatacttcccgagcgtttggcaagacgcttaggaggtactatggccggtaattgagttattgtcctaagaccaaaaacatgttctatgcttttagattcacgttgttcataaaaaaggcagggggcatgtgtttacacccaaatttggcacttaggattaaaataggaaagattgccaaaatttggaagtctaccggtttcctccgagtgggccggtctgaccgccgggcggtcagaccggcagtgtgtggccggtctgactggcaggtccgagtccgactgtgttacgtcgggtttcgaggtttccttgctcgggaaggcatgtttcgggttttctttagtttctaccccgagttggacgtggaggaaggcctgtagagggcaggaccaacccctatataatggacatggccggttcattgtaaaaaaccaatctacaatccatcaatcgaatcgttctttttcatattgcttttagttttctcttagtttgtccatctttgttggtttgcgccgtaaaccgtccgccgccgctgcgagagtgtgacatctctttgtaggtttgtcctgaaaaccttccgttttgcccaggagacgcgtagttatctagaaatcggctccgctagccagtttagttatcaaaacccatctaggtttagctctttgctagatcgaggtggttggcgactctaggatcactgcaaggcttaaggtgctgcgatcgtgcttgtcaatttgtcaaaaaagttgccaacagtattgtcgccgttccgggagtttcaaccttcctctctaccagccaccaacctccccgagtgcgcgtcgaccgggaacacaatatgccaccgacgtcgccgcactttggccactggaagcccgacgccccgctcgcccttttctctccctctctctcggctcctaactgaagagaaggaggaggtgatgggaggaagaagaagaggaggagagagaaagaaaagaaaggctgacaggtgggccccactacagtactatttcacattttctagatttaattcaaattccaatttttagaagcccatatctcctaaaccgtagatccgattccaatgaaacttggacctaaatttatataaattcaaatcctaccttttggcactaaatttgctattgtaatatttatttgaattttcttaatttattcaaatgccgtttgaatttatgtttgccttttcaaatatttctttttaacccaaaataccctttagccactaaaaagccgccggttggaactttacgcctttcatgggaacgttcgtgcggtctaccgaccccgacgtcggaccgtcggttgtaaagcccggcaaaaccaaacctaaggtcgaagtgctgctcctggcaccccacgcctcgatgcgtatagtggtcggagcttcactattccatcgacctccatagcacaccgcacagttagctctcgggctctgtgtgatcctagccgttccgtggccactcacggttatcggagtaacacttccaccccgctaaagcttcacaatcttcttatccctctagccattgtattgtctatcaatatcggctagacacctaacctagtcgtcatactatccaattctaatgacgactagcaaacacccaaatcccagtcgatattcatcctacctcgatatcggcttaatcaaatgaaaccccagccagcctgctatccaaaatccataccagccatttactctccaactacctagaacctacacataaaatatagagcctggccgatatattgccctactcctcaatcagcctaaatataaccaaaccctaggtataatcctaccttaaatcctagtcattcttctacctgtggtatttcgaggatcggataatcaggttgcctatctcggatttatttgtgttggagcaaggcaagttattattcctcccctttgatcataataatcctatattctatatctccagtatcttgtgcattagccatacataatttttaatgcataacctgaatatatagcaaaccagatatatgctagattttgcttagccatgcctagttagacggcataaaatataatgaacttagattggaacagtacggaagaaatggttgatttccgggtggctagtactgttccaaccgacataagactgccaagtacatgtgaagaacatacgagtacgaccgcaattctcgtatgggcatagacctagctgactacgttatctagcaaaggtggtacttctgtatagtggttcttcttaagtcctcgcgtaggaggcaaatttatgccgcgaagggcaattatgatatttaccgaggcgcaggtaaatatacttatattgatagtccaggggactatattatggccatgtgattttattaaccctgattgcgatgacatggtgtcatacaatcagttctctctaaatacctcgagaatgccagaactcctcttgctgctgataatgttatgttcagagcgcatgggaactagagttcatggaacaggtaccactgatgttagtaaccgaaaagctttgccatgataatggcacgtcatggattgcgggtaaagcatacatctactgcagtatgaatattctcaaaactattcgaatagccgtgctcgcggttatcgggcattgggactcacaatggcatcttggttagaaacttaattccaaacattattaaatattgtttgtcgcgtcccaaaacgactctaaaatatatcctttaaattatgcctagaataattaaaatctgtgtgcaagccttcaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaactctaaaaagtctttttcccccctccccctcttgggccggctcggcccatctctctccctctctctcctcttccccgcggcccattcggcctcctccccgcgcgcgcgccgctgacgggcgggcccgcccacctccctcgctgacgggtggggcccacccgtcatccccttcctcccgccgctcccgccgccccgcccgcgccctagcgccgccgccgccgcgaatcccgccgcctcccgccgtccccgcgcgcaataaagagggggaaatcactccccgtgattccctctccctttccccccatttttccctctctctctcgttcaaacgggcggatttgccccccacaaatctcgccggcgccattgatggagcccgagagcgccgcgccggtttccttctcctccggccgccctctctcactaccaaccctatataaaccctccccgcacctcctccgtccgtttccgccactcgccgcccttcctcctcgccggaatcgagctcgcgccgtcgctctctctctccgccgtcaccgccgagctccggtccgccgccgtcgtcgccccggaccacctcccacctcggcgccgcctccttcggcttcgccgcattctcgccgacctcgtccacccctccgtttcggtcgccatccgccggaacgccgtcgaccccatcgacccgagccgcgccgccgccttccttcgctccggtcgccgtttccgtcgtcgccgtcgacccggggtgagccgtggaccgccgcttcgtttccccctttccctcccctctctcggccgccgctccgccgtgcctatggccgccgccggcgaccataggggcgcgggcgcgccacctcccgccgctgcgccggcgtggtcgccttcgggtgcaccgagcggctgccgcgtggggcctggctgtcagccgcccgcgcccttaggtgcggctaacgcgtgggacacacggcgccggccggtgcgcgcccgggtgcgcccggttcaccgtggaccgtgaggctgacgcgtgggccccacccccgtggacccggtccgcgcgcccctcccctcggttgacgcaataaatccatttttgaattaaaatttaaatgaagaaattcgcaaatattcatttaaagagcatataaaattcaaatggccataacttgcccatttgaactcggaattggaccgttcaagtctctaatttttccttaagaagtcaagaacccatttttgtgctttgtttctgctgattatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgtgattgttattattaccttgttcaccctagaataaacaaaaccccaactagtggacactctactcattgtaccactagtatgattttaggtagatgcttcgctgtttaattaggtaacattaggtggttttacaactctagactttgggaatattctcatcacctggacacattggaattgttggattattgtggaattggattcacacctctccctctattcaaaatccccaaaatggttttaggctgggctcggggtgcatggttttgatagtagcacctcggccatataaggaccggtcttcgggcctctgttgcaaatcactaccgtacttccacatgtctaatgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacactgtcacgtcctgataaattcatcccgaaataaaattcattttctaaaaggaataatagaattaattaaaattctaaaagaaattggcaaacactaaaatacgcacaagaaaaattcaaatgtggcccggagaatttttgttaaattctccttggtctaaaaggagccctcaaattttacttgaattttcagagcgccggaaatatttattaagcaacaaaaacaattatcaaagtttattaaaaagaaaaacctaaaaataatctctcttcctcctttgggccaagcccagcccgaagtctccctttcctccctctctttctctccctctccttctctccctccttctcttgggcccctcttcccctcccggcccactgcctccccctcctctctctcccgggccgtttcctcccccctcctctcctcctgggccgtgtcccggcccaagccgcacccccccctccaggccgatccgcgcccccgcccgtgctgcgcacgtgcgcgcgctgacgacgcgcgcccgaccgcgtggggcccacgcgtcaagccgccgtcgccttttttcttcagccgccggccggcttctctctctcccgtgaaccctaatccttcccttcctcaaatccgtgtgattcgctcttgggattccaaaattaaataggggaaatttattcccattgaatcctcttcaatcccccccaatttcccccttgaatggcgcccccaatcgccgggaacgcccgcgtcttcctcggccgccctccattgccgccggccgtggttcccgccgccgttcccgctcctcccgtggccggctctctcccccatcctataaaatgggatcctcatcccccgttctctcgttttagccccctcccgagcctccccgtggtccctatccacctccccgtcgccctcctctctctcccacgctgccggccgcctccagccgcctgtgccgcctcgaccgtgcgccggccggccgcgccgtcgcctcctccagcgtcgccgccacctcctccaccccggcttgccctccgtttcccgcggagacccccggagctgcctccccgccgtcgcccttctcgtttctccgcgccggccggctccagtcgcctctcccgcctcgcccgtgcgccgtccggtcgcgccgtcttctccctcggcctcgcagccacctcctctccctcggtcagccctccgtttcgcggggaaagcaccggagacgcgtcctcgccggtgtccagtggcgtcgccaccacctctccgtctccggccggctgctgttcgtcgccggtacgccgaccgacgtcgccgtctcctccgttgacgtcgcagcgtcgccctccaccccggctgctcctcggtttcgccggaacgccgtcgccgcgccggcctctccatcctctttgtcgccggcgtcctttcggcctctccttcctcctcgtcggctcgtcgccccgctgcaccaccaccttcaccaacatcgtagcggcgtgttccacgtcatcctcgtccccgtgcagccgctgccggctgtcctcgtcgcctcctcgccggtcccggtcgtcgtcgtcgtcgtcgtcctctcgccgttcccggtcgtcgtggcgttcgtccctccgtcgagccgttctcgtccgtcgtccgcgttcgtcaagcgagccgctgcaaccccgtcctcgtcttcgtcctcggctccgcgtcgtcaagccccgtgccggccgcgtctcgccttcgtccaaagatcgccgccgaagccgtcccctcgccgttcatctccgttgtgcccgtctgtctccgccgcgcccgttcgtcgttgtcgctcccacgcctcgtcgcgtggtggtaaggttccctctccctcgctgccccgtcctcgtcctttcggtgtcgccccgaacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgcctagtggagtccgtttgtcggccactcgcctcggttgacacacgggatccgcttccatcgacccgtggaccgtctctgtgtactcggtctaccgcggtcctttttgttgacatgtggggtccgcatgtcaacggcgcagccttcctgtcttttccaggctagcgcttacacatgttttataattgcaaagcttaattataataatccgcaaatctccatataacagcattaaacttcggatgatcatatcttggtcattcgagctccgaatcgacccgttcaagtctcttaatgtttgatataacctaaagaaccctgtgctctctttttatgtattgttattgcttctttataggcttgtagctttgcttgtgtgcttcgcgtagctttcgtcgttccggaggttcccgaagcgtggtttgcggtcgttgccgaaggttcggaaggccgttctctctgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattcttgttattgttattattattaccttgttcaccctagattaaacaaaacctcaactagtggacactctactcatgacaccactagtttaattctaggtagatgcttcgcaatttaataggacaaccttaggaggttttataattttagactttgggaatattcatatcacctggacactatggaatggttggcttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtccggttataaacaaaagtacacggatggaggtggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgtttcaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctagggtcgtctttataaaatagctttgggcaactaagtgacttttaaatgctgtttactgcaaaacttaacccctatattattatccccttgtactcctttgcattaattgtgcatccccggtgtggcttgctgagtactgtggttgtactcattcttgctcaatcttttcccccttcagtaagagaagctttggagaagaagtcttaggtggagtcttggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacacagggccggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttcagtcttaaaacctgcttaacaactaaaacatggaacggttggcctgggttggcttgggacgagctgggacccagggtcgggttgccagttcggtctgaatcatcgtaggccttgggttaaggcaggttcgtgtgggttcacggccttgataaataataatgtatagttctagaatcgtgtttacaaaatagctttgagcaactaaatgtctttaaatgctgtttactgcaaaccctaatcctttatattatgattcccttgtactcccttgcatttattctgcacttgtgggtgtgtcttgttgagtacggtggttgtactcagtcttgctcaatttttcccaaacccagaagaggagcccctggaagttgaaggctttggtgtctagctcgtgcctgccgtcaagcgcctgtggtcgtcgccctagtcttccgctgtttcccgtttgtctttgtgtgtgctgggccttcgtcgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacactgttggtacatagcccccttgagcctaggacgagtcggagatcccaaaccttatctatattttcaaaatgtaaaatcctgaacttatgtgggaaggaattctctagatcttcttctggtccgggtgtttcattcatttgggataatctgaacctaaaagaaggtggcttctgctcttttcttataagtaggggaatgggccgctacattaaaccgcccgtggtctggaacctt

SEQ ID NO: 6365 - DNA, 696 bp, Oryza sativa
  unsure (1)..(696): unsure at all n locations
cgcggcaatcgtanttacanatggacctaacagtatggtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttggattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattggaatcccattcaccagcttctacattaaataacaagagaa

SEQ ID NO: 6366 - DNA, 718 bp, Oryza sativa
  unsure (1)..(718): unsure at all n locations
aaaaaaaagtgactgcntctcttgtatacccatattgaatatacacttgagtttggaatttgttattctacttcatcttctatatgcttaagtggatattctgatgctgattttggaggttgtagaattgataggaaaagtactagtggaacatgttattttcttggtacatcattgattgcatggtcttctaggaaacaatctagtgttgctcagtcaactgctaaatctgaatatgttgctgctgctagttgttgttcacagattctttggcttttatctactttgaaagattatggtcttacttttgagaaagtacctcttttttgtgataatactagtgctatcaatattgctaagaatcctgttcaacactcacgcacaaagcacattgatatttgtttttactttttgagggatcatgttgagaagggagatgttgaattgcagtttttggacacaaagttgcaaattgctgatattttcactaaacctttggattctaatcgctttgcttttctttgtggtgaattgggtataattcatccttttggcatggtttgagggggagtttgtacctcatggntttatcgagcaataatatgacaatgagaaaaattgagaaaagagagncttgttatacatatgagattttcttgacatgctagcaatctttgaaagttatttgtctaagctagcttgatgtatctaatctttg

SEQ ID NO: 6367 - DNA, 1242 bp, Oryza sativa
  unsure (1)..(1242): unsure at all n locations
gacggtgtgtacccgccgtctgacacgtgatccaccggtctgccgtcggtgtgcaccggtagactgccnaaaccggtgaaacacaaatcgaagatctctcacagtagatgacacttatttgtttctctctgtgttacaagtacaccacaagcactccttataaaatttcgactaaactcgaaaccntaactcaaactcaactcaaattgctctcaaaagcgataccggaaagcctcaggctccccctctatttatacatgaggtaggtagcctagagccacgaactaaactcatactaagagtcttaaacaccttaggaaaccttctagtacaagaaagaaactttacataaccaatcgtaccaaatttggactccttccaaatttgactccgcatcccatatgcacacaataactccatcgtatgccatatggaatctccattaaccacgtgcatcaactctagcctaagtatcccgcatgatctctaaccaccacggacgtcgcctcatccttaagccgactcccgatccatcaccgcaaatactctcccgagacatcgagtcacctacacatggaacaaacaaagaaactatattccgagaccaagctatctccaacttgactcattagtagcaaacaacagtattacatagtatagtatccatctagaagtcataatcatgaaataatcacggatatccaaacaaacaacccgaaccgaaacagacacagtgtcggccggtcataccgcgggctagccggtctgaccgcgcgcataccgccggtccgaccggctaccagagcccggtctgaccggtcacatgaaataatgaatcctgcgatcacctgtgaatctaatcatctccaaaaccacttcgtgaatacattccaaataacaaaaccaataatctccaatgcccaattgttcatcaaagaataataatcaaaaacacctttgattttacaatctcccccttaatgaacacattggcaaacccataaaaaatgtcccccccccaaattaaaaatgttggtgttggaaaataaaacaaaagtgtaaaaagcacacttcgtacaaatgtacacatcgtgctcaaaaatccaaaaaaaaaccttcttcccccgttttaaaagaaagaatttccanttgaccaaaaacatgttttctaaccatctctcaaaattcgccttgctgttcaaaaatccaaaatttcacattacttctcccctttttacatga

SEQ ID NO: 6368 - DNA, 689 bp, Oryza sativa
  unsure (1)..(689): unsure at all n locations
aagattgatttgctnatcgcatttacacnagtccatcatatccaagaggttaatcctcgattcctccaataatttgtcatagtgtaaataaaggctcacacatgaacaagtgtatgtttgtgtaagtgtagccagggtctggtttagttctcaactttttctttaaactttcaactttttcatcacatcaaaattttcctacacacaaacttctaacttttccatcacatcattctaatttcaattaaactctcaattttggcatgaactaaacacaccccaggttatattttgcgagtgtacgtgccggcctgcaagccattttttggcccaacccgtaggccctctttgtttaggcttataagccaacttataagtcgaaaagtctaagcctaaacaaacaagcagcttttccatttgggcttttttttgaaagcccccattaaaaagggcccccccaaaccccttttttacactttagccaaagctaggtggagaagctttttgtttatgtgaggtagatgtatgactcaactactaaactaggacattaaatccacccggcttataaatcatataagcccataagctgacttaaagtctaggccatagcctaagcctaaacaagagggcccgtatctgcccacaaaacttgcatatatgactgttcgtggcccaagccattccat

SEQ ID NO: 6369 - DNA, 944 bp, Oryza sativa
ctttgaatatgaaaatgtgtttggtatggtatggacattttaacagtattgactcttacaatccattaaaatatttagtattcaaagtgtttgtgtgttaattcctatcaataatgacttatacagttttcagtgtataaatgtttgacttattttgttaaatctattaggaagtattttattatttttgatgctattgtaaatagtatggttttttaaatttattttttggatagttctttgttagtgtgtagaaaaataattgatttttgcatgttgattttgtatcagatactttagggaatttatttgttagttttaacagtctttttagagtcgttaggattttttgtatataagatatatgtcatgtgaaaacagatcaagtttcataacttcctttgtaattagaagcgcactttctccatgatctccaccttcctcccctcttccacctccttcccatcgccgctcgccccaaaccctagcgccaacccaccgtcatcaccaccaccaccaccgccctcgaagagcgcgacgagggcgtcgagccggtcgggcgagacgccgaaggggcggtcgggcgggagcgacgccccgaaggcggcggaggcgacgaggcagcgctcggagcagaacttgcgggcctcctcgaggtcgtacacgcggtgctcccggagcgagatgcggaaccgcggcgccgccttgccgcgggcgtcctccgaggggagcgggttggggcacgccgggtacccgcaggcgtcggcgatggagcgctccgtgacgacgtcggcgtagtccggccccgagagcagcgaggccgccgcgcggagcagcggctccctcgacgccgcggcgccgtcgtagagcgccatctggacgcggtgcaccgccgacgcgacggtcgtgatgaactactgtaccgtcggtcatcaatggccgcg

SEQ ID NO: 6370 - DNA, 29104 bp, Oryza sativa
  unsure (1)..(29104): unsure at all n locations
nagctcttctcatttcaggtgacatattttcgacggatgcataagcgagtacgtattttatactcctccatnnccaanatatagggcacanccaattttctagatgtnnccctgtanaacaaaatgtgtttttgattattattctgtgatgacatatgagcattgaagattagtggttttgnagatgattgaattcacaggtgatcgcagaattcattatttcatgtgaccggtcagaccgggctctggtacccggtcgaaccgccggtatgcgcgtgtcaaggtggtctgaccgcccgacactgtgtctgtttcggttcgggttgtttgtttggatatccatgattatttcatgattatgacttctagatggatactatactatgtaatactgttgtttgctactaatgagtcaagttggagatagcttggtctcggaatatagtttctttgtttgttccatgtgtaggtgactcgatgtctcgggagagtatttgcggtgatggatcgggagtcggcttagggatgaggcgacgtccgtggtggttagagatcatgcgggatacttaggctagagttgatgcacgtggttaatggagattccatatggcatacgatggagttattgtgtgcatatgggatgcggagtcaaatttggaaggagtccaaatttggtacgattggttatgtaaagtttctttcttgtactagagggtttcctaaggtgtttaggactcttagtatgagtttggttcgtggctttaggctgcctacctcatgtataaatagagggggagcgtgaggcttcccggtatcgcttttgagagcaattgagttgagttttgagttagggtttcgagtttagtcgaaatttttataaggagtgctgttggtgtactttgtaaacacagagagaaacaataaagttgtcatctactgtaagagttcttcgatttgtgtttcaccgggtttcggcagtctaaccggtggcacaccgacggtcagaccggtggcatcacggtggtcagaccggcggggtacacgacggtcagaccggtgtcggtgacaggcgtcaggagcagatctcggaggtcagaccggagattcaacaccggtcagaccggctaatctactccggtcagaccgatctcatcgaaattaagggtaacttttatttccgctaaaagttttcggtttttgggtatatcaaccattcacccccccctctggttggcttagttctttcgattcgatcctacagttccataatataaagcatacatacaagcatgcaattaactatgacatcttttctattaaattattactttttttaaatcctccaccctcatgttatctaatcctattggatgcacgcattagtatttattaggatgatccaaactacaagataataataattatttcttggtctttggattaagggtggttgtgccttatattttggaatggatggagtataaaccttttatatataacttttctaaaaaataaataaatctattttcaagcatgtaatagttaatgtttaattaatcatgtttatctcggttgcgcgctattaaaaagttcacacaacttctcattcgaacgcagcctgacgcccagcttcagttagatcatgtcaggttaattagtatactttgattaattgattaattgttggttggttaggctgcaggcatatcaggattccatgggtttatcgagatgattaaaagagtcaatatattttagtcaattactgacagatcgaagacgacgtacggtttactcaaatatacaggtgtattatgtatgtgtgtattggcctgacgtatattattcgttgtacaaaaaacaatgtgtatatactccgtattcgtgaggagtgacaaacaacacggcacgcaaggctcttaattatacaaagttcattaattatgaatagaatccttgcgttccaactccttgctataggttatgattaaggacatgtttattacggcaattttttttaaaaaaaataatatgatactactatatgttacataggaagttcttgtcataactcaaactttatagttgtgtgcattctaaatgcaaagatggggatgtaatcatctcccttatctagaaaaaaaattagatgtgacaactgaccaattaaaacttaaactagaatgtgtctgcaacagggaggtatgtctaacttcaaatcttgattatggttgtcataagtattatggtagatttgtaaattggatgagaatgcagctggaaacagaatgctatataattcattgatatctttgcaaattgaattaaaattagggtcaagttagacaactttttcttgtaaagatgccatgaaagtgtatagtgatctatagtgctaagtgtatagtgatctatagtgctacatcttctttctcagacagtcatgatcggccagcatcatcataggtaggacggctacctttacaagatagatacataaaatacatttttacaaatataataaaattgcaggaaagggggagactcataatgatatgagctagctcaaaagatgtccttggattctagagtagcatgcataccaatcactgaaccctccctttacagttttttttttttcaaaatgtaaattgtgcctgtgaaatttgattactggttccctctttactcctgatttataatcacagctcttgttgatttatatgagcataaactcatgtttcacaaagatgtatatcgaagatacttgtcagtttaaaattcgattaaactattttttaaaacataacagtgtagcacaaacgtgctcggtagatttataagtaaaaatactttactaataccctacatttggaggtgcatgcttttgtgctgattaaaagcaacaatcaaaattagattaatcatagtcaatatgctaactgggggagtacatatcatggttgttttctttgatcaacgaaccatccccttaatttcatagtctctgtgatcccgaccaaatttcgacttaagaaatggaggtagcagcagcagtagtagatggccacctagagctaattaagctccaatagtgatctaattaggcggatggttatcatatattaattaggcaggaggtgtatttgtttttgttgcctgctggcagtgaggcagagtgggttccatgctccgaccatgacagtctgtcccagacccccaatcatttgctttcattttgttttgttttgctttcttcaaggtcatcaatattctcaacagttttagagatttttgtatgctcaactttgtggatcatgcatacacgcaatttttgttaccaaaccaccagatatgtatgatttgattctgtgatggagtatttgtgtagatttggcttttggagtgcatccaatcaaatacaatgtggtttggcactagttcatggatttgggacatgtggttaaccttgcatattttttaattaagatatctatttgcaacttaaatatgacaaatgatcatattattgcacacaatgatataacaaacttggcttttattgggaaataaaatagcaatgaaaaagtgcaaaggagagagttgccaatttttaatatgatggacattacgttacgaacaaccatacctattttcacattagtatgataacatgctgcattattctgctacgccaacatgaaagatcatccttaaataagagaaaaataacatggaagatttgtcttgactatatgcttttatttacttaatgaaatatctatatcttgaaaactatctgccaagttcttttttaaggtttagctcctatcaaaggtttcatctcgccgatagcctatcttaggaaccagttttaatgacactgcaatattcagggcacattctatttcataccggttgaactctatgtcaacatgtaacaactatattcatatatcatacagacgtgaaagaattacacgttattatattagagaaaataaagttttagttatataacacaacggtcagaaaggccattgtcgaaggacatgggaaataaactgctaagttaaaaactacgaaaaagaagttgctcccagagtttcatatatcatacagtgatacaataacactatttcaacatcaagaactcacagtatgacataatccagggtatattcatatttcacaattctacttactgtcaccacacaaataaattttacagccaaccacagcaaatttatttacaagaccaaaaatttccccaccacaaaattcagtaatacactactactagtacaaaggtaaaaatgaccatgaaatgaaaaaaaaaacaaaaatcagagagatgggccccacacgagatgagattggcgccacgggaccggaacctttcaacggtcaaacagacaagttaattacttaaaacaattaataatcaattaattaattaattaattaattaatactaagagtaaacataaaaatttcccttttttttattttttctgtgtcgcaatctcttcttcctcctgtgtattatagaaggcagcgaagctcctccttcctctctccctccgaatcctcccccgcattccgcgccggagctgaggagggacagcgagccagcgagggaggtggggcaatccagcgagcgccagatcgtgccgccagccccgctccgtcctctctccggcgaccctccgccccgcctgatcccgtggtaaatccctctcgcctctgtttcttggatcccgtggttcttctctctgcttgttcttgcccgattcgacggttgacgcggccgtggttgctcttggatcgtggcttggttggatttttctttttcaaggggtggaagggaaagctggttctttttttttccttctttttcttttttttttttggtgtgtgtgttcgtttgttcttgtgattttcttgggggtggggaagatggtggcggtttccgaggtcggatcggatacttgttcgtcctgctgattttgcattttgatcggtgattctggtggctttcttctatttggatgatgcgtgtgattggagggagatgagttgatgggggaaagatggtttagtttggttgatgcaaaatttggtggtctctggatcggtgaaatgttcccttctcttggctgttatggatagcaagcatgggtggatgaactggttgattcttgaaagctaccgcctcgggataatctcccaatgatcgtggttgaaaatatcatgataaacggggggtaattggtacagattagcattctaatatcttcagattctgtgtttcgattgagctagaaaagtaacactccagttttgataacaactcggcatccatcatggattcccaaagtttcatttcttctttttttttcttttcctgtaccttcaagcctacctgccaattgccaacacaaactgtctgtgaatgtgcttctggcacctaatctcatcacatctttcttaagtaaaaacactgttgtgactttgacttaccattattatgctgttgtttgcaggtggatcaactacaactcatctttaggaaagcctcttgaacattagccttgtgtgcctttcaacagtatggcctcggtaggtgtggtgcgttcttccttggggtttcagaacgaaacaagtacaagtggcgatgccgaccgacttccgaatgagatgagcaatatgagtataagggatgataataaggtattatgcctaagagtggtggatcatagttgccttttgctgtattgtcagttgctgatttgattcacaaacgtcgcaggacattgacgacatagttgtcaatggcaatgggacagaacctggtcatgttattgtgacaagcattgatggaagaaatggacaggctaaacaggtactgttcacaaaacaagcacaagtgatattatgctgatccttttgtgtccatttagtgttgcctgggaacacaataagtttttgttcactgaattatctatctacattgcagaccattagctacatggccgagcgtgtcgtaggtcatggatcctttggaactgttttccaggtttgtctttagacagatcgatttatgttgcacttgttcagtgtgttaatttgtgtgttctggtggcgattgatgaacccttcatttcttgaatgatcttgtataggccaagtgcctggaaaccggtgagactgtggctataaagaaggttcttcaagacaagagatataagaaccgtgagctgcaaacaatgcgagttcttgaccacccaaatgtggtgtcactaaagcattgttttttctcaaagactgagaaggaggagctttacctcaatttggtgcttgagtatgtgccagagactgctcaccgtgtaattaaacattacaacaagatgaaccaacgcatgccattgatatatgcaaaactatacatgtatcaggtaacgttacacacctagatcttctaatctatcctagcacaattatgcattgagtataacatggaaaacctattataattgacagatatgcagagctttggcgtacattcacaacaccattggcgtgtgtcacagggatatcaagccacaaaatcttctggtatgttacatacttgcatttagttataatctgttttccacttattgaagctttgtggagttagtcaagtactaagttttgtttagtcagatggttgctaaaagattattacttccaggtgaacccacatactcatcagctgaaattatgtgacttcggcagcgcgaaagtcttggtatgatcactcattaccagatactcacacgaacattgccattgtctgttgtacctaatcttttgttctattattataggtaaaaggagaaccaaatatttcttacatctgttcaaggtactacagagctccagagctcatatttggtgctactgaatacacaacagcgattgatgtttggtctgccggttgtgtgcttgctgaactcctcctggggcaggtaagagatcacattatttacatgaggcttttggaccatccagctcattgcaactgtctgcctaagctttatcctttttttgttttaaaagcctctattccctggcgacagtggcgttgatcagcttgttgaaatcatcaaggtaaattatatcttgcttccatcgaaatcactccctttttgttgtttacctcctacttaactgactattctctcaggttctgggtacccctacacgagaggagattaagtgcatgaacccaaattacaccgagtttaaatttccgcaaatcaaagctcacccatggcacaaggtagaagaaaataatcttatgttggactgtttattttttattttagggttgaaacctaatgtagctttcctttttttttaccaccagatcttccataaaagaatgcctgctgaagcagtcgatctcgtctccaggcttttgcagtattcaccatacctccggtccactgctgtgagtgttgtcgttgcactatttgagccaacaccattttttagagaaagttttagttcttggcatcactattgtgttacatttttctaattacttcatcatacaaacatgcactgccttgccaagtactagtagttacagattgtgcatttctttatttgccattacagtcggaagcattgatccatcccttcttcgatgaactccgtgatccaaacacccgcttaccgaacggccgtttccttcctcctctcttcaacttcaagccccatggtaagcttgcaacaccggctgacatatgacatgcgtagacgaaaatttctgaaccaccgatcaacttataattatctactaatctggccgatttgaacagaactgaagggtatgccaatggaattcctggtgaagcttatccccgaacatgctcgaaagcaatgcgcgtttgtaggatggtgatttctgaggtcagcatgaaaactagttcagaatttcttcaccgtcctccattagaaagcagagatgaaccctgtgtgcagccatttgggaaagctggtgcatatggaagtggaactacatttttttgtccgagattctgacgccgcgtattcttttcccccctcccactttgctgctgccggtgtaaccaaaaaatcatccacggttctgtaaagttgatgaagaagagtgtaaaatcaggttgaaaactgaattcgatcggtttgtcaagattgtagcaacatgcaaggaaggatgttgcacactttgtatggcaatgttcgttcggtccaaatatttggacatggatcgagaggctattcatttaattgtacttgctgctacatgttcttacatatcagtaatcttctgagaagcttgtgaaagaaagcaagtaggtgatgtgttgctgtctatgcaccagtatcagcaaaggtatgatgaatctttgctactatgaacaaacttttgccaggacaacacaagtacagcatgcaaactgatcaatctgtgatattgtgcaaggatggagaagcaatttcaattgtaactgagcatttagaagctgaaaaacgaatgtaattttgctgtaaggttacccagcaaactgatcgcttagtcccaatctactgagcgattacaaccaggcaaacataaaacaactctagaagcagcatagaaagcaattataatcaaagaatggagcataatgctacgaataccaggaacatgaaagggtaattaatgcaatgtaacgaatgctaacagccatcgcaatgtttctgcggagatcaacataacatttaaagttgtctgagagcaactgctccatgacacatcacctacagatccacatgatgctatgctaatgctacaccatcctacaaggccagacaagtcaatttgatggagagcgatgtcgatgtcgagcagattcatgcgccctcacctggagccgacccattatatgcttcactctttgaacaacacgaacatactcaaaaaactggttggaatccatgcccatggatgagtttactgttgtaccacctttacaggaactgaagtttccaccaataattatgtcaaaaccaccaaattctttcaccaggtcctcaagtacattaatcttcagcttccaaatggtatttatctgcctcagttgccccttttgttcagtattactccaccaccttctcaaaattttcctgttcgtatcagattggtcaacagatactacacactgtagtggtatccctaggcgatggagggcaattgctgcacctccaattccactgtagattgatagcacccttagcccatctggatacaggtccttcaggactgacaaaagatagccgagtgtgtcagtctggaaactgtacctcatggcttctattctatcttgtggattcaggccaaacaggtttgtgtgtttccgtgggtagccaagtatccgttccacttgttgtggatccaaaggacttaacctatctgggccaacccagatgaggttagccagcttgcactggtgcatgatgtgcgttttcttttcttgtgaaagataacctcctgagtctcttaccatctttcccagtctctcacacagctgctctattcctgcaacttctgtagcaacactgttaagttgttttcttgtgtcccacgatggccagcactgccttgtgaatgggaatgcttcttcgatagtcattggtgacctaggaaccaggttacgccttccctctgttggaaggttatgaatgtaaccctcctttcgtgagagagccgagaaaaactggctatttacaaactctggctccacattatataagaactctgacagctgacgccatgtagctttgggaatttctacaacatttccatataagaaatatgggggattggcgacatcactgcgaacatttctacggatgcctggtgtcattgcatcaaattcttccttgacagacccatcactagttgtggcacggtgatccttaagccatggatctaagttaggttgatttccagcacgactactggaacccgcactgtcatctataaacatatgcttagcccttttaatccttatgttgtcatggtcgtcatcatagtaccttagaccagaatttgagggatggtatgctgaatagctggtttctgtctcatctagaaagtcaggctcaactttcacctgtgcacaagaatgcaaatgcagacaaattagaaatcataacagttgtgacttgtgtataacaatatgctgtacagccatatgagcagcatttaaagaaaaacattggtttgctgagaacggtataagtgtttggttagagggatattttgtaattcaagcaaattgtttatataaaaaggttcctactaatctgctgtgcgctctgcacagttgtcatggacaatgctaccaagcaacagatgactgtaaattcacaatacaagcttatagctgtaagaataaaatgttgacgaaattacctctttctgctcaatgctactggcaattctacgtgcaaaaatggtgtcagccagctccaaaactgttgcttctggacctgaaaaggtaggaacaaggaaatatggcattaagtttgctagaggtaggaactcattaaaacagtatattctagtacatacaacatagaaactggtaactaatgagagaatggaatattgatatagaaaataatcaaatgtattacaaggaagattgaaatttttaataccaaaaatttgggggctaaaactataactacaatgtgaaatatgaattcccttttaccacttgcatgcaacgttttatccatgtacatgagtgaggcacctgcggatgccatgtgcgtgcaatcagatgctctggatgagacatgagattgaatttacagtccttttagcttaaaatggcatatatgtatccatggggagccaccttatgtacaaagcaggcatgaatcatacatagaaagtctgaaaggttcgtccttgacaaaatctatgagcaaggttaggattcggtcaaataagtcaaattaagtatactgttaacatgaataaaaacacccttttgtacaaatatttgtcagaactgatcgtttcaatcgctcatatattttgctactcatgcttttgcaaagcatatatntcataactttttccttgttaatttcctttttgcatgctccccaatcatctatttgatgcgacaaagatttatcgatctagtccaattgaataaaaccaaaagattgcttggaaaagctttgcaatggtaaaggttcaagaatgacaagtgtttgttgacaggtacagtattatcagagatcaggtgccaatgtactggtgcatgctgtggtattagattttaaggatttcactttgtgaaactccctctagtcacatttatttgatgctgggagtactaaacttagtacacccagcgtcaaataaatttgaccggagagagtacttcaccatatgctgtggactgtggtcatgaagctcacagatctgagtaattttttaaagcatttttattttcacttaccagctttgtcaatgacagatgacacttcttcctccgtaaaacccatctggagtaaatgtagtgttttatccattactccaaacagtgattcatcctttacctgaaacaaatgtgattttaaatatacagttctgttgttgctcatttgtagccaattacaaatatcatttatcaaaattagtgttaaagaaagaacacaaaaatatcataaacatgattgataaccatgatacagatcccatctatcaaaaatagaatgtcaaagaaagaacacatataactataagcatgactgaagaaaaacatgatgcatgctccaggctaagtatagttcatgtcattgtagtatcaaaaggaattaaacatctatactgcagactgtagtaagaagtttctagggtacacaataggagacctacaaagcatggctgacaagacaatgtgagtaccaacaagcacaaaataatgtgatcctgtggtttacatgttgttacattatcgactaccaagtaaaaacacagaattaaaaggagaattctcaattgtcgttgatgcgaaatataagtagaaaatttggctgcgatttcatagctgggatagtatgaagcagaatgtccaagtgacaatctggtatgaacaaggatattctgtaactggacgcaacacataataaactagagagatttggagcaccaatttttgtgattggataagtacggaatagactctggaacaacttttccagagttggataatgtacaatgttctactagtctcatagcagtaacaccagttcactgaataatgagtctttcacaaagctacatattattaaaagttattaagtgtgttttacatttaatgtcaaaaagaaaagtgtgttttacatttcataaaggagtaaagattcttggagcagcgagctcaatatttacttcatgtactcagacaatgttagtcagatgtaagaaacagaaaacaaaagaactggcgaaaacctcatttgaagcatctccattttcgtttcctccagagcaacctgacacttgaccagtaacaatgaaatctacaagctgttccaatgatgcttcctcacctgaaaccaagcaggtctggaagtttacagtatgctggatatgacaaagaatagaatgactatcaaacagatctaaaatgtgtcctgaacacattcttgttcaacagtgtcttaaaaattgtgtagtacaattggttgaactgatatcaacaccaaaaaaaaaaagaaaaggcaacagtacaagatctagacaattaaaaagataaattgctaattgcacaagtcaatgcagcatcacctacctagctggttgagtgccaaatcaacttctcgctgcgagaagttcattgtactcagtagatatgatctcttttctgaggatgaatcagcttcaacctaaaaatagaaatgttgtgcagattggtctaaggagttcaaaatgaatagtaccatgattaacattttgaaccagaacatcaccttaatgtcttggataacttctttcctaggcgcaaaatgagaactattttcttcattatcagaatcaaagagatctcccaatgaacctgattcagacccagatttttgaagagcctataacatatgaaaattgaaaaataaattcaagtattgtgaattccacaactcattacaacacaattattgactactgtagcaatgccaacaaaattagatggaaactaaaattcctgataccaaattgaatatcagtcatttaagtaaacatcaatccaactacatgaaggtgtacttaagataaaattacactagcaacattaaagtaaatggaggatcataatgggagctttaatggtaaactattcgagtcataaaacaataacacagaaaaatataaataggtaacatcaaggttaggagaggaaaccatttcctaaagaaagaaaaccagaatattgagattaacgggacaaatgttgacatgcagctggggaatcacttacagactgtgacaaaagagcctccagtatagtatctgaatctctgtcacctgcatgagagagataaatgtaatcagttcgtaaactctaaggtgtataaaatgtttggatttaactgtgttttaactggtgcaaaagttttatatcactacatgcatttgaaaaggcatgtcataggatattaccgtgtttctgaagcaccctgtcaaccaacattggtgaaaaccccatgccaataaattgtgatcttacatgactggaggaagagcttggctgtccttcctacaatatatgtgaagaacattttgttggtatcacaactttattaaaaggaacccccgcaaaaataaataaaataaaatattaaaaggaaccaaaggaaaagttaacatgtcaaaaggagtattaactatttaaagttgtggacctctggttgttagcaatatacctatggttaggtcaacacccagttactttcaaatacttaacaccatcaatcaactgcatcttagatgtactactgtcaatatagattacatccaaaacaaacgtcaagtctattaaaattggttgtatttgtaagtcatcctgatttggtgtttggcagatgtgttcgcctcaaatcaaagcacaataccaaaaaaagaggctcagttagaaagtagctcacagggtaggggagagggggggtgcaatctagaattatattgaatttgggtctagtgcccaaagacacagatgattctattgttgtttcaagaaataacttcttggtacaatgcaaacaactcaggtgcatatagcgattagcaactggaagcctgtgcacaaaattatagctttgctttccacttcaagcacgacataacagacagcacattgccgccataataaaaccacactctacaagtggtaaatgagaagcgctcaacccgcctggccctaaaataataactgcccaaatttcccgcgtaattgccattactcattaatcgtatttgacatggagactttgttttaacctcaactataataatatggaccccacaccacagtcaacagcatagatactttttttttctgtgaataacatgataacttctaggcatggaaagcaaaatacggtgactccttttcacccttgttttaataatgtaatatacataatcgattcatccaaatagtttagcatgccatgcaaaacactactccaagcaaagattaatacaccagaaggtttggaagcaaaatcaccacctcctccttaacagtagcacgcagcagggcaggctgtggattgacagcagcatccctgagatcaccaacagaagcgttgatgccactgccctccacatcatcttctactttaacctttgtgtaccaataaaagccagcatatagtgagagacggaacaaaatcaaaaaacacaaaataatagagagagctaaataatagagggagcacagatgccctccattaccatctcgatcaagtatcaactccgcttccaaaatcgcatgcccctgcaagaaacaaagacgatagcgcgatgagtatcttatagcagcataaacttggatttccatcccccacaggtttggatcaactcaagggtgcgattaaacccatagaaatggagacaaaaaaaacacaacccaagaagggtgccccatattgcgtaatggtaaaaatcctatctatctcaacatataatggaagaagatcccaacaaaaagtttggattcccataccacacatagtctgaatccaccacctctcacagggcgactaaacccatagaaatggagacaacaatacaaccggagagcggcgcaaactaaacgcccgcaatcctaatcatccaaaacgatttagagaggataaggaggcgttaaactaaaccctaatcggttgttcctcgcatgagctaaccatttccagcacccaaaaaaaaaaggcaaaaatggccacaccacatagtttggaagaagatcccaacagaagtttggattcccataccacatagtttgaaactttgaatcatctcacatggcaactaaacccatagaaatggagacaccactacaactggagaggagcgcaaacaaaacggctacaatcctaatcatctaaatcgatttcaagaggataatgaggccttaaactaaaccctaatcggttgttcctcgcatgagctaaccatttccagcacccaaaaaaaaaaagcaaaaatcgccataccacaaagtttggaagaagatcccaacagaagtttggattcccataccacatagcttgaaactttgaatcatctctcacatggcgactaaacccatagaaatggagacaacactacaaccggagaggagcgcaaacaaaacggccacaatcctaataatctaaatcgatttcgagaggataaggattcgttaaactaaaccctaatcggttgttcctcgcatgagctaaccatttccatcccaaaaaatttataaaaaaaacaaaaaacaaaaatcgcgagaaaacccatgggcggtaggggatcgagcaatccgagtagagaaatcgcgagcggaacaagcaaggaagagagggcaagatgaaatggttgttcctcgcatttcgagaggatagcgaggcgttaaactaaaccctaatcggttgttcctcgcatgagctaaccatttccatccccaaaaaattaaaaaaaaaaatcgcgagaaaacccatgggcggtaggggatcgagcaatccgagtagagaaatcgcgggctggacaacgaggaggagagggggaagacgaacgaacctgtaggaggaagggggagggggagcagcaatggaggaggaggaggaggaagacgcgtctccccgctcggctcaggttggcggcggaaggggggcggcgcggtgtatatatatagaggcgaacatggccagtgacaggtggggcccaccccgcctcggcgtcgacggcggctggcctgaaatggtaacaatggagaaacccccactcccgctcgccgctcgcggcagcggcttcccttcttccttcccacactgctgctctgctgctgcgttggcgcgggggacggaggtcggacggactcggcgacggcggcggccgcgcgctccgatcccctcccgctcgacggcggcggcggggaggcgcgcggcgcgcctccgggtttggttcgaagtggagatggggaccgggcgattccaaaagggggaagatgcgcacattgactgtacaggacaagactgacttatacagattttatcacggtttttgttagcgtgttttttaagctacgagaacacttcgatttggagaggaaaaacatataaactagaagataccccgcgcgttgattagggatatgagtataaaaagtaataccgaactatgtaattttgaaaagggtgataatatgaacaaacacattctgaaaatatgggaaatctcttatatgtttttgtaatcgaggagtactgatattatagaattgtagtagagataatgctatagctgcaagatggagaacagaatgggaccctaataaaatatagcaggtcttatgcatatgacataatgaagtcttcatatggaaggaaaatataataagtcttccgcatagtgaaatcaccgtaggtcagacagcatgtgttcacctgtattttgtgttggagaatatattagtagtacaacagggatgtgcttgtaagataatagagtaaatcgttaggaatgtgaagaataagtaccaattttattatgtagattggtcaggcagattggtatgcaatgcagtttgtagctctatgttgtttggagtggttcataagatattgcagttagtgttaaaggcaaaagtattgcaaatcatgagtggatttatctatcacaaaaatcaatataaaaataatgaaatgtgtggtgttataaaataatgtataccctttggttccctcaatggagtcttcaggaaaatcagcctttccctctgtatgctgtagttttttgttgcatgaaatagttccaaaaatattgtagtcagtattatagttgagttatgttattctatgtattttccaaagtagtacatgcccttctttgtaatgtttgagaacagggagatctagttttttggtagtgtaaaaggaaaaatgttccaaggttggttgtgagttgatatttgttaatcagaaaaggcaatataaatggggttataaaatataccttctggtttcctcaatggagtctttagtgaaatcaatggctctttttgtagttgagctgcagtaatggataataatcatatgaatgattttattaagcataattttttttgtatatttacctggttttttcagttggagttttatcagccaaagatatttcaggaggtgtacttttgcttgatgctcctgtattatgaatagttgtgctgaaatttatttggcatcagcagttagtactatatatccaatgtgatgtagaggctgggttttaatgaaaatcctttatctaaaaaaaattatggtgttgtacaaatgtaatgaatagaacatttgatagaataacaaaccttgggttatctgtatgtggtgcaggtggtggaagctgtagtacctctttgttcttcaaaggcttgattagttttatattttaatttaattagtttgaaatatttgaagtaatatggaataggatatctgaagtaatatggaacagtagtatttactaacctctccatctgtgagcatagggaccgacatagtaggctcaattgtgaaactcttcttaagcacatagctgatagggaacttagaagatgtatcagtattcatccctatagcaaaaatttttgttttaccaatggcattattgagtgttgttggatgatcagccgggtctatcttcatgttttgggaagcttgggctgcatcaagctctaccaaatcttcagcaacaaaagaaaatgctactgcatctaaactccctgattcatctgtaatcgtgacagggagtttgtacctgaagcattgtacattagttagatacatctagagtggttagcattacagtaaactattttagttcttcgaatgaatgtataagagtaggagattgtacattggtttgcggaatgaaacttcgcaagcacatcttggtgaatcagaattgttgatgtaccctttatcacaacgatggcatcctatgtaataccatttaattgatgacagtatggcagttattttcgcagtagcactgtatgtagctccacccttatgtaataaaaagtattaaatcttggcgaaaggaatccatggcatggtaataacaatatagtttttttttcttttgtattgagttgtacctgaaaggctgaaataggcatagctgatatctcacttaaggtgtacatttttcctgctgcttggatcggggttaaacgtataaccttagggagttgttgctcaagagttggacgttcccatttgtagcttcaaattgcaaagagataggttggcatcttttgacgtgaaatataatacatattgaacaggaatattcaagtgcaaatggtttgaaggggttaaagagaattacctagtgcgaaactctctaacttgaggtgtgtccaggtcaatatatatttcagtagcagagcttgaagatgcttttgttatagctgcaggtgaaagtgaagtttaaatgttttgcattctttgtatgggagggcatttgtttgggtcaaagaatgaacctgaaaattttcctgcagtaaggccagcaaagatggctactacaattccatcctttgatttatggagtgttgcatcttcgttgaatgattctccatattgtccccagagtaggacatcttgagtctgttccctacaaaaaatgttgcatataaacaattgctgagattacacaaaagtaattaatgagagcattgattttaacgatcaggtttggaaaaggtacgtactctaggttttgaattttaattctcctgagttttttgtctgatgttgggctcgcaaaatcatatggaccaatatgactgattactccaatcaaatctggaggaatattcattcaaaaaaaatctagaggaataagccaaaagaatgtgaagtgtaataagtatgattcaatgtggaattaaagatagcattacctatgagaggtttggaactgatacttttccctagaacttcatcaaatgggcagaagtcaaaaaggaactttggtatggttaatcctctagattccaggggttgaattcttgtgtcatgtttaaactagagaatatagttctggcactggtagatataggtctttctttttgcatcaatggcaacagtattactaattaggtagacagatcctttatttagcaaggggcggaattgctttgcaaacctttttggcacagtgatctgtgctattgagccctgaaaaattattgtgcaacaattgatatggctagtattaagtatagcaaagaagtagaatctagtattaatatttggtggaacacataagagaatgacatacaagttcatccaataggatgacgtcaatgctgatgaggggatctgcagattttgatctcatgtttatagcatcccataatcttattagacgtccaaaaaccttgcagttttgctgtccaacagatatatcttttaatgatatagctgggttagccattgaggtaaatctgaaaaaaacataataaagaaaaaatgaaacataagtgaatatacgttgtcggtgacatggggccgggggtatcgtgactagaggcttgggtagccgcggtcacccacgtggcctgaccccctcgggggggtcgggcccgagggtgacgtggccacccctccctctgtctccccgaggggtcgggccgctcccgtttcggccccgagggctggggcgccccgaccccctgtggttttggtgccacgtgtgtgggttaggtgagcacagcggggctcacctaaccgcatttatagcaggttggacgagcgcgccacgccgtatttaatgcggcgcagcgcgcgcttatccggtccgtgaccggtcgcggtgtgtgaccggtcacagaccggtcagatcgcgggttaggtggcaacaggcggcctgtcacacgccttgccccgtcccgtcggaatgatgagagcttcctggctctcgtccctagccggagccggtgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggaggcgtgggctctgcttgtcagaggtcacttccggctgtagactagccctcattgtaaaaagcatgtttcccttcttaggcagctagaggcccttgtggtgacccctgaccagataaaaaggaggcccaggcctaggagggagagaaaaaaaaaggaggaaaaaaaagggggaaaaaaagggaagaaaagaaaaaagggaggaagggggggttctagagtctgaactctctctcgctctccggctctcggtattccttcacacacagatccaccagaacacaggagtagggtgttacgcttctcagcggcccgaacctgtctacgtcgcccgtgtcttgtgcacttcttctctcgctgacgttcctcagatggagggcgaggaacctcacttagcgcccccggccgaaccggcaaaggggggcctgcgcggtctcccggtgaggagccccacgctccgtcatctggcgcgccaggtaggggtgcgcgtgtctttctaagccctcgtcctctttcgtgtgcgccaagcttctcccgctcagcccaatggccgaacgggcagtggcgcacagcctctctccgaacgctagcggtgacgacggggagcagaacccgcgccgtcgggctcgcaccccaccgtccccctctcgccgaaatcttgggcggggggaggcgctcggggaggtcggaggatccgcgacttcgccgcccgcgggcgacgggggaggacggcgagatggggcgcgtcgccgcctcgtctacggcgatggcggcacgccccagggcgcgctccaggctgcaggcgcgctcctgcgtcacccgcccgtcgtccccgatccagagactccagcccgacgttggctggatgacttggccgacttggtcatgacggcgcagcagcgcctaggcgccggcgggcggtcctccgccatcgaggcctctagcgctgccgccgccggctccatgtcgtcgaggcggagggcgcggcgagcggcggccgttacccgtcgttcgtccgccattccctcgtcaacgcctccgacccaagaagatgtgcgtggggggccggatgcccgcctcgatatcgagcgccggcgcgacgctcgtcgcgccgcccacgcaacggagggcacttcctcgtccggagcgccacttcggtccgggcacgggggccggccccccgtgtccccggttggcggtgccggctgtcgagcctttgtggcgagccttcggaacgtccgttggcccccaaggttccggcccaccatcaccgaaaaatacgacggaagcgtcaaccccaccgagtttctccagatctacacgaccgggatcgaggccgccgggggtgacgacagggtcatggcgaatttcttccccatggccctgaagggtcaggcgcggggttggctaatgaacttgccacccgcgtcggtccactcttgggaggatttgtgccagcagttcactacgaacttccagggcatatatccgtgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagcttgcggaccgtgtggctcgcaaggaggaggcctgggcctggaactcctccggttctggtgtggcaactccggccgcccccgggtccgccgctcggtcagggcggcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacaccttcctccacgacctcgcggactgccgcgcggtcaaaagtttggctgagcggacgaggaagtgggaggaggagaagaggcaggagcgccgtgagggcaagaccccggcggctcccgccggcaaccgacgaggtgaggccaagcagaaggccaccgccgaggacatcgacgatggcgacgatgacctggggttccaggagcctgaggccaccatcgccaccatcgatgggggagcgtgcgctcacgcttctcgccggagcctcaaggccatgaagcgagagcttctggccgcggcccctacccatgaggcgacacggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctaggtcatatcgacctcccggtcaccttcggtggttccgccaacttccgcacggagcgggtggacttcgatgtggcggacctcagtctgccctacaacgcggtcctggggaggcccgcgttggtgtcacgtcctgataaattcatcccgaaataaaaatcattccctaaaaggaataatagaattaattaaaattcgaaaagaaattggcaagcactaaaatgcgtacaagaaaaattcgaatgtggcccggagaatttttgttaaattctccttggtctaaaaggagccctcaaattttacttgaattttcagagcaccggaaataattattaagcaacaaaaacaattatcaaagtttaataaaaagaaaatctaaaaataatccccctcctccctttgggccaagtctggcccaaaacctccctctctctctctctcagcccgcggcaaaagtcctctcttcctccctctattcctctccctctcgtcctctccctccttctcttgggcctcctctccttcccctcggcccactccctcctcctccctctttcccccaggccgcctccccctcctctcctcctgggccggccgcccggcccaagccgcgcccaagccaggccgagccgagccagccgtgcacacgcgcgccgcgcgtgcgctgaccgcgcgcccgaccgcgtggggcccacgcgccggtcgtctccctagctcgctccctcctccaaatccgcctcattcaaaccggggattccaaaattaagtggggggttttaatccccattaattcctcttcaattccccccaatttcccccttgaatggcgcccccaatcgtcgggaacggacgcgtctttcccggccgccttccatggccgccggccgtgtttcccgtcgccgttccgccctctcccatgcccggcttgcttccctccgctataaaatggaaccccctctttgcgttctctcgttttagccccttcccgagctcccccgtggccacaccacctctccccgccttctccttctctctctccggtgccggccggcctccagccgcctctccctcctcgcccgagcgccgtccggctgtgccgtcgcctcctccagcgtcgcagccgcctcctctccaccggcctgccctccgtttcgcgcggtgaccgccggaggcgcgttcccgccgtcgtccagtggcgttgccgccactgtaccacctccagccgcccctgccacgctgctcaggtgcgggctggccgcgccgtctcctccttcgtcgttgccgcgtcgacctccactccggcctgctctctgattcgtccggagaccgccgtcgccgcgccggcctctccatcctcttcgtcgccggcgtcctttcggccgccccttcctcctccccggctcgtcggcttgctgcaccaccaccacccccggcattgcagcgacaaggtcgccctcgccctcgccctcgcctcccctccacccgaatgccgccggtgtccgtcgtcgtcttcaccgttcattctcgccggctcgtcgtctcgcggcgccgcctccatcgtcggcatcgcagcggcgtggtccgcgccgtcctcgtctccgtgcagccgctgccggctgccctcgtcgcctcctcgccggtcccggtcgtcgtcgtcgtcgtcctctcgttgttcccggtcgttgtggtgttcgtccctccgtcaagccgttcttgtccgtcgtccgcgtccgtcaagtgtgccgctgcagccctgtcgtcgtcttcgtcctcgcctccgcgtcgccaagcgttgcgccggccgcgtctcgccttcgtccaaggatcgccgccgaagtcgtcccctcgccgttcgtctccgtagttcccggccgcctccgccgcgcccgttcgtcgttgtcgttcccacgcctcgtcgcgtggtggtaaggatccctctccctcgctgccccgtcctcgtcctttcggtgtcgcccgtgctcgttgtgcggttgtcggccccggtacccgtgtaccggtgtcggtagtcattcgcttatgcgtgtggtgactgtgttagtgtgcccgctcggtagccgcgtggtttccacgtgtgcagcccgtgtggtgtctagtggagtccgtttgtcggccactcgcctcggttgacacacgggatctgctttcgtcgacccgtggaccgtctctgtgtactcggtctaccgcggtcctttaggttgacatgtggggtccgcatgtcaacggcgcagccttcctgtcttttccaggctagcgcttacacatgttttataattgcaaagcttaattataataatccgcaaatctccatataacagcattaaacttcggatgatcatatcttggtcatacgagcttcgaatcggcccgttcaagtctcttaatgtttgttataacctaaagaactgtgtgctttctttttatgtgttgttattgcttctttataggcttgtagctttgcttgtgtgcttcgcgtagctttcgtcgttccagaggttcccgaagcgtggttcgtggtcgtcgccgaagggtcggaaggccgttctctctgagcaaggcaattcacatcatccttgagcatattgaatcccagtttataaaattattttaatttaaattaatgcattaccgctttatttaaattcccgcgttatcactgttttatttagccatgcctatttacctttgttaagacattattattgctattgttattattaccttgttcaccctaggataaacaaaaccccaactagtgggtactctattcatggttccactagtatgaatttaggtagatgcttcgctgattaattaggcaacattatgtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtacctcgggtactataaggattaagctcgggcctctgttgcaaagcactaccgtacttccacatgtctagtgggtaaggcttagtttgtggctcggtctggttataaacaaaagtacacggatggagatggacgaagtcgggggtcgatggacatctctaggacaaatgaaggctacacgagctacggcccggtagtcgagatgtcatggcacagggccggtgtcctgctgctgggggctcagtcctgcctacctgtctcgggggttccggccgtaggtggggttgggtcggtactcttgtttatggctaggatgggttgggaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgtttaattcttaaaatttgcttaacaactaaaatgtgaaatggttggcctgggttggcttgggacgagctgagacccagggtcgggttgccagttcgatctgaatcatcgtaggccttggattaaggcaggttcgtgagggttcacggccttgattaataacactgtgtaactctaggatcgtctttataaaatggctttgggcaactaagtgacttttaaatgctgttttctgcaaaacttaacccctataatattaccccttgtacccccttgcattaatcatgcatctgccggtgtggcttgctgagtactgtggttgtactcattcttgctcaatcttttccccccttcagtaagagaagctttggagaagaagtcttaggtggagtcctggcttataccccagttgagcgcctgtgaagatggagccgcaggcccgctagtccgctgctgtttatttttgattgttaggccttaagtgcctttgtaataatgtaaatattatcgatataataaagatgtgccttttgtaccatgtttgtgtggtgtaccccggcttttcctgggacggggattaatacactagcgttcgggaaaatgtatttttctcggtcgcgacagttggtgaagttcatggcggcggtccactacgcctatctccagatgaagatgccgggccccggtggccccatcaccgtccatggcgacctatggagcagcgcgcggaccacctcgccgcggcgtccaagcccgcgggtggcgacgagaggctcagcacctccgtcccggccgccccaaggcagcgtatggtcacgtgcgacgaggtcccggtcaagaaggttgccctgggcgacggcccgtccaagaccacacgaatcggtggtcttctggacgacaaatagaaagacgcgctcgtctccttcctgcgggcaaacgccgacgtcttcgcctggagaccggcggacatgcccggggtccccagggaggtgattgagcatcgtctcgccgtgcggccgggcgcaaggccggtccggcagaaagtgcggcggcaggccccggaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacacatagatcagattgtcgactccaccgcggggtgcgaccttttgtgttttctagatgcatactctggttatcatcagattcgcatggctagggaggatgaggaaaaaatgcattcattacccccataggaacttattgttatacgacaatgcctttcgggttaaagaatgcaggtcctatttttcaacgtactactcgaatttctttgggtagccagataggacgcaatgttgaggcctatgttgatgacttggttgtgaagacgcgcaaccaagagaccttactctcggatctagcgaaaactttcgaaagtctccgctctgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgaactactgtacctctggttggtcgagccaatcaactcat

SEQ ID NO: 6371 - DNA, 733 bp, Oryza sativa
  unsure (1)..(733): unsure at all n locations
cgctggnnattaggactacaacagatgcacccancaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgat

SEQ ID NO: 6372 - DNA, 25519 bp, Oryza sativa
  unsure (1)..(25519): unsure at all n locations
cccgggtggagtgctcgtctgcatgcacaannntatcagnacctggcgaaataaaaggctgtggtgacttcattaatcttaagatatattggccctatcttctggaggtgctcatagaggtagagttgtgcgtgtgtattcataaaggtgatgagcgtgtgtgtatgtttatagagttaagtgtgcacgcattatgaacgaatatgtttgtaccatgtttctaaaaaaaattgtttgcaaacaattgtcagaaatttttacaactaattctatatatagcatttgaggaatcagcacaggttccttaatccaatcttcagtttttttctttctcattaacctaaatgataaaacaaaaagtcatgtttttgacggatgaagatcaacttctggatttgggagtgttgaatccaacttaattaggaacatagttaattaaggcatcttatatattgtagtactatcaataatactaatttagaagagggacagacgtgtggactgctggctagcagtactgtgccttatatttgaagtttgacatgaaataccaaacacgatggaagcacatggcaaatgggacaatcatagtagcttgtatccatgtttcagcggttgggtttgcaattattttgtcccaatattccatgcatatcaaattatcaatgcatgcatgcaacgaccaatgaaggaaatagcagcacttaataataatattaaggatcaatttatacatattattgattcgtagtgaaattattatcaacatgatcatagatataaattcaataattaaacttaacatatagttttaaacaagaaagctaagctaacaattaatacattaaaaatttttagaaaacatatatttaaaaacgtggagcaaataatctgtggtgaagtattacttatttagatacatgagaggtgcggtagtacactcatactaccaaaaagtagtgtcattctccttccatctcctctcaccacgcacgtagcacgtccgtacgttttgtataagtaaccactgatccaatgttttatcctcagttactcttttagtcatccctaattatacggacctaaaataatcaccggatccaatattttatcctcattcaccctcttagtcttctttgattatatgaacctgttacaatattgggtatgtgacatgttactagtataccagaaaatgtgtaaatacaagttaatttaatgggtatatatataagtatccaagaggttaatcctcgattcctccaataatttgtcatagtgtaaataaaggctcacacatgaacaagtgtatgtttgtgtaagtgtagccagggtctggtttagttctcaactttttctttaaactttcaactttttcatcacatcaaaattttcctacacacaaacttctaacttttccatcacatcattctaatttcaattaaactctcaattttggcatgaactaaacacaccccaggttatattttgcgagtgtacgtgccggcctgcaagccattttttggcccaacccgtaggccctctttgtttaggcttataagccaacttataagtcgaaaagtctaagcctaaacaaacaagcagcttttccatttggcttttttgaagccataagccactctaacactattaagccaaaagctaggttggagaagcttttttggtttatgtgaggtagatgtatgactcaactactaaacttaggacattaaatccaccggcttataaatcatataagccaataagctgacttaaaagtctaggccaataagcctaagcctaaacaaagagggccgtaatctggcccacaaaactggcatatatgactgttcgtggcccaagccatttccatccaaccatgtgacgtttataattatagaatgctagaaatgaattgcattataagcccttattatacattagctacaaaattaatcaaagacttaagattaacgatgcagtagtaataattttaaaccaaggtgatattacagtaggtacgtacaagtagtcgtattaatgtacgtacactacgcgtatactagtataataccgtcgtatttttttccgctgactcgatcgttgactagttactactactactagtagtagttctggttggtgcatctgcaagtcttcctgatctcgaagtgggtgccctcggcggggagcttgctgagcttggccatggcggcggcgaagtccacgtcccacttggtggcgttgtccctgtactcggcgaggtcggcggcggcgtcgccgtcggtgcgcagcacccagtccgacttgaacagcacccggttctgcaggttgttgtggtagtagctgttgtccagcgcccccaccgccgccgtgtccacgccggcggcgtcgtacccggcggcgctctggaacgccgcgcccatgtcgcggatgttgttcttctccgccgggttgtccgtgcgctggacacccttctgccgttcgacgtcggcggcgagcgccgacgcgtacgtggcgtctatgggcgtggcggtggcggcggcaaggcggtcgtggaaggaggagaggtgggcgacgccgatggagtgggcgccggagaggatgacgagctccccctgggtgagccccttgctggcgaagttgtccttgagctgggcgaagtcgaaggtggactccgggaggacggcgtcggcggcggcggcggaggagacgacgccgtccttgcggcccgtgccgacgtcgtaggtgatcctgccgccgctgaggatggcggaggcgtcgcggccggcgagcaccacgatgtcggcgcaggagacggcggcgcccagcttggatttgatggcgtcgatgacgtcgaagccgtccaggccgatgttgttcgccgccgccttctccgtgctgctgctgtacggcgtcttgtccaagagcaccgatccatcacaaccctgcatttttcaagaaaaaattctttattagttatgcgctccatcttaacaatttaaaaatgtattcaaatcaaatttatagttaaaaattgttatattttaagatcaagctagctatttgcccaaattaactcagtaagtgaatcacttttgaaacaccatatcaacatcatctcacaatttaaaaaggtatcacagccctgctttttttttgttattatatatccattcatgttatagtattgttcatgcatgtggttatttctccaaactcattacaagtcacttttcaagcaccacatcaacatcatccaacaatttaaaaggtatctaattatcattttcaggtgaaaaaaaaaaagaaaagttattactacttactatcaacttagaccccccccccccaaaaaaaaaaaaaaagctaatgcagacaagcatgacaagttctcttacatgatccccaattcaaaagaaaaaaaagccaaactaaaaatgccataaggcctatctagctccaccgaaatttgcattatattgcaagctaagctgcatacatattggacttcaggtttacttatgcatttagcagatccaaatctttttgagagtgtgttaattaaagacaatatatttaaagcacatatgtacgtgcaaatgtaatatgtgtaacatattacgtgtgggattgagatcctcttcaatcaaaatacacggtatatttgtcactgacatgtgggtccagggatcattggatccacatgccagtgacagagacacgtgacttcgactgcagaggatcctgatctatgtgtatgtgtctgtatgtcattcatgtactcggaaaaaaaaaagtaaatggtggttagtatacttacgttgacccagcagtcatggaacaccaaacggacaagggcggcacccacgccgggattgtgcttgatggccttctccacctccttcctcaccgtctcctcgatgctcttcttgccgtaccaatcgccgccggcgtcggccgccgccggatgcacggcgaccaccaccaacagagacagcacaacggcggcggcggccaccgccgcgttaagcttcaccatcaccatctccgatcctccaaatccttagctgaattagtaagtgtgtgtgtgcttagctagcttactagctactgcttaagtaggatggattgatggattagcagctgtgcatccagggggtatatatactgctgatcacctctcaccatcaccatgagcatcaaataattaattagctactagctgctatagttgaacactatgactatgccattgtatgggttgagttaggctagcttagctagcttgcatgcacacaccggataatatgcgtcactattttatatgagcaatatatatgcatgatgctttgcttgcttaatttgcatgcttgcagttggtagataaacgttgatgccgatcatgtgttgaccaaaaatgaaggaaggtcgacgaacgacaacgtgcatgcatggcaattatatgacgactatgaacgatgatgcgttttagtcttgggcgtctattcaatatttatattattatcttaaaaaaaatccaatctttgtattgtcagtttggcgccgctgtcgcctgataagcctagtttaattagttgcgctagtcaaatggaacgtttatatatataaatattacaagttgggacgaagttcaattcgttgccaacttccttctcttccaatccatttcgttaattcggatgatatatacgatgatcgattatcatcatctcttgctggtcagcttgacaactgtacgcgtttgtttgtcactgattaattaaatttgtagttttaattagagcaaaaattaaaggacccaacacgtttacttttgtggtttaaaattaagttaccatgcttattcggagaaaaagaaaaatatatacacaccctttgattatgatgatggatccaaaactctatatgaccgtgtaaatagaccaattaatatctacactattctaaaagaagagcaatgaatttttgccaaaaaaaatgtttatatttttactaactactctttcatatgattttaatattacaaaatagagcacataattttaatcttagagtaaatttcacaaaactacaggtactttgcacaatctatcacaaaactacagatttaagaaattgtctcataaaactatagatttagggaccccgttatcacaaaactacaggttttagctctccccgttaaatctaccgtgacctgacaggggtggcccacttgcagtctcaggaaccttcaagatggttgccacatcagaaatcccatgtcaaatgcgtgcgtggtggaacggttgtacgaagaagttgcaggatgtgtttctatccctctcgtggacccagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgtgcacagttttttttttaaaaaaaaaaaagcaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaaagaaaaaatggtatttttttgttgtgttgaaaaatttaaaaatatagattgtgattcattattatgaaataatttaaaggtaaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtaacaatttcaagaaggttgtgcaaaattatattagcagttggataataaacatgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaagggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactctgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtcgcctcctgaaccggtacctcctcaacgacagccgtatgaaccggtacctcctccacagatggtggagttggagccgatccggaggtaccgtcaaaccccgacatgtagttggggtcgaaatcacccaaggtgaacgacggtgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaaaaatgcacacttgagaacaaagagagcacttaaaacacttgagagcacaagatgaggagtgtgggatgaggagaaatggctggggttcatgccctatttatagggcgaaatttgagattttttggaattttttcggaatttttatgaattttttagcctcccaacggttattttcaaatttcaacggtcaaatagccgttagtgccacgtgtcgccgtcccattggaccgccgcccgcctgccgcgcctgacgggccgccgccgtgccgtgccgggccgtgccgcgggccgtgccgtgccggcccgctacagtagccgggccgtgccgtgccggcccgcgtgctcggccagcggcccaagcacggcacggctaaacggcccgtgccggcacggcccgttactgtagcaggccgtgccgggccgtgcctgctacaggtccggccgtgccgcgcgcggcccgtttggcccggcccatttggccacctctacgtggacccattcggtggccaattcctcactttccacgcgtgcatcgtcgtctcgcgtcttcgcctggtcaccgcatcgttcctctttggcctgaagaaaccctagccatagagatggcatcggcgaatagcgcgagcaagaagcgaagcataggtgcaccatcccagcaacagggtagcgtgagctgtgcattgggcaaggtatgcaatgtatatactagtggatttgagtgtgcgattggttttgattttgatttttcgaaattgggtttgatttggtgagttgggatcgaatgaaatctttggggtcgtaggaggtaagtctggatgcagtgcccttatatttggaagaaacagaatggcatggtgaggagaaaggaactcgattgcgctgcaagcatggattgtgtctagcacggagggtggcttggaaaggagaagacacaggcaggaggttcttgggctgtccattagaggtttgtttttttgttttctttgattttgttttttttttaattttcccccacaattttgacctgattttgttgggcttattcaggaagacgaggaccaatgcaagttcgttcaatgggtggatcctgaatgggactcgagggtgaagaagacactagctggcatgtgggatatggtggaccgtggagtgaaacgtgaagcaattattcaagctgacatgtttaaggcttttgccctgaaagaccgtttggagaaagagaagaatgatgagttagcccacaagaatgctctgcttgacatgagggaagcacaattgaaagaactgctctacaaatctgcctccgaagcaaacgagctatgttctccctcctcctaggttccccccttcatccccattattttgctcgttcccgcgtttcctctcttttgccgcccagggcgcaggaggactggcgtggttccttccaggagaaggaaaagtgcgtgcgtggactgacgattcaaccggaggaggagtgacatgggatttctgatgtggcaaccatcttgaaggttcctgagactgcaagtgggccacccctgtcaggtcacggtagatttaactgggagagctaagacctgtagttttgtgataacgaggtccctaaatctgtagttttatgagacaattttttaaatatgtagttttgtgatagattgtgcaaagtacctgtagttttgtgaaatttactcttaatcttattacatctctcaactacaaatttatcctgaaaagacgtctacacgtacacagatgaattgtactctatctataaaaaaaacatcacaatcgattctttccaaacatgcataattcatatttatttgtagcaaaacataggtattttgtttagtagctatattcaaataaaaacacatttatagaaataggagaaataattatatattgactctaattctgctttctaaatctaggtccgtggaattgtagaaaaattctatagttttttaggctttcccttgaaatggaggattttcaaaaggaatttcaccgaaactaaactaacttatgtaaaattcctgtaattttttctcacatagatcgtccttaaagtgagctgagcttacaacaataatatatgaattacaactttttccacatttgataacatacgactgattgtcaaaatattttcgctaggtaatggactaatagtggatatcgacgcagcaccctattgctacccgcgctaactaaattatactattaattaattagttcagtcattccatctttcacggagaaaaacctgctcttgatcgacaagaagtcatctcagaagtcagagttaatctgccagtctccaacttcttctgttcatcaggccaactgcaactaattgggtaggagtagcaaatatatgttaattaatttggataaaaaaaattggttggtagttccataggcactatagctgaattagcgccttaactcttcctcaacctgatagtaggaaaaaaagtccgagcatatatagatataaattcgaaagtggattccatgtagatagcatatccaatcaaagtggtagaatgatcggctggaatgctggatgcatgtgcaagggttagttgcaactagctgatgaactaatctgtactagattaaattcatcaacttgtctattgtgttcttaattatgtatcttggagttgttttattagaatctgcatatagttgtctgattgtctccaaaatgacatgctcaattaattactccctccgtattttaatttatgacgccgttgactttttaaccaacgtttgaccactcgtcttattcaaaatttttatacaaatataaaaatacttatgtcatgcttaaagaacatttgatgataaatcaagtcacaataaaataaattataattacataaattttttgaataagacgaaaggtcaaacgcttgtcaaaaagtcaacggcgtcatgcattaaaatatggagggagtatatattaacatatgatttaagtattccattagatcgagcacatgtacaataaccggctattagccttccacatcagctgttgcagtaagctagaggagagagttgagacgcgagagtgcaaagccgcaggcgactaaatagtctcaagaattaactccaactaagaaagagtgaaaattaagcaaaattttagaataagcagctgactgattattaggcttgctcagtaatatcagttaacctaatgtacattgaaccggaaattaatcacctagaaaacaagagaccgatggagggctcccggagaagaagaatggtttttacaattcaaataattaatgcatgtgcaacaatattctaaggcattaatcgatgttttattgagaatggtatatttgtactgataagaggatataatatatattagtattatgcttttcttgaagtatgtatatgatgatagtggatgtaggtaaacatgcacttgggttgtactaatgaaattgactaatttctcctctcatttttgataatattttatagttagtacctttcgttccatttcatcctccctgtaatatattcaagaaccggatctttcggcacgttctctcaacaatacagaaggaatcgttctattccatctttgtcttgccttcgtcgttatccccaatatgtcctaaccatagttaatactcctaccatttgttttcaaagttgctgttaagtggcctacgtgcaaattaaaatggacaagacaagtcatttcaattcgttggtacttgagcaatatactccctacgtttcaaaatatttgacaccgttaacttttcagtatgtgtttgacaatttgtcttattcaaaaaaatttaagtaattatttattctttttatatcatttgattcgttgttaaatatacttttatgtacacatatagttttatatatttcacaattttttttaataagacgaacagtctaacatgtactaaaaagtcaacggtgtcaagtattttaaaacggagggagtactatatagttagagccctggagctgaaatgtgctagctccataatatctatctcgatcgatcgtctgatcagttgtcgaacggaaaaggatcgatgggcgttcctgtagtgtcggcaaggtagatgcattattgaatcttagggccgttttaaattgaagctgaaatgtttttaccgatagtttcaatactagatagggtgattttagtccgaagccaaatcattggcattgccgatatccaatttgacactttctaaattcttatcaaaattttactagcttctaattatatgttggcctgctcagatttttaaggtgctcgtaggggtatggtgtgtgcgtgtgtttacaaggggtgagtgtacgtgcgttataagcatttaagtttgtaccgtgtttctaaaaaaatatattagcatcaaaccaaatacaactttacactactgtatctatatttcctaaacagttcaactgttgttggttgctctattaaaccacaataaaaattgaagtccacggtgagtagctgatagacaacgaaaaaactcaactaagcaacgaattgaaggttaaacttttatattcgtgttttaacgatttaaaaaccaatgcttaaaagataaattataatgagaaaaaacacaaaatcaactgtaaaatcaaataataaatttaaattttagttgtgaccgattagataataaccaggcaatgagagagaaaatatagccacgatggatttgttttaacagagaaaaaaaaagcttgtgtacatgtgcaatatatagtcgaaattgtgaataagttgagagaaaactaatgcgagatggattgtgcgtggatggggagattaattgctcgatcggtcgcgagccatctagtagttagatcgggaggcaagtcgcattgcaagtaagcgaagtctgaactctgaatttaacatggaaaattcttcagacatgctcatcagatttcgcggcaagcaagcaaagctatgtaggctatggcgacgagttggatggtggtcagatcatcaccaattcccatcttctctgaaactggagctggtccacttgccgggaagcacgcacataccccacgtgctgaaactaatcgggatatagtggtggtgttcctcctcttccaacccttcttctacttgccggcgctccttgttctgatatacttcctccgtttcataatataagtctttctagtattgcccacatttatagagatgttaatgaatctagacatatatgtgtatctatattcattaacatctatatgaatatgagcaatactagaaagtcttacattatgaaacggagggagtagcaccactgcaattcttctttccagcgattggtcactgcatctccggatttctactcctagccgccggcagggatacctccggatatgggaaagaaaaaggttgcgtctctccggatttctactcctatagtcgccggctgggatacctccggatatgggaaaggaaaggttgtgccagcctagtaaaaaaaccggaccggcccagcggttgaatcgtaaaaccagaaccatgcctctcaccggttcggtttagtagaacggacggctcatgcatttgacccggtaagaaccgagtgaaccggatggtttttagtgaaaaccggcgaaccgggctaataagaaccggcggttcattgtaagttgggctaacgcttgggctagccttgtaaggcccatcatcctacaccacggcccatttatattttatgcaaaatataagagaaagcatgtgtgggaagtgatttgaacccgtgacttgcggattgagacattgggcctgttcactttgatgccattttcaaccttaccaaattttggtaaagttgcaaaaaaagtggctacgggcctgttcactttgatgccatttttaaccttaccaaatttttggtaaagttatcaaaaaagtggctacatttagtttgctgccaaattttggtaactatataagaaatcctgccaaaattttggcaagttgtcaaaattttggtaactatgctaaaatttggtaaggtttttttttggcatcaaagtaaacaggccctacatttagtttgctattaaattttgataactatataagaaatcctgtcaaaattttgacaagtttaccaaaattttggcaactataccaaaatgctaaaatttggtaaggttttttttttttttcatcaaagtgaacagacccattatcaagtttaccatattgctagcaaactcattttttttaatagaaaatatatagtagccatatacctccgttcagcattgaaccggctgactcgacggtccgatcggtgaacagtaaaccaacgagatcactaggtcgatcaccgtggtcttcttcgatttctccggcgagttctgacttctatccagtggcggaccaggtcctgggccacttaaggctatggcctgagacctgggtacgagagcccacattttcaccattctcttggaccgaataggtagtgggctggtcaggggctggcccaaacctgggtccgctggttcgctggcctcgggaataagatcactttgactccctcaactgaccacctaatctaaatcgtatccctcaaccgcaataacagaaatctcgaccccccaaacttgcaaaaccggtgcaatttgactccctcggtggtttgggggggtggtttcgctgacgtggcgcctatgtggtgatattgaccgagtctacggtccacgtggcgttaacgtggcacttacgtggcagtagaattaaaaaatatttgtgggacccattagtcattaaaaaaaaagtgggcccactaacatgtggggcccacatgtcagtcctttcttcttcctcctccctctctcccttctctctcaatctctccccttcttcccatttggccggcggtcgagagggcagcaagagcgggggccggcccggctcggcctcggtggggaggcggtggcgcaccgccggggtctaccgacaatggaaacggcgcacgaacgaggggagcggcggcggccatcggagcttcttgggcctcgcctcggagtccccgtcgcatctcgccattcgcagctaccagctgctccctccctgtccccgccggccgtgagatcccgccatggaggtgagcgccgcctctcgtcccctttttttccttttcttttgattctttgttttgtttgtctctttcgatttgatggttctcggcggaggaggtggcgttgtagtgtttgccacccctggccttctccagccccgtcaccccgaccttctccaacggcctccacatgaccccccgcgccagtcgcttcgtcaccgacgacgacctcacgagccgtcggagaccacgccggtaaccgcgaggatgaggatgacgagcggcagcgcgggccgccaccgccgttccactcgtcctcccattgccgcgagtcgccgctgccgttcccctcgtcctcccactgccgccagtcgccgccgtcgttcccctcgtcctcccactatcgcgagccgtcgcggcggagccaccgccgccctagccgccgaccgccgcccctggtccggttctgatgtgccccgatgccgccagccgccctcctgcccgtcggccgaatgggaagaaggggatagaaagagagagaaggaagagagggaggaggaagaagaaagggctgacatgtgggccccacatgtcagtgggcccacagtttttttgtgtgaatgactaatgggtcccacgtatattttttaattctactgccacgtaagtgccacgtcaacgccacgtggaccgaagactaggtcaatatctacatgtaggcgccacatggtgccatgtcagcgaaaccgcccccaaaaccgccgagggagtcaaattgcaccggtttcgcaagttcggggggtcgagatttctggtattacggttgagggatacgatttagattcggtggtcagttgagggagtcaaagtgatcttattccctggcctcgtcgatgtgtgttggagtccagcttgattagcgaaatgggctgtgatcccgctggactgcacatatgggccatgtgtctcaagcatggcaatttgggcccacaattgggtctagatgattaatgggccggtctaaatttcatgaatggaagtcacatttgagcccaacacgtttctcatggtccaaatggccctaggcttgcactctagatgacagcaattatatttgggcccatcgaatcttcctgtggatgggcccaaatataattgctgccatctagagttactgtgataataattcaagaattaacattgtgccattgaaatcactagtatgtttaacatgaaggagtagcataattttgtgcttcttttcttttcatttcatgtttcctttttgctagaagcaaattgacatccattaaaaacagaggatctggactagcaatgacagtagggcttgctcatcacagttaaaactggaaatggaacataattgaagtggccagtgccatatatcgatctttctgtaatccctccttattacatgaaaatggagaaagttttggatggatgaatacaaatccaatccaaaccataccaaaaaaaaaaacaacaactaattaactttctttctttttgacaccaatagacagagaatgcaacaacacaaaagctactatacaccatgaattctcgctgtactggtgttctcacatacacatgcgcgtagaattcaacacaaaattaaaccaattcaacacgagatcgacgagcaccaacaaatcaaaaaaaagaacaagatacacaaaattaaacgacgatgatgaaccaaccatgcgaataatgaaacaaagaattattgaaaatgaggatgcagatgagagctcaagatggaaggcttgatgttgggatgatgaggatgaagaatcagtagtggtgggtgttgacgcggcggcaatggcggcggatctcgcccttggccttgggcggcaatggcagcttgctgagcttgacgagcgcgtcggagaaatcctcgtcccagagcgtgccattgtcggcgtactcgtggacatggccgcgcgccttcttctccgtgagcagctgccaatcggagttgaaggtgacgatcctcgcgaggttgttgtggtagtagctgttgtccaagaactcgaacttcctcagcttcgggaggaaggacgggatggtggcggcgacggcggcggggtcctcgtcgcggacgttgttgggcacgatcgggtcctcgccggcggcgcacttgccggcgaggaggctgcggtatcccgggaggatctgctcgggtggcgcggtgaggcgggcgcggagggaggagcagtggccgacgccgacggcgtgggcgccggagaggatgacgagctcctcgatggtgaagttcttgcggcggaagttgcggatgagctcggagatggtgaaggtggagtccgggaggtcgcgctgggcgtcggcggcgcgggagacgcggccgtcgaggcggccggcgaggacgtcgaagtggacgtggccgttgctgaggaggatggaggcgtcgcgggcggcgtagatgacgatgtcggcgcaggagaccacgcccgggcaccgctcctccaccgccgccttgatctcgtcgatgagctcgaacgcggcgaggccgatgttgatcggcgccgtcttctccgtgtgcgggttctccgccgtcgggtccagcagcaccgacgcgtcgcacccctgcaccacccattccaattcaaatcgatcattaacattcgcgcgtttttttaaaaaaaaaattactataatcagcaaccaattgagaattcaaatttgtcgtgcattttttacattgtaattaatcaatggcgccaaacaattcaaatacaaaaagttttcataaacttgaccaaacttaaaattgtttgcgtggtaaaaaaaggtcaaatcgttatactaaaatttgttcgaattttgaatttttttaggcagaaatatttcagaatttctgcattgtacaagtagaaccatagtaggataagcaggaatgatccataaatttgactggtaacaattagatgttttgggattagtgaatatcggggtaagatttaaatgtatgtcataattatgttagctaacggtaattatcacatgattagacaatacaattgataaaaaattaagcacgcgcaatgtagtcaactaataatgccttaaacactctgcatatgttgaagttctctatataccccaatttaggtagttagtcaattaacaatcttccacaccatattataagacgttttttttgacctatgtcaaactatatcaagtttgaccaagcttgttaaaaacttagcaacatataaaacaccgaattagttttattaaatccataattaaaaatatcattatattaaatttgttttgtattaaaatgctacttattctatagttgtttcatccttctttattctctcaaccaatgagcctaacactactaggccgaatcataccgtcctttggaccaaacatctccacggaatcgttcaattaattccacacatcatcgatctcatacctcctactcttgttccaccgtccaaaacactagtagttaatactaatactgttaactatatgtgtgcttggcaagtcatcctatctgtacttaagcacagttaggatctgtttgatagagctccaactcttaaatttagttttaagagttggatttggagtggagttgtggaacagtctaaatctagctccacctctctaatttattttgtgagaatgcttcaaccagatctactcttattttagatggagctgaaactgtttcgttgagctccaacttttaaaagatggagctgaagctatggcaaataaacctttaattatattagagccccttgagaaaaatgtgtgatagatcgatcgattgatcatcgtcagctgagttgttggaaaacgatatgcacatataattgcatatgtagtgtcggtgagagggcaaatgcattattggttcttaattacttgaacagttctattgctgctgatgcttaaaccacacaacgaaaagtccatgcatgctgcaacttgtatatatgtacatcatcttcttttattattttcttaaaaagaggagaacaaaaagaaagactaccgatgctaccgaccatttcgtctataatgtgctcattcaattccgtagccactaatgacctatgttgtattcttgcatgtctaaataaaatagtttcactctatatttttagtctaataacatgaacacaaattggctcgcacaaaccaatcaaaatatgtaatttaatcagaacaaatgcaactccaagaacttttagagccaagtaagctaggatgcttgcttggatgagagtgctgaaactctgtcagaacatgcactaattacttgttaatcaaaagggtaagtaaaaaaaagttcaattaattacttttactctcttttctattcatgactgaggagctagtggtaccaattattggtcatgactctggagagatataggtatgctttctctttctcaacacagtgtccccttttctctcccatatgtgtccttttcctctctctctctctctctctctctctctctcctagacaatcagcacaagaaaacaatttgccccataggaagcaaagaagctctggccccaagcacaatccaaacataatcatatcccactaattgagcttacctagaaatcgaacaccaataaaatcatgtttaactactactactactaatatgatatacatgagagtctaattaattaattatttgtgtgtatgcaaaacgtactgatgatgcatgaaccaattgaataggtagttacatgttgcttgccaatcacagcaacatcagcagcagctgcatctggctggcacccatgcagagaaaagaaaggagagggaataaactgacgacaagggcatagtgtttctgggaccctagagctaattaagctaagctaatgcagcttaattatgtgtttagctaagcagccagaagggaaaaaaaaaggtgtagcatgcattgacagtccaaatgatggacacaaggaaagtatcacattcgattccagcatgcatgttgcagatgctgaattgctggctaccaatctctctctctctctctatctatctatctttctctctctaatctacctttagtttctctctcttgccatgttggattagtagtgaactagtagaagtcaagtagctcacgaaactagcttagcttagcttagctaggtctccattgaacttttcttttcttttgtgcatggaaagaaaggaagagaaagaagaagaaactgtctctggatggagtgatgacagtgtgtcaaatgcagtggcgtgtggctgctaacttgctgataactatctgtgttgatcttgacaacaaccaaccaagtggggttcagagacttaactaagaagctgtgttatgtatattagcttaagatttgatcatttctcatacacgcttatgcggcgacgacgacgttggtgtaagataagatgctgattgagtagttgcttagttagtttgtgtaaatgttgctgttatttccatcaagagtaaagttgttttccttattaattaatcaactaacctagctagaatgtgataagtttcctcgatggatcgatcacctgatgagtgattctgaagaatgaaaccaactgtaacacaactaaactctgcaaagccaagttgtactatgtacacacacaactaactaacagttaagctagctagtaaaccttagctagtacgtactgcaaatgtagattgatatatatggatggatcaatcatgagccgctacaataattgatatgcaagaaagttaattatctgattgagataattaccctgacgaagcagtcgtggaagatgaggcggacgagggcggcgccttccttgcgattcgccttgagcgccttggcgacatggtacctcaccacgttctccactccgggacaactcttcttgtagtaatccacgctcagctccgcctccaccgacatggccgcggccgccaccaccaccatcaccaccaccgccgccgccaacctcatcgtcatcctcctcctctccggcaacttaatttctcgctatcgatgggtacgtcgccttttctcgctctccggccacgcgccgcctcgtgtgtagcggtggttggttggcgaggcagtgtggagggaagcagagaggggggtggagaggagaagaaggggtggcaggtggtatatatatcgttgcacgatcgatgggaaattgcgttttaacggtcagctttgctaagtgatgatgtgagcggggtcatcatgtgtgacagtgaagtgccaccgcgcaaaaacgcttgtaatttaactttaattcgcagatcagtttagtttacagagttttcagagagaaagggagagagtgatgggctctgatgcttcagtaagacagtaatcactgtactgcttcttcttcttcttctagtaggagtatatcttaagaattaagaagaatgaggagattagaagaaaaaggagagaaataaaagtaactaaaagggttcgatttatgcttgttactatcgcgccacctaactgcagttggggcgttgacggatcgatccgtgcgtgccatactgccatggcgtgtcactgatctctgatgtaattcatgatcgatatcaaatatggaggtagtacgtacgtcttgccgcttcgagaaatgcgcgcagcccacgccacagtcgccggccggaaccccttgccgtcgttacgccggcgtgtcgagggggccagcatatgtcgagattacgaagttacacacaacgcaatcgcccagaccgacttatgttaggagaagggagaaaaagcaaaagaaacttagagaaactacggcggctaaaaacagactccaagcggcggaaggcaccgagccatgctacactcccaacaaatccccagaaacagcgacgccagctaaatgccacatatggctctatgaatggatggactccagaaccactgagactaaagagagagtggatcaaggaagcacccgtgtcaaatatattgacgtgcaatccttttgcgcattcgtgaaaaaaatattatgaagttatcaaggaagcacccgtgttaaatttataatttaaatccaagtagattgattccaccacaaggaatctaaccagttgagatacgctcacttcattaaaaaaaaactgtacaatttacaagacaagtgtaaatattaagaacaaagggagtatgatttatttatgtacaacaataattatcgaattacttgtatacatgtgcgccgactggtttcgatataatcctaccatctccaacataaatatttaatgtttatgataatgtttggtcaagcttttaatattttgatcattaaaaattttatgttggaataagtttgtaaaacacattaagtttatgatatcttgcttcctaattaagtcaaatatagacatataattacttttgtatttttttaataaactaatcaatttgagaaatcgtcgatggtttgagttttaaaaatcaaatattgtactaaacatcaaatatttttatgagtatgaaacatgttatgttcatacaaaagtacaagtgaatttaccaatcgtcgccactcatgaatagcttgatatttgctcattagcctctccttctccttgaactccggtcggttgttggcgaggcgctgtcggtggcacaagaaaaccgtgcacacatcacgcattgatcgatacatctatcggcatttctaactggagctagcataaggttaaatttcgatccaacctcaattacgaattcagatggatggatggatgcaatcgtgttgagcatatttcgaatcatatcctggtggttgcagagttccattccatcccatcgtttttcctttttgttgagatcattaaacaacttaatttctcgtttctttgacacgcacacatagattaatgctctatgtatatgtacgaacagtagtgactccatgatccgtccatgccaacgtccctccctgctggccctttgccttctcaatttttagtcgctttcgtgcaacctccttgtactgccatactacatatgcattctctttgtctcggtcgtctctctgattaactagacgacacctcgcacgttacacgggaaattatatgaaacaaatatcaattttaactaaatacctataatatgtatgatatataaaagtgatatttttttttaggaaggggcaggtgctctgccaatttcattatagaaggagagaaaaagcgaaggttcaccgacaaatggtgtcacatagtaggaacatgagggggtacaagaattttgaaaaaaatacaaagcaactttctactggtctattggtttagcttctggcttctcgatgtgtggcctcacgtacgcataggcttctttacaagagtaaatgatgttagtgggttgtaactatataatacaggattttcaaaagtattccgtgtttatgtatactccctccttcatgttacgaataagttatgtattttgtaaaatgcacaattaatgtgtctgtaaattcttatcatcaatatctttgcaatacttcgattcaattttgaaaacggtatggctagatctgttttggggtacattttaaaatatattttgcattttgtactagcaattaaaaataaactagtgcataggtgatcattcatatcactgtagtacaaactaaacgccactatttataactgaatttagtagtaccatatacacactcttccaatcaatctactcctacccatccattttttcttgtctgtatacatatcctgtcatgcatggcagattgattgcacagaaagtaagcaacagcagctgaattaaggccatccagaatgatgaacagtattatacaatgtggtaattagcctttatttggaggccagtacacaaacacaataatattcaggctcatcaatgaccagcaagtgtctgcaaatggttaggcacattacatttggccgtgtcttcttgctgtatgcataaactagtttagatctactaatatatactgttcatgatgccatgcacttgcaggtagtagctgcaggtgacatgtcaatctcatacaagtaggaatatatagcatcatggaaatattaaaaacttaacgatttctctcaagtcaatattataaatatagatggaactgatctgtcatctctcttcctcctccatctttaatcaatttctcccgttttcttagaccgaccttttgattaatcttttcttgagttctgcaatgccgatgcagacacgcaacttgtttaattcgtgcctgaattgaagcctagtggctagcaggcagctgcaagcaagcttccaattcagcacaagtcttcaattcagaacaagtcttcagaacttaacaaccatccttggcaagctagcaagctagtagatgcatataaccttaattggccatgaaaaaagtctaatcaaaggtggtccatgaataataattccaaagtttatcaagcacgcaggctgctctccatgctagctcggattattccaactttgccttgatattgaatagactgtgcacttgcttttgctttctttgcaatttgccatactgctagctccagctatatttgctcatttttaattgaagcctttgatacatgctggagtattaatgaattaaactagctagcattggggggctacaacttagttaattagtagttacatgtgatccctactttatatgtagatacttagatgatcagtgttagatactaatattactcatgctgtgtacttgagtaccactttgtttgattagtgttggagtacagacagaatattcatcatggaaagtaggtaggaggagtacattgatgggctnctgtccaatctgttagtcatcaaggcgcgg

SEQ ID NO: 6373 - DNA, 19477 bp, Oryza sativa
  unsure (1)..(19477): unsure at all n locations
cgccccccngtgatttgctcgtgcgctactgcagaagatcatcatgtttatttggatgcaatgtttctttctttccaactcttttgtgcgtgtttggacatgatttagtaaaagctgatgatgcaatatggaccattcaaatcaatcaaggaatttggattatgagagagatgatcatagaagccggggttggtccattcctctagctttcgccatttttccttttcgtaagctagaacatcactgttaggaccatcttgggttactatgataatgtaagagcaaatagtagctaccagactaagatccaatttttcaattaattattaattaattaaccaaaatattaatggggatagacctagtgtaatgacaaaattaattgtactggtgaatgaggagatgacaagctatataggtagatagagaggttgttgacagcagtaggaagtactgaagtggcagcttgttagaaagaaaccgatgatttaattttgtaattagggcttcggccgacacacggcgctcaggtaattggatgaattaattagttttaatttatacccatccatctatataagtttgtattctgtttcgacccgtgtatatgtgctggtttcgatttaggcacattaattaaactcaagtgctcgtttggtgaccttatatatgaaaagactatacaggtttacaccagcttatttcagccattgcacatttcagattaacccttttatataaaacaagaaataacttgtaattaaggtcagtgattacaatttcggttcgaaatctcggttatctcagccaaattttttggtttttctcaaaaaaaatttacaaatttgatcaaaatatagtcaaattatcaattaaattatgttaaaatttttaaaaaaattcggtccaataagtgccgaaaatacaccctccaggttgataatacttatcattttgaacaagagcacagtctccaaaaattaaccattatttttcattataatatgtataaaagtgttaacaaatatatgattttattaaagtactttttagagaaaattccctacatacccctgaaaagtttcgcgatctcttctatacccctgagttttgcctcatcccctacatgcccttgagttttcattttgatctcctctatccctattccgttagttgaccgtgagttgactgttaaatttttctaaaatgaccatatcgcccatttcccattcttacagtacatgttatatactctacttcataattcacaatgtgaaaaattgtaactcatgataaaatcaaataggacataattatttattgaaaagaaaatttaaactattgaacaaatttattttttttgacaaaatccatataagagctttagctagaaattgtgaaccaaaattatttatttgttgggttcaaattttgatgaaaacaatgtacggatatcataaaagttaatttaaaatttatttttttttaaaaaatgttgtcaaataattatattccctttgtttatttacaaacagatcttttttcatataataattgngtttttgtcattaaactagcacataagtataagagaggggtaatatagtcaattttaataacatttaacggtcaactcacggtcaactaacggaattaatgggcatagaggagatcaaaataaaaactcagaggtatataagggatgaggcaaaatttaggagtacataagggagtggatgaattctcaaggatatacagggggttttctctactttttaagactaatctatacatatagtcaccattagtcactatatgtgaaagataaatattttaaaaatgattcataatcaaagattataaagtttgacctcacccttatttaaaacgataagtattattagcccggagaaagtactgaaatttcggccaaaatcgaaattgaaaaccctgaatcagatattatgtgtagtgagcccactcctacagaagagcagagagctaggttttgtggatttggaggctaattgtcttacacgtatgctagcttaattaactggtgatatgaaatgtattgtcggtcacagtgttgatacctagttttggtggtgattaaatgatgaacatgtgtacctgagatgagcttaactgtttttgggtaagtacaaatagagacaaaatgtgcgtgagacacgcgtgtcatatatatctacaatgtaacaaggtgaggtgttgctggctagtgtggtagcagcatgtggttgtacatctccatttcttgattggcctggcccacccaccattggttgctctcatcggcaaaacactattttgcactttcctgtgataagaggggatccatcagttggttagatcagcatatgcgaaatgctctcgacttccaaatatagggagggttcagcaagccggctgcaacggctaaggctacggctgcacacggtgagtgtgacactgttcataccggttacggtgcaaccatgaaagtagcagccaaatagaccataatgtaatgacttctaaatgtatcaacatttaacactctgagtgtataactgtaatgacttttaaacattacatttgatcatctgtcttataaaaaaactatataaatatattatttattttgttatgagatttatcgttaaatggactttatttctttttttttgcatattttaatattttaaataagacatattatcaaatattatgtttaaaagccaactattacagattcaaaaagaaaatgatatattaaagtacaagtgaattatccctctccattcattaacagatgcaatctgatatgatattaacgtcgtatcaggttgcacggaatatagtcatattttctttttctgaatactgacacatcagtggaaccagccatcataataccattgaatctaatttaacccgattttatgtatccggtatcgcgtttagggatacgatttaaactcgacggaaatacaacgaatgtaaagtggacttatcctgcccgaatttacaaggcccaagcccaaaaggcccatccaactcacatcgggctacgtgggccggccggcccacacacaacccagaaaaccgccttactaccgacaatgttagctccctctctcttcctcttcgtctcgactctgaactaaaaactcaactcctcccaaaatccctcgccgccgccgccgccgccgccgacgacgacgacatgggccccaccacggccaccgacaccggcgcgaggatgaagcccacgaccgtcgcgtcggcggtgcaccgcgtccagatggcgctctacgacggcgccgcggcgtcgagggagccgctgctccgcgcggcggcctcgctgctctcggggccggactacgccgacgtcgtcacggagcgctccatcgccgacgcctgcgggtacccggcgtgccccaacccgctcccctcggaggacgcccgcggcaaggcggcgccgcggttccgcatctcgctccgggagcaccgcgtgtacgacctcgaggaggcccgcaagttctgctccgagcgctgcctcgtcgcctccgccgccttcggggcgtcgctcccgcccgaccgccccttcggcgtctcgcccgaccggctcgacgccctcgtcgcgctcttcgagggcggtggtggtggtggtgatgacggtgggttggcgctagggtttggggcgagcggcgatgggaaggaggtggaagaggggaggaaggtggagatcatggagaaggaggcggctgggacgggggaggtgacgctgcaggagtggattgggccgtcggacgccatcgagggctatgtgcctcgccgtgatcgcgtcgttggaggtgaatcgccttttgctgacctcttctatttctatttgcattgagcattgattggtttttctgttcaaattatttactcgtttggtttgattgtgctgccataggttagtagtacgatgagtgaggtttatggcggtggcattctctgttatcctttgtgctcaaattaggtagagaaaaaactttggaagatagaaaatggaggaatttgtagtgttcgtagtaaattactttgagtatcaacaattgttgttgctagtagcagttaggaaaattctctgtaacatgtacaactacaacattttggtgaactagttataaactccttgtgtaaaatctccctacctgattagcaaattagtagcatttgtgtatgactagaaacaatcaactaggtaataattgagagctatcaaatatggtaagggacagctgaagaatagacataaccgtggtgccatattttttggttgcagtcattcaaattacaagaggacaactaggcaattcactcattttgtttagacctacatattgttgttgataagggacgctagaacgaagataggagattgagagagtaattaatttttggaagtacgttacagattttaatgggaggtagtgacttcttttttgagagattagaggggtgagagatgagctgcttactttgtcaatgaaaagcgctcaggttttgttcaatatttccccgaagaaatacaaaaatcatgtctttgtaagcatcatgtgttgttcctcttttctcactgctcacggaggtgcctaaactgcctaacaaggtggcaaactggtccctagtgcctaaacaccaagccaccaaggcagtggtggtttggtgggagtgtggtggtacttagctcctacctcctaggcactgtttgtttttcttatattcaaataatgttctagaactagatgtgacaatgttacaagagtaacaatagttttacttgcaggcacatttatatatatgaaaaggatatgctcattcttgctctttgttcgacctgtcttagtttcgaacaattgaagaaacaatgagcttgtgttctgtatttcagggccaaaaaaagaggctaaacagaacgatgcttgtagtgctgagcagtccagtaatattaatgtggattctaggaatgcttcttctggtgaatccggcatggttcttactgagaatacaaaagcaaagaaaaaggaagcaaccaaaaccccattgaagatgttcaagcaggatgaagataatgatatgttgtcgtcttgcatatcggattccattgtgaagcagctggaggatgtagttctcgaagagaaaaaggataagaagaaaaataaagcagctaaaggaacatcgagggtaggtaagagtaagcctgcaaaaagaccagttgggcgtgatggacatgaagtggactttacaagtacaattattatgggtgatcgtggttcagaaatgatggatcatggtgctctgggtcaatataatttctcaagttctatattagcaaatgagcagccttcatcatctcaatatgcagcgatagattcagtgcaagcttacactgaagaactagatgaattatttagtaatgcagttaacattgcaaaagacgagacaagtgatgatagtggtagatgtacactaagatcttcattgaaggctgttggatccaagaatgcagggcattctgtgaaatgggcagacgagaatggaagtgtgttagagacaagcagagcatttgtaagtcactccagtaaatctcaagaaagcatggacagttcagtaaggcgtgaatctgcagaagcttgtgcagctgcgcttattgaagcagcagaagctatttcatctggcacatcggaagtagaagatgcaggtgaacacttattccttaaccctgtggtgctttgacatgcagcttttgtttttgatatgtattaacctgtgccttttggtaacagtttcaaaggcaggaatcatcatactgccggacatggttaaccagcaacagtacaataatgattatgacaatgacaaagatgcaggggaaaatgaaatatttgaaattgataggggtgttgtgaagtggccgaagaagactgtgcttctagacacagatatgtttgatgtcgatgattcttggcatgatacaccaccagaaggctttagtctaactgtaagaattcttgagaaaaaataaagtagcacttcttcttttttttccttctggttgaatttggcatgtcatgccttttttccttttcagctgtcctccttcgcaacgatgtgggctgcattatttggatgggtatcccggtcctcattggcctatgtgtatgggcttgatgaaagttctatggaagatttgttgattgcaggtggaagagaatgtcctcagaagagagttttaaatgatggccactcatctgaaattagaagagctttggatacttgtgtgtgtaatgccctgccagttcttgtatcaaacttgaggatgcaaattccagtctcaaagttggagattactctggtatggataaagctagttgaacaaactaattaaaaagttaaaacattttttaaaagaaaagaataaggactccgcaattggttagtgacctagttgaacctggatatgtatttactggctagtacatatagtttttcagcagcggctgtgaagaggcttttcgttgcattttgttctggtatctagacacctttgactgagatcaatcaagctactactaccaaaatggtcagtttaacaataatttcttagtcatttggggttctctctcattcataagtgtgggtgatgagctgcgcatatctggaaatagataagacgaagtggaggctgtacgttacagttattctgaattagggccagtctcttttttgttgattctattgaagacagcttaactgctagatgttgccaccaagaattttatttgttagtttgattacagtttcagtaattaacatttagagctataattagtgtgcatctaatgtgtttttcccctccccactagggatacttgttggacacgatgtcatttgttgatgcactgccttctctgagatcaaggcagtggcaattgatggttctcgtgctgcttgatgcgctctcactccatcggcttcctgctcttgctccaataatgtcagattcgaagcttttgcagaaggtgatgatgcctttccctgcctttctgctatgcaagtagacggatgcacatattctttttaagaaatctgatctttcttcccttttgtgtgctgcagcttttgaactcggctcaggttagccgagaggagtatgactccatgattgatctcctcctcccttttggaagatccacgcagagccaggcatccctgccaagttaaacctcaagcaacacaagtatctaaatacatgtttacacagcggagtaaatagagagaggttctacatatcagcgtcagcttggcagtctattcggatatactatcataatggtgcctcttgcgtctggttgtttaggtttcggaacacgtcttgcaaaatatcggttgctcccagttgcttcaactatcccctttgcattggcgtcagacgtacaagcggagcgggcactgattcctgtcattctcaggaattgttagctttagtgaggagagcaaaagataactgcctccagaacaatttggtccactatggacttttatctctcattgctagcgcagttcagaattgtagtgcatctttgggttttttttttacctcttttaccggtgtgcagtttgtcaggttagtacagccgaatttgaccagctaacaacccactcgtgagtcctaataggtgagtgctagatatcaagtggtatagtaaacccagtgttagcatctataaaattctgaattttatgcctgtcaatctcgcattcatggtcaatcggagacttgcagtggctgtaactttctacaagttggcatctcattgcagagagagaagaacaagagcaaaaaggttggcggctgatggctgaagtgcgaatacattgaaaacccaggtgctgccttatcgcaagagacttaaaagggaggagcccaaaaggagaggttagaccattattagcttggtgtgaagtgtgaacagagctgcctgagcttgaggattagcagcaaacttagtagcgtgtgtgcctcttttttccatgtgaaatcgtcgctaatttggattcatgtcctgattggctccttgtctcgataggaatttgacaatcctttaggtatttcgtctgaccggttgcctagattatccactctataaatgatagcagtatcagccccaacgcccaacaactagcctaaacgctttaacactacctaggtttttgttttggtgagctggagatatgtgtatgcatctaacactgatattccatctattccaaaataaatataactacgcctagtacttaaaaaatatatttattaaaatataagcggttctagcactatttaatgcaagttacctttcatctaaacttctcatcttacccaaagactcccatcctcagaaatatccatattttgaaagtaaaaattcaacggaacgtattttctgcttagctcatttcattgattcttctacaattagcaaggaaatagtattttcctgcttagctaatttcattgattcttgaactgcttggttcacaaaccaggaagagcctgttttgctctccatagtcttacgtggtgtttggattagtccatgtatttagaaactaatttaatttaaagtactaaatatagactacttacaaaactaattatataaatgaaagctaattcgcgaaataaattttttaaagcttaattaatccataattagtaaacattatataaatgaaagctaattcgcgaaataaattttttaaagcttaattaatccataattagataatgtttactgcagcatcacatagactaattatgggttaattaggcttaatagattcatcttgcgaattagtccaagattatagataggttttattaatagtctatgtttaatatttataattaatgtcaaatattcgatgtgataaggacttaaaagttttagtcccatctaaaaaaggtctaaatctatctcaacgaattggtctttcaagaatgggacaatcaagaatctcacagcaacttggtaaaagagcatttcacagagagagagagagagagagagagagagagagtattgctcaagggaagctagtccatccatacatgaactcaacagagatatgtacaacagcaatggtgtgaacaatagcagtaacatgtcaacaaaacgcagaaaaataataacgaggaaaaaaaatggcctacaaaactgccggctgctcaccctccctgctccacctcagcagcctctcaacaaatcagaagaacaaaaaacaactaatgtcagcatatgtacacaagtgtgaagtggccacaaccaaacaccggcgcctcgccctagcgatcagtctccagccagctcctcaggttgcacagggcctccgcagagaggctcttgcaactcctcggcctcgccacccccgcctgcccccccacctgctcctgccgcggcgacccaagctccgagacgaagcagacgacgatcaccgtcaggttgtcggcggtctcgagcctcttggcctccatgacaagctccctcgcgcacctctcggggtcgtcgtgctgccggagcccccgtcggacgatgctcaccgcgtgctggctggtcatcacgtcccagatcccgtcgcaccccatgatgaggaactcgtcgtcctccgtgagcatggtctgtcggaactctggctcggcgatgagaggggatatcgagccgtcgggcattttcatgtcccagtcccctagggcccgtgtcacggataggactccgttgaggtagccatcctcgatgtatcctccggatgcagcaacccgttcacactcctcggcatagtttgctctgtgatctcgagacatctccatcgctacgcctctccggcaaaggaccgcacggcaatcccccgcatttgcaaccagcaattgcctgcaagacagttcagcagaacctcgagtgagcatccacactgaagcatgagatgtgcaactatagatactggatatgtttttttttaccttccgaagactaatgcggtgagtgctgtagttccggaagagcggctgatatctaaatcatcagctaaggcaagatctgcttgcaagaacgctctgcgcacagagttctcaactgactgaacatatgtttcatctacttgcgatgcttgtgggaactcactgtcctcaaacaggaacctcattgcatgccttttcatgtaggctgcagcatccaggcctccatggccatcgaagacctaaaattgcaaagggaagaagcacgggcaataagttcaaccattgttgctgaggaagtagcattcacaaatcacaaatcagggtaggcattcacatagaagattacacttaccccatagaaggcactaggcaacggacacaccaagagcgatccaagatgggcagagagatcatctatccggatgtgctcatcttccatgtacctcctaggtccaatatcagcaaagctaccagatcgaatactgggaacaaactgtagtgcatcaactgatatgctcggtgcaccagcagcactctccaacccctattaataatgaacagaaacacaaaaattactaatcttatttctcagacacaaaacaaacataaacaaccaattcttccttaatctgctaaattatatacccagcactgccactgacctacttgcgtagttatgtttcaaacataatcctatcctgccgctcacgcagcactatgatttaccccactaccccactctacactgaaataagatactgaacaagagctgaaaagtttcagctacagctatagaaacaggacaacacttttaggctagataaacaatcatctgcgcaaattcgtatgataagttgaacttgcgcgaaagcgcataaatacatactacaactcaactaccactagcactatctacacaatggatccaataatatcagcacccaccttctcaaccttctggcctacaaccaccaccctataccccctaaaaagggactacttttttttttcttacaaactgtgtcagtcttttgcatccacgaacagaaaacaatctcgtgtaataaacagaaaggcagtaaactccataataaacctaaaatccaataacaagatgacagcaataatttacatagagatatctaaaaatcagagctgattacaacaactgaaagcacctttttcacatgagtagtattaacaaacaatcctaaaattactgaaaaacagctgctaaactgctagtaatccttgctagattccatgttatttcccacgaaattcttcgatctcccaactgaaatactactgaaaacgtagaactacagaacacaaagttgagcaactcaccatgtgaggcacctggacggcaacctcgacctcgaccaccggcggcggcgcgaccgccgccgcggcggccacctcctcgacacccttggcgacgcaccggtggtacggcacctccaacaccggcacgggctgatgcatcacctccgcctccgccaccatctctcccctcccgatccaaacaccaccgcctctccggtcaccggagaaaaaaaaataaaaaaaaaatcaagaaaccgagcagcgatcgatccgcgcgagaggccgcgatccgaggggggagagggcgatctcgatggtttctaggacacggtttcttgatctgaggaggaggaaggagaagaggaagggggaagaaatgggggaagaggaggaggggtggttggtatttatccggtggcggtgaccggcggcgaccggcgacgatgcggacgggtgaccgggtggtgccggtggcctcaccggacacgtggcggtctcacgcccgtgtgattgcgctgccgacctcgcctccctctttcttctagattggatggaggccaagggagagtgataaaagatgtgttttttttactaatctagagttctaatcaaatgatttactacttacagtgttaattactggattagttagaggcttgggagtgatgaagaatgtgtcttttttttttgagtggtaatcaaatgatttattgaaatgtttgtgttagaaggaagaacaagctaaaaaaggatgtaatttttttgcaagaatgatttggattggaggtggtgagatgcactttggtttgaaaaagaatgtgtctatttggagtgctaatcaaatgaaatggtctatggaaatgtttgtgacacaaggaagaacaagctaaaaaaatgtaattttgcaagaaatatttggattagagggagtggttcttttgcatatgggtgatggtggtggtgtttatatatgcacttgtttggtttgatcagctttgattttcgggaggtgtggtcaatttgagtgttttttgtgctggtttacagtttttgttgcatacgttgtttttgggtggttaatttgaggttaggggtgttacaaacttacagtacattgattaattagctggtgttttaaagtgtttaattactaactcgtggtaaatgcatagcaggtttgctcttttcctgtttttaaccaggcagttttggttgggaacaaaaggcaggttattcttacttttttgaagggaatataatgagaatcacacatgctaacggtacaaagattactactttttttaaggggaaaaaatggcaatcacttgcaggtgggagtgactgtttcttgcacgtcatcaactgaatctctgtccacgtgttcgaacttgctgttaatcactgaacagcagagcagcttaagtagcaagaaggaatctttgtaaccctttgtcatcttatctcttgggcaagaataagatggcaaattagattgttgtctactgcctgtcagtggaatcacaatggaagatatcaagataagtacatgattaagaacaattagagatttagaggatctgagaggcatcaatcaaatcttattatgaaaatttagccactattatcttcctgaatatgacatgacaaagagagacggtggatcaaatcaaaacggatataagaaaatcgagtttttttagtagggtatgttttatccggcctctacatgcaaccagatatatatagcctttttaaattagaaacttagcttctcaaataacacaatctgaaatcgagttaggaagttgatgctttatgggcatgattagttactagtttattttatactacagttcctgcaacagggtgcgatcatttaaaaaagaaggtggccaatccaataaatagattgtactagaaatattagtgaataaattacatttcaatgtagttagaggcctagaggacgatcatgtctgcaaaatttaagtaaacatattccaacagaaattttgcaagaaaagtatttttcataacactataatgttatgaaacatacttttcaagacaattcttctcatatggttttcacacgttaaatctgaatatttaaactaaattggcgaagagaagttgttcttccttcatacacccaattaagttataagattgactgtgatagtgtgatatctatccccattggtgtctacagtacatatagcttatgattatttttttagaaaaaaaggagtgaagtaaatgaaaaaattgctttccaaataacagacacaaacggtgcaagatttatatataatgttgacaaagcagtggcacaccggacagcctgacgtaattgtgatccaaatcactgttctaacacaggatgagctaatccgatccacttcaagttcataaatgacacaagattgcttcatttggggataaactaaataatccaaatatataatttataattgcaatgctattgcttgcagttccctttccttttcgtatcactttcttcctacaagaagcgaactcttgtggcttcatttgttcctgacgcatcttcactttgtacaagttgaccaaaagaaatagacaacataagaagatcttttacaattgaatggtggataatttaaggaattgtgaagtaatatttttttagtcagagattgtgctccatttcttttgacaaatttaattgggaatttgggattgctctttattttttatcgaaaatattacttgtttcttcagtcacaagataaacaaaaacttatgacaaatgatttggaatagtaaaaaaacccaaatatcagacaacttcactaacaccacatatatagtactgaaagaaaatgttggaatctcacgcaggcctcaattgaaacaactttatattttttgtcgaaactattacttgtttcttccaatcacaagatagtaaaaaaaaaaactagtgagaaatgatttggaatagtaaaaaaccacatacacaaagtatcaaacaatttcattaacagcatttatagtactgaaacaaaaatgttggaatctaaagtgaaactctaccagctctcaggtttaagttagttaattcatttttcttgaagtttcttgtgctggagccaatgggagggcaacaggtcatctcctaagaatagtggtgacaaagaaagttggcccctttcttccactcctgtcctctggagctccctttcttgtctgtagttggttgagaaaattggcaagcaagactgtcttcttgttttttggggcctcatcatcaccatcactaccattcattttaaggtcacctttgcaagaactgaaaaaaaaagccaggtggcagtggcactaatcacactccagctagtttgtggattgtaagaaaaagagggagagaaatgcagcatatatgtattctggatttttttgggggcccctttcttcttgttgttcagccacaaattcaggaagcttctagatgtttggtctgatggaagacaaccaaaatggcctgatgagtttctggtcaggaaatcaaatcaattttgttattttccagtgcatgcatgattgagtagttggttagggatgagcaagcttatgaaatatgtggttgttttatcttgttcagcattatactaattgtgtatatatatgtaattaacttattgtcatatgcacaagaatacgtaacagttagacaggataagatttcttcttcccactgccttaatattattgtttttggttcactaataaaagtttttttttctagtcttcctttggtttctttccaattttaatgttttatgttgggtgtaggtatgcattcctcattgtatcctacaagccacacctgaaagcaataggtgcaaaatctgaaaacgttacaggagtacatcatatgacaacgcaatctaactaccattgtgaaaaagataatgcaatgcaatgggattagcaataaatgaatactatgcaaaacacatgagtatgtcaacatatcaagaatgataagtaccagtcagtaggccaggcccagcccacagcccagcccaaaaataaattcataacttgccctaaacaagatttaagtctatctcacattgtgcaccactggagtacaatagcataagctcaggcataatctgcaaatttcttttatatcattgtctttttagaggataataacattgatcaacttattatctaatggcataataatatttcatagtattaaacaggaggaaacaaagtccaatctcacttttacatcatactagcttcttgctagtagtaactccttagcaacctaatccatttaattgactactttgagaaaaacacacaaaaagtctatgagcgtgtttccttttgtcaagtttcgtgtatttttgatattaagagtctaaccaccaaagtgtacttgaataaaaagtcgtccaattaagctgctatattcaactaatccattcaaattttggagtttgaatcagaccgactcacactggcccatatatgcataccgcataaatttctcaccaatcaaatgtcagaaatacttcaataggttttgaaagtttgaaacaacaaaccgtgtatacatttcatccccacacacattgattgcacgcagctgacaaattcattgagcattgcaccaacgagttgaaaatttcaaatccaaggaactgatcagttcgtccgtagtaagtactagagctactgctaattaattactacatgatgcagactttatcaaattaatattgactgtatgctcacatgaacatgtgagtactatacatggccaatcatatagagacaaccatggtaaagatagcttttgtatttttagccaaaccttcaatatttttagaactgcatgatttggtctgaaatttgaccgatttaaggtgctacaccaaataaaaaatgacacaaaatgtggattagactgagtaattaaattaagatggtttggtttgatcgggtcggttggacctgttgagccgtagcgtcctgccggccgtccaacagcctgtcatgtcggccattgcttccgattaatttgtcttaggctacatcattaccagcttaatgcttagctacttctcattttcagtgaacatgattttcgacggatgcataaacgagtacgtattttatactccctccattccaaaatataaggcacaaccaattttcttagatgttcctgtaaaatcaaatgtgtttttgattattattctgtgatgaacaattgagcattggagattagtggttttggagatgattggattcacaggtgatcgcaggattcattatttcatgtgaccggtcagaccgggctctggtagccggtcggaccggcggtatgcgcgtggtcaggtggtctgaccggccgacactgtgtcggtttcggtttcgggttgtttgtttggatatccatgattatttcataattatgacttctagatggatactatactatgtaatactgttgtttgctactaatgagtcaagttggagatagcttggtctcggaatatggtttctttgtttgttccatgtgtaggtgactcgatgtctcgggagagtatttgcggtgatggaccaggagtcggcttggggataaggcgacgtccgtggtggtcagagatcatgcgggatacttaggctagagttgatgcacgtggttgatagagattccatatggcatatgatggagttattgtgtgcgtatgggatgcggagtcaaatttggaaggagtccaaatttggtacgattggttatgtaaagtttctttcttgtactagagggtttcctaatgtgtttaggactcttagtatgagtttggttcgtggctttagcctgcctacctcatgtataaatagagggggagcgtgaggcttcccggtatcgcttttgagagcaattgagttgagttttgagttagggtttcgagtttagtcgaaatttttgtaaggagtgctgttggtgcactttgtaaacacagagagaatcaataaagttgtcatctactgtaagagttcttcgatttgtgtttcaccgggtttcggcggtctaaccggcgacacaccgactgtcagaccgacggcatcgcggtggttagatcggcgggtacacggcggtcagaccggcgtcggtgacaggcgtcaggagcagatcttggaggtcataccggagattcaacaccggtcagaccggcggctacgcttcagtcagaccggctaatctactccggtcagaccgatctcatcgaaattgagggtaacttttatttccgctaaaagttttcggtttttgggtatagcaaccattcagccccctctggttggcttagttcttgtgattcgatcctacaagtggtatcagagccttgttttcttctttggatttttatcgatctagagtttttgccatggctactcccgctaggttttcaactaagcctcatgttttcgatggaacggatttttctcattggtatagtaggatgcaatcttatattatggctgaagattatgatatttggagaaaagtttctcatccttatgtgattcctgaaactattaatactgctgctgaaaaaactgcttttgaacaaaattgcaaagctcgcaatattcttttgagtggtatttctcgtttggattataatcgtgttgctcatcttcaaactgctcatgagatttggactgctttgagtaattttcatcaaggaacaaataatattaaagaacttcgtcgtgatcttttcaaaaaggagtatattaaatttgagatgaaacctagagaagctttggatgactatctttctcggtttaataaaattttgagtgatcttagatctgttgattcttcttatgatgctaattatccacaatctgagatttctcaccactttttgaatggtcttgacatgtctatttgggagataaaagttacatctattcaggaatctgttaacatgtctactttgactttggattcactttatacaaaattgaaaacacatgagatgaatgttctttctcgaaaagttgattctaagtcgagtgctttggtttcctctttggatgttgatgcttcttcatctaagtcttcttttcttgctatttttaatgccacatccgatgatcaactcgaacaaattgaggaggaggatttggctttggttgctaacagaattgctcgagctatgaataatgccaggaagaccctcaacatgattttggatcaatcaaagattagcacacataaccgtggtttaggttttaatccttatgctcataattcttgacatccacctgttgtgttaggtgttggtgctagaagtggtgagattttggttaaacctgatactaataaaactgtgtttaaatctgctggtatcatatctactatgaatgcatcttcttcaaaatccaatgttgtgcatgcaaaatctcctgttgttgctcatgttgctaaatctactagtgctaccaatgtgtctaatcatcgtgaaaaatatacttgttcttttttggggcaaagatggacatattgttggtttttgtttcagattagctcataaacagaaaaaggagagagagattgcctttacaaaatcaaagtggcaaaaatctggttttccctcgaggaaaccggtcagaccgcagtgggtcccgcggtcggaccggcgacctatcagaccggctgaacagcctcggtcagaccgaccaccagtcagactagcggtgatgcctcggtcataccggcccccggttagaccggctgcacaccctcggtcagaccggcctcggaggaatttttccataaattctaaaattgattttgcacgtggatatatgcctattggatcttctggtcgtgtgtctcagtactggattcctaaatttttattatcatctaacccaagtactgaggcttcgacttctgcttgtgtgtaggctttggtgacaaagaaggagaacgtgtggatcgtggattccggttgttcgcagcacatgaccggtgataaaaattggttctcc

SEQ ID NO: 6374 - DNA, 954 bp, Oryza sativa
  unsure (1)..(954): unsure at all n locations
gacttagactttcatcatttaaaatgattgtgtctacggtcgtcttnctcctaattcttanttgttnctatatgataancatttgtngtagtgtctcaanattggtgattatatntgtctacntncnnnncnncccnnncccccgtggttttgatttgcagcngctgctattgcaccccnnccannannanagnggnaaaccatagcagccaggagctaaccaaanannngacgctcacggcgacggcgagaggggagcaccactatatataccccttggatgcacagctgctaatccatcaatccatcctacttaagcagtagctagtaagctagctaagcacacacacacttactaattcagctaaggatttggaggatcggagatggtgatggtgaagcttaacgcggcggtggccgccgccgccgttgtgctgtctctgttggtggtggtcgccgtgcatccggcggcggtcgacgccggcggcgattggtacggcaagaagagcatctaggagacggtgaggaaggaagtggagaaggccatcaagcacaatcccggcgtgggtgccagcccttgaccgtttggtgttccatgactgctgggtcaacgtaagtatactaaccaccatttacttttttttttccgagtacatgaatgacatacagacacatacacatagatcaggatcctctgcagtcgaagtcacgtgtctctgtcactggcatgtggatccaatgatccctggacccacatgttagtgacaaatataccgtgtattttgattgaagaggatctcaattccacacgtaatatgttacacatattacatttgcacgtacatatgtgctttaaatatattgtctttaattaacacactctcaaaaagattgggactgcttaaagcataaataaacctgaagcccaatagtttgcagcttaactggaaataa

SEQ ID NO: 6375 - DNA, 1965 bp, Oryza sativa
  unsure (1)..(1965): unsure at all n locations
gtggccggtaagacanctgttggaancnnaccatacgcgtgctccatggatcggagaaaaatatactccattcatccttaaatatttgacaccgttgattttttttaagtatatttgaccattcgtcttattcaaaaacttttgtgaaatatatatatacataaaagtgaatttaacagttaatcaaatgatagaaaaagaattaataattacttaaatcttttgaataagacgaacggccaaacatatcataaaaaagtcaacgacgttaaatatttagggacggagggtgtatatgaaaaaattgggcgtggatgcatgcatgggatcgatcgatgacataatgtttggtcaccactcaccaatcacacaagctaattaaattaaatgcaaccatcttctcatttgtttgttggaagctataaactgtcggtaaacgttgcatcatgcgggggaaaagtgtgagatgagtactttaaatatgttaattattactcgtctcaaaatataacaatttatgtatgagattagatccaacctaacactatgaatttagttcatagattgctaaattttgaagcggggagaatattaatttagtgttatcatcgtactattgggtgctcgcggatgtttatgcgacacacaagtcatgtatggcataaaaaaaggagtttgctaacgatacatatatgtataggttataggttgaacacgttcttaaattagtataaaaagtcacctttaataaaagttaaaacatatatattacttccgtttaaattacttggtgttaagccagttaattttttttatcattgactaatagaaattcgtgtatagtttatgaaagtactttatatggtgatgaatataaaagagtacttaattagggtgcgttctttgttgggagttcccaactccctatcatggttttccgtgcgcacgtttttcaaactattaaacggtacgttttttaaaaaaaagtttctatacgaaagttgcttaaaaaatcatattaatcaattttttttaaaaaatagctaatattcaattaatcacatgttaatgcaaatatcgttttgcgttccggagaggaggtatcctagtatattttatttcatacttccacgtgaagtgaacacatacaatttctcgcattcaaacgggctttaaaaagaagtgaacagtaaatgttgacccgtattgaaggtagccatgtatgccccgctgtcacaattaacggtcgtaattaagcatgcaaacacctgatgcattatctgacttaaattgatgtgggccaatacatatactccatccgtactaaaatatgaaaaaaaaataggtgggtgtgtgactataaatcttaacagaaagtcaaatcagatttatgatcctaaatatattacatttatataaaatattttatattttaggagaagggaataatatatatatatatagcttacgtgaatgcatatgacgcttgatagttcatcgccggaagcaacgtgcagtgagtcatggacgcaaaagttttcaacgtagcaggttggatcgagtacgtggcatatataggcagtgaattgtagtactggctcactttataccggcacgtccagttttccccttttcacgcaaaaaacttcacgagaaagatgaacaaaatgacaagaaacccacacatgcagctatttacaaattacagtctcctctctcatgtcctggcagtatatgagtgtaaacacttattagtccacataattaatccatttgcaaatactaagcttagtgtagtaccatctttgccttagtgtctttaaatgtttaaccgttcaattattaaatactaattaactattggttattggatacaacctcctttttaacgcacataattattgggtatttatactctcttcttcttattcaatactatttactttttctccatcctaaaatatn

SEQ ID NO: 6376 - DNA, 19044 bp, Oryza sativa
  unsure (1)..(19044): unsure at all n locations
gccgggtttgatgatgactggccagttgcacancacatctatttaaaattcttcatattttgagatatggaatatattttaggatggagggagtactcattgactatactttttgcttaaaaaaatgtgggatcaatcaacggttgagatggtcaaacccatgggtcaaccaagggatgagatggaaggagagtccgggaaacgaggcatatgccctcctgctactgctgcctccgcttgtcttgttggccttgcagagttgcaggttgcagcaaggagcagcagcagcagcagcgccatggggacgtgggtggcagacgagacgacaaagggggctggctgcgcgcgaaaaaccaccgtatcgacacccccacgaccccccgtgtggccgtccccaccgtgcgcgcgcgcgcgcgcgagcacgggaaatagaggtgatttgtgtgtgcgccgctaggggtgaaaacggtcggaaacaatatctaaaactactatcactttaaccgatgatcgattgtttttgtcattctaattatttagtggagatggtaatacaagattgaaatgatttagaattattattttatatagggttagaataatatcgtatggtgaagtgagcataactcaattgattagaaaccgattcacatgagttcaagtcctggacttgatatagatgcttgtatttacgtctaattattatttttcaatgtgtgacaatatacacgtgttactttatcaatcctaagttatattagtccagtctttcaaagatgctactccatctataaaaaaaaatgctcaccactcgtaacataaagattaagaaaaaaaattagggccagtttggtttgtgaccaatgttggccttaccaaaatttggcaattttgacaagttttggcatgccaatttttggtaaggccaacatgtgtttggattgaagccaaattaaactaatttggctattaaaatggcctatgttatataggcatgtcaaaatttggcttcaatccaaacatacacaattattgttaaggttgccaaaaaaattggcaagcctaatttaggcctcaaaacaaactggcccttaatcattctcattggttggatcgcattcatgcatacaagcaatataattgaagagctcgatggtttaaaacaaaccaaatttagaggatcgaggtgctagttaatatatatacgcatatgttttatattatgaggcatgaaaaaacatgattgtacattatatttttggatagagggagtaattaaattaggattttaaagatgctaataaggatatgatgtgtgtttatgagcgtcttcgtttatatcatgttttagaaaatgagaccgtacaaaaaagcacgctcggtcggtcgggcattttcgtgacaatcttcatctcgtaatctcgttcgtgtgcgagggagtggtgcccccttccaatcaatcatccaaagctttaatggatggttattaaaagcgttagtaaatggcgtcaattaaaggcacgcatttaaggggagttttactttggggttaatggtgttttaccattaactacttgtagatccagagatcaggtcgtctttgtttgctccattggatgattataatttggggcccagctgcagtagtggtataccgtgtgaagaatctaaagttgttaaggcaagcatatgtcttctgttcgtgtacgcttctctataattactacagtatttttatacaagcagtaaatatgtatatggtattatactgtttggtggtactccgtaggggccaatgaaaaaaaagggaagaaatagaaaaaaaacgtataattctaataacaattgcatgtacaaaacagaggattataaaatataggagaaacacaagaataaccatttcattgaatcacaggaaaaacacaataatcttataaagggatagattcaaaggaaaatttctaagaggttgaaactcttgctaaattttcttcacaaaatctttctaggattattcattctataggaattttaaagcatacaatatgattcaatcctttattttaaagggtttcctaggaaattttcttatagggttggaatcatcctaaactcctactcttatatttttttttctccaaatcaaaaggccctcaatgtaggagtacagtcactgtgcgatactattcatttgtgcgtggcaagttgatactactagcttgcaatgctatattcacttgtgtgatcgagatgtgtctcatccgtttccacaactcttaaaagtttggatcattttaatcagaaaatttgttccaaaaaaattctcaaaaaaataatgatattttttttaaaaaaagttaaaaatgagatacggaattgtcatatggaatgcccattttctactaatttaaggcctcagaaaaaaaaacattactactagtaccaatttaacatgttcatggaaaattattttttgccccgtccaattgatacatgagatacaatacaaaatttacagacgcaagaatttcgccggtgcggggtagtacatactacagactacagagggatggcgtttcgtctgtagcgatcggttggagcttgtggatgaaatgggccccaatttctgttgccctccaccatttttgaccccttaaaattcagacagatggacagtctacttacattctctccctcatcttcttctcccttgagatgttcttgctgttcttgctccaatctcctcttgttttcttgctgggagttgtggtggctgctgctgctgagctaggagtagttcacatgtgtgtgagctgaagctgaggttggttgcttgcttgcttggccatctggaacagtcagtgtctctgcttttttcctcccatttttttagtttatttttttggctgcagagagagagagagagagagagagaactctgctttcttctccaactccctcccttttgctttcccacctctttgcctcaataatgatggggtggtgaaaatggtggtgggtttggtcttgaagctcaatgcccactctctccagctctctcctctccctgtccaaatccaccaccagcttctttctttccattttgcttctccctttctcttttcctgttctagttggggagcagcagcagcagcaggagcagtagtagtaggttgttggttttgtacctttgggctctttgcctttgctttcttgctggggattgggaggcctgccttgaagctgaatcccaatcttcccctgcccacatctgcttcccagcatcctgcaactttggttataaggtggttggtttttgttcttgatttgcttcatcgattgggaggtttcttgctgttcttgggttttgtgctgtgaattggattgggaggttttttgttgccatgagggcggcggaggagaggaagggtgtggtgccggcggcgaggaggagggaccagttccccgtcggtatgcgtgtcctcgccgtcgacgacgacccggtgtgtctcaaggtgctcgagaccctgctgctgcgctgccagtatcatggtaaatacttcttcttttctttttgcagttcagtcttggtttttttttttgtcttggaacagcaatatcaattcttacaaattttattgttagatgtctatatgtatgttcttcagaattttgcctaatgctttatgtttattcaataaaatatttcatgaagttatcgtatactatatatgctgcatgcagctacagagatgtctagttgtaaattgtttacatgatctggatttatggtgtcattgttgataaaagaaatgcatgctgcaattttttttttttttgggggggggggtttagggtgaattgttgttgtcgcagatgccttcctgtatcttcaacagctattcacttgaaagagtaatttttgttttgtttttccagtgacgacaacaaatcatgctgctatcgcgctgaaaatgctgcgggaaaacagggacatgtttgatctagttatcagcgacgtccatatgccagacatggacggctttaagcttcttgagcttgtggggcttgaaatggacctccctgtcatcagtaagtcatgaatcttatcccttctcagagctatccaataatccagttcaactgttcttgatagtaatagccactgtgagtgaagatttttcttgtatctgcagagcatcaattcaatttcagtttattcagcaaatcctgagcactgtactgtacttatttccttctatgacgggtagggggaaatgttgatgttaaccaattagtaatttccttgcagtgttatctgtgaatggagagaccaaaactgtattgaaggggataacccatggtgcctgcgactatctcctaaaacctgttcgaatcgaagagctcaggaatatctggcagcatgttatcaggaggaaattcagtactcgcgaccgtgctaatctcgatttctatgaagagtgcaacaagccaccaaatgcggattcagaccatgtgcatggccatgttacatgtggatcacctgatcaaagtgggaggcccagcaagaagaggaaggagtactgtagtgaagaggaggatgagggtgaggtcaatactcaagatattgatgatccctcggctccaaagaagccgagagttgtttggtcagttgaactacaccggaaatttgtcgctgctgtcaaccagcttggaattgacagtatgttctcaccactgcctccattttgctgttcacaatttttttatggtgactcatgttacaccctaatcttttcctttttggagagagagagagagaaacggccccatcgtttggcatattggaggaaaaaactaaacgacatatttgcaaatgaaaaataatttgtgaataaaacttttatatacgtgttcttaacgatctaaaagcaaaggctaaaaaataaactacgatgaaaaaaaccccaaaatcaactccaaatttaaggttgaaaattcaatttttggctaataagcataagcataagtgaaaagatgagattataatttttttctatttatgcagaggctgtgccaaaaaggatacttgagctcatgaatgttgagaaactcacaagggaaaatgttgcaagtcacctacaggcaaggaactcatttcactatcttctatttattagcatgtactggtaatgatgtaatttgaatagaacaaatctgtaccacagctagcagctattgtaattaattgcactacaagtttttactgttcagaggaaactatagcttaagatagaccatctttcaactttactaaggccctgaagaaatattaaccgaattcagaagttcttcaataccaatgaattgtgcgctgactgttttacaatactgtattaaatatggctgatagaaagtcactgtggcatcctttatcaacacagagctattacacatttaaggcctattctaacttgagtcttgtgtactttgcccctctgcttccaagagcagattctgtaacaattaaatgagtggcctttaagttgaggaaaaggccgtacatttttcagcacttctctaaaccttctagcagatttagcaaccacatatatggtgaaccaaaaacaagttccggtgctattctgtgactcatgctgagacactaaaagcaaattgttcacagataaacactacaacttgtttgcagagtctaatctcaagctttgtgtaccacgcagaagtacaggctctatctcaaacggctaagcgctgtggcgtcgcaacaagttagcatcgttgctgctttgggaggtagagacccctttctgcacatgggtggatttgaaggactacagggttatcaagcttttacctcttccgcagctctatcatcttttactccacatggattgttaaacagtcctagaaacaatccagcagctcttggaactcagggggtacctgcttcaaaatcgattcagactatgagcggaagccatacattgagccattccattaatgatgcaaataagtaccaccttagcttaccaggaaaccagaaaggaaacttgggacaaggtttggcaacatcgcttgggcagacccaaatgcaacagaagtggatccatgaagaaaccgatgatctgtccaccatcctttctgggaatggcctatctaatggtatgtctggcacactccaaagtgtcacaagcagtcctttgctgcctcaagaactagccgagtgcacacaagccaaaattgtcagtcagccatcaattcgaacttcctctgtaagttcagaacatattgaaggcgccgttggagtttcatctggtctgcttgaatctcgtgtatcccagcagagtactattcctttatcaggattttccgccaacgggttgctaatccatggttcgtttaacaatacctgtgcaaacaaattgggtggtacatcttcatcgtgtgcacctgctcgctcttcaaatgaccttatggtagcaagagacacaaaaggtggagctagctcttttggtggcgcgatgcttttacctccagatacagagcaaaagtacttgaattttggaggtggaaacggtttgaaacagaagttcgatgataggactgcagacagtctgtttgatctcaagttcgtatggagttctgtaccgagctctcaattggcaagcaacattggggctcatcatgctatgagccaaagatggaacaatagcagtagtaacagtagcaatattggtgccagaatgattgggcaagcaacctcaagtggttcaacagttatcccacaaatgaagacagatttcctcgtttcgggagatatggcgatgccgaagaacgcctccgatttgagcatcccgaaacttcagagcgaacttagctctagcagctgcagcttcgacggccttctcaattccatagtcaaagtggtaaggattttttccttcacctaattttttttaccatgacatccatattaagattacacaaaagtgacacataccagcaaacttattgaaccattttcgctgatgataagaccatcagaagcaatagtcatcttgttgacggcgctgtttcgctatctgacactcgatttccatgcaggagaaggatgatgttaccttcagcgacgacctggggtgcggcgatttctactcccttggagcttgcatatgacagatctctcgtctgcatctgtgtacatgtccccccattgtatgctgtgtactagctagcagtgttagtttgtgatgtaatctagtctaggcctgtgtatctatgtcaatatatgtattgtagtagtaatctggaggacgagatgggttgccaactcgacctagaaagagagacattgatggcttgtataaacctgagcttactgtcagtttcttcttcctcgtcctggtttggcacagacagccgtggcgcggctggatttacattttaggacatatatttggggagcttcttggctgtgcatatatgtttggatgcagaggccggtttaatctattatctaaaataattgggagcgaaactgaagttgtagaatccggttaggtctcacgtatgagttagccttttaaaaacatgtctaaattttcatccactataattgagatacaaatttatgctatcacttcatttctttttgagtaaattttaaaaaactgcaattatagtcacaaaactaccagtttgctagaacaatagcgtgataaattatcacgaaactgtaacttctacgcatatcacgtaaaagttgtaattttgtgataattttccacgttattattacagcaaactgaaatagatcactaatgttgcagcacactacagttttatgactatagttgcagttttctgaaatttactaattttttttttaaaaaaagggattgagaagaaggtaaactttcttaaagcaagcaagcccatggattgtttgggcccatggccgccgtcgtgcgccgctcgcgccttctcgccctcctcgtcggcgcctcccgcccaaaccctagacccttctgctgctcctcctcctcctcctccgctcctccggcgactgctcgcgaggacggcgacggcggcgacctactgtcgcggtgcctcctccggatcccgaggaagagcgggcgcgccgccgcggccgccgccgtcgagagatgggctcgggagcgcggccgcgtctcgccgccggagctccgccgtgacgtcgtccggcttcgccgcgcgcgccgctacgagcaagccctggaggtgagcacactccaaacagctctacctgatgaacgaatttgaaccgagaaaaatctgatacagataggacataggagtctttttcacctttgcaacaatttgattcaaacttcttaataattccttataatgttatgctgcaaagtgaacattgtttcactctttgttatatgatttattgacacacttgcacagctcagctgaatgtttattgctgttccaatctatatcgcgcagtggcgatgcaaggggcactacctaaacggaattttattatgctgcagattttatcatggatggactcgcacaatgattttagactatcgccctcagatcatatggttagactggatttgattgcaaaagttcatggtacttctcaagctgaggagtactacagaaaactaagtactgctgcttccaagaaggccgcgtcattcccgcttctccattgctatgttacagaaagaaatgtgcagaaagctgaaaccttcatggctgagctgcagagatatggactgcctgtcgatcctcattctttcaatgaaattatgaaactatatgttgcaacgtgccagtatgagaaggtccttagtgtaatttatctgatgaaacggaacaacattccaagaaatgttctgtcctacaacatttggatgaatgcatgtgctgaggtctctggcttagcctcagtacaatcagcattcaaggagatgctgaatgatgacatggttgaggttggttggagcacatactgtacattagctaacatcttcaagaagtatggacagagcagtaaagctcttgcttgccttagaacggctgaaacaaagttgtcatcaacagggcgtttagggtactctttcattatgacatgttatgcagccctgaatgacagagatggggttattaggctgtgggaggctagtaaaattgttccaggtagaatccctgctgcaaactacatgtctgctatggtatgcttgataaaagttggcgacattggtcgggccgagtggacctttggaagctgggaagcagaaagcaagaagcacgatgtgcgggtttcaaatgttctccttggtgcttatgtgaggaatggatggatcgaaaaggctgagaggcttcatctccacatgctagagaaaggtgcgcatccgaattacaagacttgggagatactgatggagggatttgttcagagtaagcagatggataaagctgtcaatgccatgaagaagggcttatctctgttgaagacttgccactggagacctccacttgagctgttggaggccattgcaaagtatttcgaggagcaaggcagtgtggaggatgcagatagattcataaaggttcttcaaaagttcaacttgacaagcttgcccctgtacaagtcattgcttggggcatatattaatgctgacattgtgccacaaaatattcctcagatgatagcaggagatcaaatagatatggacgaagaaatggaccaattgatcatacgtgccagcaagatagacatcacgtgaaaagtaaatgggtaggctatgaacagttgctgcttatgagcacacacggcaaatataactcacccgactgtctttgtggttgcagccaaaaaacgcagaattacactaagaacctgcagattagagggtgaacagtgcactgcgctgcattacttaagatggcaactgttttgaacttttgatccaattacggtgttttgagaaaaagatcttgacggtaagccagggatgatagaacgactcctgcctgcttaagattttcattgtcaatagagacttgacaggaaaaatgttaattctttctaatgtaaacttcaggccatttctttgcatgatgtaaacttgcatattagctcgccttctgtgttccctttttggaggttaacaaatctgtactgatatttttagtgaaattgtgaggcaaactgaaaacatgttctctggatgcaataagcacttgtttctggccagccccgatttatggaatcagtattcagatctcacaaaaatgaccacaactgtttaacactacacattacaattgcataagcattacacatttgcattatccatgggaggaagcttgtgcaatgcagatggtttgatctcatccctggagatttggggaattgagataggctgctgctgccatcaatctgtgatgaagaaagttcatgcgtgcacaaggcttctcagtcttcaaattgaacccatgcacaagttggcatgacgagtaccacattttaacaccagaaatgcatcccgttaaaaaatgatacactaggaaagtattatcaggtttacctgcaaaatatgaaacattagacaatttcaatacttttgaagctttttggcacccaaacttctccagtttctaacaatccttaccttgtttcttgttagccaccattacctttattcagaatagctctccaacaatgtccgaacttaagaaggaccgattatatacatgaatttaaataaactggacaatggcaatcaaccgggattaaggtagtgtccaagttgagtcttaataaaacgagaagatgtagctaactagattcttctctaaattgggttccaacagaacctgtaaataaactcgttagtaacttaattaaatgccctagatttcatctccacatgcaacatttgaggacatgttagtgccaaaggaactaatattctagttgcaaagcaaaaaagagtggtccggtacatccagcaatgaaataatctgatgctattaaattgcagggaatgatgtaacttgtggtcaaagctcatctagttatgataagtttttcacaaagaatgtaaatggatcaatgttgtatctagaatataagttggataagtagaaattcaatccaagtgttgcaggaaggcaagggaaatagtatcagcatcactgtctcaagacatgcatatttgttactgtaacccacaacctattatggaaaaagtaaactgctagtattcatgctctgtgcatcattgtgacttaattgctggatcaagagacacatatagctagatgcgtatctaatattttgttagcaaatctgcagaatttgcatatttgcaggatttcactgtagttttactccatggagtacagaggttttgcctagtgaacattggccagaagcccagaactattcgctaggcagtaggcttactggataattgaattgatgaacaaatagtagaaaactttggctgaaaaccgtaaatgtttccaggcttccaatgtagaccagatagcattacctcagattaccaaaaactgcagcacaaagtcgaaatagagagatgcccttattctcaatattgcattgtgttattctctagaaggatacatattagagtaactaattattctgggaaattaaaataacagcatctaaaatacccatgtgaagagaggtcgcgctctgtgtattgtattgtaatgttatcaagttacatgtttgagcactttgatgtacccgcaccccactctttggaaacaaccagcttccatgctatacatatcaatgacaaaacagcaacaaaatatattcattttaccatctcctaatccttaaaggtgatttttctttcctatctaactaaaccaggtaggagaaaatgaaagcggacagaacaacttaacataaatacagttcactatttcatcgcgaataactgaagaacactaggatcacattaaacccaaatggagtgagacaaacttgacctacataacatcatcttgatcatttgtcacattttctgtcctaaatcaatccattcacaaagctaaaattcaaagaggagtaccatccatcaatgcgcactgacaacattctccgcattgagcccatacagcactccagcatatttctcggtagagccagcgaagaacgaatccttgagcttccagaacgcgcatgaagtgaccaagctatctgaaccggcctggtgggactctccgacgcgctccacgtcaaggagctcggcgagcttgttcagcccaccgtgcaggctattgcagaacttcatgaggtgcttgatgtcatacacggtggggaaatatatcttcatgagcttaaagaagccggcttgcgtgtccggtaggctgctgcatgtgaggatcttaagcaggtacccgaagtcgtagcccgcgtggaaggtgacccaatatacagaatcgttaagcacgacgccagaggacatgagcagctccgcgaaccggcgagcgtcaacgccgcgctcggagttgcggcggaagtcgatgccgctacggcgcaggagctcaatggagtcagaggcgaagatgtcgcgggcgtcgtcgaactcgcggaaattaaactgccatacgcatcggcggcggcctgggccgagcgcggggagctcgccgcgcgggctggagaaggtgaggccgagctggatgaggtggagcatgtcgacgttggccttgagcgtggcgtagttgtagtcggccggggagcggaaggcgccgacggggcggcacacgatgccagggaactccgtgtccatggcgacgaaggggaactcgtcgacgacgtcgcggatcagcgcgaactcctcctcgaggttgtccgcccacacctcccggatctccaccggctcctcgtcgtcgccgcctccgccgccgacgccgatgccccccggcttggggatgaccgccgccgtgggatccgacattggcatgcgcggattcccctcccggaatggattctcttccaggatctggccgccgcgccccggccgcctccgctgcggatttggatttgaagatttgggcgagacgaatcgaaacgaaggggaacgagagagaggagaagagaagaagcctctagatttttagagaaatggggattttttttttcttttgtttctttttgttttgagacgggaagatgtgtgggtggtagcgggtcgcgcagatgcggcgtaacctctatcacaaatcgacggggtcgatttaacgtccacaacgaatggacggccacagatcgcccctgctcgcaaaatctcaattttgaaattgtccttttcatgtgcactagaaaaaggaaaaagtacactgaaggtccctcaacttgtcatcggatataaaaacgtcctcgaaccgtaaaaacagatatacggtatctcttaattatataaaaccggtcacccgagatcattcggtggttttgatcccgattttggtctacgtgacggctgaatcagcgtgggaccccacatgtcagtgtgccatgtcaccaccctttatttcccatcttctctcccttcctcctctctctctctctctctctctctgcagaccaccggcgggtggggaggggaggaggccggcggggagctccgcgtcaagcggtcaaagggtggtgggtgctgccgcagggcgcacagcttgtcgccgtggcgcgagagcccgaaccaaaggtcgtgctccgcgacgtgctcggcgttgcccctgaacagcagcgcccactcgccctgcttgctctaggtatctcgcaccgtgtcaaaggcggacgtgcggacgccctccgtcgatatccagagacgtgagtcgccgaccaccgcggtcgccgtgatattgtaataagggtgtttcacggcggcgcctcgtcgcgttcgtagcccgggtactgcacgtagggaggctgcgggagggcgcgccagtgccagtcctcgagttggatgctgcatctggcccagccgctgctgccgacgtaggcgggcggcggctggctgtggcggccgtaggcgagcacctcgaaggtgacatggccgtctccccggggatacatctccatgacgtacaggccgccgttcttcgccgctagcgacaccagacaccgtgaaaatatgatatttttttaaaaaaatctcctttttattgcttgattcgtcattgtttatagcctgtgatcgatgattgtgaaggtttatagtctgtatgttgtgtatgtaatggtttggttgatcctgaagctttttggaggtcttgtttcagttgaggacgagcatgagagacaagaaagtggatcttcattttgtcatacaattgtgatagccatggagcatgcaagtagtagtttatggtatgagtgtacgactaaccctgaatattcattcctatactagtaaatagtagtactatatcatattggagattctgtgattggatgaataagtagtgtagccattcttcgatgccgacgatggcgttcttgctccggccgagagacatgaactccacggtgcctccattgtgagaacgcgggtagctgggataatggaaggacacggtgcgtgcccgtcgctgccgccgctgacgaggtgcaaccaggactcgataatcatcaggctgtggaagaaggtggcgacgccgtgccaggtgcccgtgtcgagcccgcgcgcccacgggcaccaccaaggccagggcggcatggcgtccggcggccagaacccgcgcccgtcgaccagccgcggcacgtagcgcctctacgtccggctcaacacgctccacttcatcctcagccacgtccacgcgctcgacaagtcgctctccttcttctcccgcggcaggtgctcgtcgtcgtcgtccgccgccaccgcccgcctcctcgcgccgtgctcccacttcgaccgcgcgcgcgccgcggcgcaatccgcggtcggacacgtcgccgaggtcgccgcgtaccgcctcatcttcctcgactcgcaccactcgttctacgatgggctctatgtcggcggtgtcgctgacgcccgcatccgcccggcgctccgcacgctgaagcagaacctgtcactgctcctctccatgctcgtcgaccgcgcgcagccggtggcggtgcgggaggtgatgaaggcctcgttccagccggcaaagctaaatgattatctgaaaccttatgcatggaagttccaaggtgaagaaaacttggatgatatctacagtgatgcactcaagaaaatcccagatctggctttacacagtagtggtgctcaagggctcatcttggctaatactttagattgcttgttgccaactaatgcaaatgtcatccaaggtgaagaatgcatgtatagccaacagaacaccgataactatggaataaagtatggaaatcaattgcctttcttgcttaatcaggtggctgaaacacatttagtggatcagattattgagcgacacacatactctctacagtatacaaaactgatagctacagttgcatggcaagtgctcaccgaattgtctatcaatcctcagtttctttctagtgggctaagattagtacatgcatcagaggagatacatgaggttatactggtggtggagtggaatacatttagtgcagtactatccagattctccatggccggtttacttgaattcaatccaagaagggacaatcatatggtggtaatgactgggatatatgcatggttgatcatgctatgcaacgcctggttatctgatgctcctacacagattggtatggttgctgtacttgagcatcaagttttacaagaggaacttcaaacatcattcgatccaggaggttttcttcatcgacttggggacaagccgaatttcaagaagaagggattgtcagggtctcggctgggctacacatgggccgctaggcaacccgttgccaagaagcccaagcaagcccaagctgaaacaatacaagggcaacagcagcttacaggagaggaggggaaatagaacagaactggcaatcggcggcttcggccacggcggcagcggcgaccaggtttgggcaggaaccttgtcgatctctctccctcactactccttcctaccagccactacacccttcctgtctccctctatagaaccttctagaagcttgtaatactcagctacttgctcaatttcacctcaaattggtttagatattgttgctatttgcttggtgcatcgggttgctaacagactccgacgactaccatggcgacgccgacgaccaccgagagaaacagggcacacaccgtcgatgcggcggtggaggaggaggaggacgccggccaccacgctcgcccgcctgccgccaccgccactccgcgcctccgctcttctccgcttcgccggccgccgcgcgctcgtaggccacctgcgtcgaccgccggtcaacccggctcgctgctgcctgttccgtgtgctactccctcacggcaaagagaagtaacaaaaggaagagaaaaaagaaaggggaagtaatgggtggtgatgtggcacgctgacatgtggggtccacgtgggtcccacaccgactcagccgccgtgtagacaaaaaccggggtcaaaaccaccaaaggatctcaggtgatcggttttatatagttaagggaccctgtatatccggttttgcggttcgaggacgtttttgtatcccgatgacaagttgagggaccttcggcgcactttttccctagaaaaatggattgatattgggccaggatataggaaatgggccgatttcccgttgttttcgccacacttaattcagtgttgtgcgtgcgttgagggaataagttcactttaagcccttcgtctttgacgtgtttgaattgtgtattggtgtacctgagatcctaggcagcggtggagggggctcgagcccccctaccctgctggactccatggaaatgtgagggaggagaggagggaaaagagggagaggaagaagaaaatggggggagagagggggctggaggaggaagaagaaggctgagccccctcctcctccaaacctagctccgccactggttctagggcagtatagtttccggttttggctcacatgacaacttgatagtggtcaacctgactgagtcagcgtggaacccacatgtcggcttcttcaccctcttgtctcttctcttgccaaccaaacctgaacatctgaggcaatgccaacatgtttccccaaaaaataaaaggacatatatttacaagagatgttattgtatcatgacgtgacgatagcgaaattcccatgtttcatacattgtctagtgtgaaaatatataaggacatgaacatattccttactccaccaaaatttagccaaaccattttaattgacttcatactctacaaacctcttacgatatggcccgaaaagccttacagacagcttgctaagagcaagttttatagtggaagtggttactacctctaattttagctatgtctagtcatgaccatgatgtttagtatcgatctgaccacactgctctgatctaattaatggtttgaatcttttttttttcgctaacgcaggtccaaatcaatttatgtgatatggaagcatgagaatacatataaatggtaaatggtagcaattacactaagtggggatgaactagataggtatagataggtatagagaatacattctaagtagtgggtgccatggatatatcatcatactcttactatatcactatctctataatgcaacaataaaatatttgtgatacctaaaattatcattggtacctcctcggtaccatggtacggtgagttaccatgattacgtggcccctatctagaggcatgatatatacgattatgtgagtttagctggaaagaaaaaaatgacacattcatggcccacttgaccgaccaatagcagttcgatgggtgacactaattgcccataattacaccaccgacaaggttagattgtagacagaacgagccttttgcacttataggtaatttggtactttcatacttgtaggcaattcaataacttggcctacattgtctaaacctataggctaaggcccataagtctttaatttgtttgcagaaaccaaaaggtcaaagttttaaaacgttagataaggtgcaagatcaaaacccagactcaacgagatgaaactctgatgtagccgacgcatcgcatatacttcctccgtttcacaatgtaagattttgtagcattgtccacattcatttagatgttaataaatttagacatatgtatgtgtttaaatttattaacatctatatgtacataggcaatgctaaaaagtgttatattgtaaaacggagggagcacatatcatgtccttagcccccgtatacatatcagactagccagcgagcaccatcctcacttcctcagcctaactgcttgggctctagcctccagcaagcccactaataaaggagctcagtgctgataattaaagaaactagatgagatgtatggtgttgtgtgccatatgtatatatgtagacataaatcccgttatttccaatacaaaacttaggttattgcaccttacaaaatacatcattagctatagtttcctgttccaccaaagtatatactccctccattccataatataaggcacaaccactttttctagatgcatgcatgcatgtcgctaagataagagtctcaaagaatgacaatatatagatacttccacaaagtttagttttacggaattgctaaagctctgtcgacagaaaatcctacctcaaatcttgcaaattttggatcactagatgtgcttcacgattcgtgcttttcttctccaactccggcgaccacctcttcttctccggcgccggcaaacccaaactccggtagagggctgacgaattagggtcccagggtggggtgggggtgggggggaaggt

SEQ ID NO: 6377 - DNA, 3041 bp, Oryza sativa
  unsure (1)..(3041): unsure at all n locations
ngctggtgcgcgttgcctcacatgttctggtgctgctccctgagaggcgcgacgaggctgacaggccacccgtttggcggtcctcaagggcccactcctgttgggaggcctcctctgcgtatgctccacagtagtgtggcggctggtgtgccgctccttgttgtatctcgtccccgcatgcatcccgtagactgggcggagcagtgtacccctctttgtctgctcatgttttcatctccccgtagtcttgtctgctcggtacgcgcttttttgtatttggctctccgcgcacgttgcgtgtctcgccaccgccccgggggaanaagggggagttcgccggctttagagggatggccgtgggaggcggcagcccggcggatcaggcgggcggcggcggcgccgctgaagccgcggggctggaggacggcggcgggggcaaagcggaaagagtggggaggaggcggccggtggtggcgccccgccgccggcgacggggaagacgacggacagctcgtcgccaccggcttgaggcaaaggagaggagagggagagggagggggccggtcgggggggcctcgcgagcgccgttgacaccattcggccagccggcgaggccgggcggcggcgcgctagggcggaggagcggcggcgcgtgatgaatcgggagagagagaggcgagaggatttttagagtttggttgcctgcatgaatcttaaagcaatcggatggttcaaaatttgcaagatttgtaaggggggttttctgtcaaacgatactgctcgatgcaatgaaattggcataccagtacgtgcaacactggaaaatgctggtggcgaggtaactgacaatctcaacttcgatccggtttaccaacggacggggaagtgttcctccttgggcttgctccaccggaaatgcgcggcgttgatccactctgggttgacgagcaacttgccgaacacctgcgcccacaccgccttgaacgtcgtcgggttcgtggcgacgacgtgggtgacctccgggccgacgtcgtcggcgcaggtggcgccgagctgctcggttctcctccacacggagtggtggtcgtcgctggcgatcgcccgggtgaacgccaccgtgcacccgagcagcacctcgcgccgcgtccgcctgatcacctccctgacgtccgcgacgaagctgccgccgccgccggcgaagaagcccgcgtggactcgccgcaggacgcgcagtgccgcggcgcgctcgctctcgtccacgccccgctccgacagggagtgcgtgcactcccacggcgacccgaagtcccggcagctcgacgcgaagtagtggtatctctccatctcgatcaggttgtcgctgttcccctcccagacctccgccgtgtcgtcgaggatgaccaccgcggcgcgctccgccgccgatgccggcgccgacccgaagacgacgtcgaggctcttcctgtctggctgcggcgactcgtccctcgatatgatccgttcgccgaagtagacgccgtcggggtcgagcagcttggcgaccgccgccgcgtagtccctgtccccgagggtgtacacacgtgcatctcgaacatggcgctcgcttctcgcaggaagccatggacgaacggcctgagcttggtgatgaacgccgagaaccagctggcatgatccaatatgaacaggcccctccccggatcatctgtgacgagctccgccaacccgttgacgtactccgtgccggagatatcgtaatccgcggtggagttgacgagcgtgtggtccaagtccacgacgaggatcagcttcctcgcccgcaggaggctcgccaggtggccgctcgtcggctccggcgggagcacgatcgagtcggtgctggtggcgccatgggaaacggcggcggcggcgtcgtctgctccgctccctcctcccgaatcttccgcgtcgagatctccctcctttcccccggcgattccaccagggttaggagcggcccctgcactggcgtcgtcctccacctctccccccagatccatcccaccagtgggcggcggcggaggggtccattccggcgagcgaggctgccggagaggttggcgatcggcgccgcaacgggaagtgtgcggtggaagggaagggagcgggtggtgcccggaggaaatgaattgaaatggggggaaatgaaattgggcgcggccgtgccaatttgttcccacccgcggggggaaggaggatgggcccgtaaaatgccaccgcatggcccacgcagcccagttattctcggccttcctgctttgcttgctgctcgtgagtcgtgacatttcccttaggaaaaagtacaccgaaggtccctcaacttgttttttttgttataaactcctcccccaaccggaatggcggatattcagcgtcccttaactaatcaaaaccggtcacaataggtccttcgggggtttttacaccggttttatcctacttggcggttttatcatcgcgatgcccacgtttcaggattgccacgtcacctcttctcccttctctctatctatctcactcttggcttctctttcctttttttccattcttctttcttttagacaaggctcgttgttctctccccacttcgtcacgcctatctcaccttttgcacgctttctaattctggggccgtctttgtcacaattcgtgtactataaatttcttatagcgttattccactaatatgtgccggtcttttatatgcgctgttgttactacttacgccctctacctctttcttagggggcctattatttacttcatctcgctcttcttttcatgggcgcgctttctgatacttgtgtgctcgctacttatattctatggcgccatcatatattattgtgcgcgctttttaaatcagtgctgcgctttatacaataacttctggactcgcttaacttagtgcgggcgcgttataataacacgtcggcgtcttcttttttaaatgttgcggtcctcttttttaacgggccgtagctctttttcataattaaggccca

SEQ ID NO: 6378 - DNA, 3667 bp, Oryza sativa
  unsure (1)..(3667): unsure at all n locations
cggcgcttttgattgacagatcgacagnagcncatcacataggattaaactggtgtgaaaaccaccgaatgacctattgtgaccggttttgtaagttgagggatgtcatatatctggttttgcggttgagggacgattctgtaactcgatgacaagttgagggaccttcggtgtactttttcctttcccttcgatcctgatcacttcacttgaacaaccgattcaatggcttggatgtgtgctcttaggtgttgcactacttctagcaacttttaaaagatttttgttttttttcccaaaatttaaattcgaacacatttagcaaaccggtaatcctttctgtactccacggtaagcgcacgataaccagacacttcccaagacaaagatggttgcattgaagagagagaacgcaagactttctgctaaaaagagatcggcgatcgagtcgatcgacgcccaaccgaaaaatgcgggcaaagaaacatatggcgtcgctatatatgatcagaatctgcgtatatcgaagaatacaagagatggtttacgctgatctagagttctaacctttacctcgttcgctatcatctttggtcagtagtactgtattggttcatttccagatcgatttcctacagaatacagtgcacccaacgaatcaaaatcaacatcgctgcacgaccattgccagaccaagattggcagcctcaacttcgatccgaagcatatcgatctcgacggcatcatgaacgccattccagtgcaccgccgcccgtcgccgccgccgccattccaatgtcctcaatgctcgcctttcacggggtacattctctcctccggcttgctccaccggaaatgcgcggcgttgatccactccgtgtcaacgagaaacttgccgtgggtctgcgcccacagcgccttgcgggtgaccggtttcccggcgacgaagtgggtgaccccctcgccgacgtcgtcggcgcaggtggcgccgagctgctcggctctcctccacacggggtggtcgctggcgcggccgccgtcgccgcttgggatgaccccggtgaacgccaccgtgcacccgcgcagcacctcgcgccgcgcctgcctgatcacctccctgacgtccgcgaagctgccgctgcacaccgagccggagaagaattccccatggactcgccgcaggacgcgcagcgccacggcgagcgcgccctcgcgctcgctctcgtcccggttccgctccgccagggacctcaccgcgatcccgaacttgccgcggctcgacgcgaagtagaggtacctctccatctcgatcaggttgtccctgtaccccttccagacctccgccgtgtcgtcgaggatgaccaccgcggctcgctccatctccggcgcccacccgaagacgtcgccgaggctcttcctgtccggctgcgacgactcgccgctcgatatgatccgttcgccgaagtaggcgccgtcggggtcgagcagcttggcgaccgccgtggcgtagttcctgttcccgagggtgtacacgtgcatctcgaacatggcgctcgcttctcgcaggaattcatggacgaacggcctgagcttggtgatcatccggaagagccccattcggaacaggcccctgctccgatcatctccggtgcgctccgtgaacccgttggctttctcgtcgtcggagaggtgggcgaatctggtggagttgatgagcgtgtggtccaagtccacgacgaggatcagcttcctcgcgcggaggaggctcgccaggttggcgctcgtcggctccggcggaagcaggatcgagtcgttgctgatggtgtcaagggaaacagcggaggccgcgtcgtcttcgtcggcgttggcgcctgctccgctccctcctcccgaatcctccgcgtcatcgtcgtcttcctcttccccgcgccaagcgagtagccgaccggtgacgccccttgtactggcgccgttgtcctcctctccacgcggctccatcccacccgtggtggcgtggtagtcgtcgtcgtcgtcggcggcggcggcggcggcggaggggtccatcccggagagcgaggcggcggagaagaggtgggggatccgcaccgcaacgggaaagcttgcggtggaagggaagggtgcgggtggaccccgggggaaatggaatgggccaccgcacgggcagacgcggcctatttattctcggcctgtctactttgcctgaggcccacgaaaacgtggcctgcttggtttgcttgcggcccacgagaagatggcccgttgtcttccccgcgctgcggcggcctccgcgaattcatcacactactccacgccctaattcgccgccgccgcttactcacctcctcgcctgtcgcctctcggtgcgagttctactcaccggcgccggcgacggcgacgaccctggttggcggttgaatcgtcgtcctcggcgtgtgatggtggtggccatggcgacgaaggaggaggagggtgggccgtcgagccgcgtgcctcaccttccgtggatgcggaaccccgtcgacatcgactccttctccggctgccccgtcgcgcaccttccccgtctcgatcccaggtgagctcccccccccctccacacccccctctttttgtatactttcgatcacttgaataagcgattcgctagcttggacgcgagctcctaggcgtcgtggcactgtgaaagttttatgcatggaatgaacttagctgtcgataactatgcggtgaggatgctaattagtttgcatcctcgtggggtatgaactatcaagtaggtttttcctttttttttttttggtcacggttgatttgtaattctgggattaggcgatttgtgtgtgaccataagatgttactccaactggacatcaatggcgttgtgtaatttcactaagctaatagtgttcagctggtgtccgagtattcagagttggaatttgtacaagttcggttagctctaaaacacacatatgcacccatgacccatcttgtttggttctaagagagtttgtaatttcagttgttttgcttgcgaatctcctttattccctcgctattcttgaatgcgttttcagtgcagttaattttgttgaggtacttagaaaggatgcttttaatacttcatgctgttaagaaatactaacatgtttactcctgtgttggctatgttttactgctttaggttggtgaagccattgcagagaatggggatagaatcattttttccagttcaagtagcagcatggctggaaactattggtcctggtgcttttgagagggatatctgtattaactccccaactggatctggcaagactcttgcttatgctttgcctatcgttcaaatgctcgctactcgaaaagtaaggtgcttgcgtgctttggttgtgctacctacaagggatttagcattgcaggtttgtgctgctccttttaccttttacatgctagtttaaccagaacagctagtcaacaagtctatttcatgtgcttcaggttatggtgaacaatactgatgctccatgaattctttgctcaatttcaaggttaaagaggttttttgtagcttttgcttccaagtgcgggcttggcaagtcggcctccctggtcggtcaatcattaaatgccggttggagcctccaat

SEQ ID NO: 6379 - DNA, 7424 bp, Oryza sativa
  unsure (1)..(7424): unsure at all n locations
ttcgggttatgtttgaccattcctgatgttccctgaattcttttgttccatttcggtttaaagaggtttttgatgctattgctcctgttgtgggcttgtcagtaggctcagcagttggtcaatcatcaatagcggatgaagtttcaaatcttattgagaagtctaaacaagggcttttcccaagtcttgatgaagaatatatccaaatggaaccacagactaaagttgatatattggtggcaactcctggaagactgatggatcatatcagcatgacaaaaggtttcagcctggagcatcttcaatacctggtaggttgatgggaacaatctatgtgtcctcttgagttatattccacccccttaatcttccccgcttgcttacttttcctaagattacttgtttgttcttttgttcaatcagcaatagcaagaacatgattattccaggacagcttggaataaggaaaatagtttattaatatattttaccttatgttggtttcacataattattggattgaccagaccagcagtttatgcttggatatgcactttgattttagcactaagagtcttcttttccatctttttagtgcctttaatttctacttaatatattgacatttcaggttgttgatgagacggacaggatgttgagagaagcttatcagtcttggttgccaacagttatccagcttactcgctcgagtgatcaaaaccattcctggtcagacatgaacggagaaactctactgcatccattgactaccattagacgatcgttagtcccacactacctaattacattgtcatattttagtattttacactccccttttagtaaagttcacatattacttgtaatacttatgcgttatgattcagcccttcctgctattgtagctctgaggattgtttgttgatctgtacttcaattcaaaacttgattaatctatgctatggcatataggggtgttgagcgtggttttaaaggtaaatcctttccaagattggcgaagatagttttgtctgccacactgactcaagatcctagcaagctttctcaacttgagttgcaacatcccttgctgttgaatagtggaaagaagcgctacagaattccaacaaagcttcagtcctacaagctggtttgtcctcatctctatgtagcacatttttagccgttacatctttagtgctggtgcatccaatgtgtaaaagtctatttggaaattctgtattttcttgttcatcttgatgatgcgttgcacctgcaggtctgtaaatcaaatttaaaaccactatctctgattgttcttctccaagagctgcgtggggaaaaatgtttagtttttacttcatctgtggaatccagtcacagactgagcaccttgctggaatttttcgaagacttgcccttcaaatttagtgaatattcacgtttgcaacgtgaatcgactcggaggtaagttcagtttcatggagctgttagcaaatagacaacataaaaatagtatgcaaatatcatatctagctgaccattccttgttcaagttctatggatcataatattttctggatcatgtggatttgaagtttgaactgcaagacctatgtaacttctgttgatgataggatgtaatttttggtatgttgaacttattcacaccatgataagttacgggattagcaacacatattttttgcaggaagacactggatgccttcaaggaagggaagatagatgttctgattggtacagatagaatggctcgaggaattcatattgatggcttaagatatgttatcaattatgacatgccaccgtatgtaaaaacatacatccaccgagcaggtcgtactgctcgggcgggagagtctggttcttgcttcacatttttaaggaaacatgaggtaatacattgctgaacaattataagtagttttccgttcttctagtacaataatatacagtgagttgattttattaatatgacatggtaattacatgatatgactatatgtgtaggaagcttgcacatgaaagattaatcgcatgcctgtatttgtgatgtttaaaaacatagaaaagaagttgagtatttattgacttggtatatgttagattgacgctaattgatatggtgtagaaaacagaaggggcaccaccgattacctagcactgggactttctgttttggtttaggacttaccaatgcataaaacacctgatgcttattttttattgcaacatatgtccagatgtgtggataactatggtctgtgtaacctttctactttatttcactaaaagaatgcctaattgaatactgagagcaggtgccataagtctaaaatctcattctaactcttttctttttatttgggctgtctttgcaggttaaggcttttgacaaaatgctcaagaaggcagataattctagctgcagtcttcattcactaccagaggaatcggtagaaacccttcgcccagttttttcctctggtaaggttgcagtctgttttgtttaagatgcactaatgcattattactcatatgatttgtgttaaatttaatctttttttttctgactgggtgatcaaagctctaaagaaattggaagagtctcttgaatcagaagcaacaaagaaatctaagtcgggagataaagcgcctaatgcttctaaaagaaagagaaccatcaatacgtgaagcagtatagattagttgaagttctaatttattctttgtatgatgtatctgcatctgctacatagatttggtgagttctactttctcagatggcatgaagtttcttctttttatttactgttttgtctgctatagcttcatccaccagccctattaatttgataacatcatccaacatcagttagaaaggaaggggtaaaactgtcaggactctggtgttcattgagtaccagtaaaaatgggctagagtagagtttggagttaaacatgacatatcaccagagctcattgagttcttataatatggagatatgctagatttgaacatgataagtgatgaacattaaaccatgtggttcaaagcgggttgggtctatccatttatcgtttaaagtatggagggcgaaacacccacttgatcatgatttatcccttgtttgatttataatgctgcctttccagtgattccaatgctgtctcctttaggtgattctcgcctatgataattctgcaacaggctcagcatttaatcatggatgtccaaaacaagagggatggtttgatgtgtcatgtaatccatttgccgtgcaatccccaagcagctttccccatccctgcaacctgctgcttatttttggtgcacggtacagtagttctcttctgcttttacaccagggaaggaattcttctttccttctgtagttataatacatccactgcttttcatggctaggaaggaatctaccccaaagtaaagttgggtacgttcacatcaatgtatcgtcgctgttaacctttttgttaggctttacacttgaaatatctattactattacagtctctgttagtaatgcggtttgttactccattttctagtgcctttgagattccaaatttcaggcagaaggttgagaatcccttggcctttgtttcggttcattttcctttttgcaacagttgtgcggcttcatctgtctcgcattaaaattttttcatcatcttgtgtccagtcttgtattttggttttctctagagcaattctagactatttttcattgtattaactcatccatcagagttgtcactgcgatatttttgtttagagcacgaccaaagatgcccttcatttacttcaccaacgtgggtgcatctcccgtccgaatccttgaatctattcatcatatcattccttctggatttgtttacttgaagccagcccatcgcgacgtgcgagttgaaagcaacgaaggaatattgcagtttggagtagtagcatagctagcatgtatgaacatatcaccttgccctcttcatatcattcaactttgttgcctcctgcatcgcaatcattggtgcttcgtcgtaaggggaaacctaactgttccagctcaagtgttagatatataatttcttatacacattctgtaggtaattttcaggaacaggtacagcctgttgtttctgcatctaatcttctatatgtctgatggtccggaaagcgcctggattgcatcagcgtgaaggagactttacagcttaagctgctgttagagagcagagcatatcctatccctgattcacgcacaaacttcaactccaacgacaaacctttgcacttgatgcctgttccaggctacgaagtactctgatattttttttgaatcagaatatgatcagggtcccttctggaccaataatttcgattcctccttacctctacagtcttcattcagcaggagaaacgacagctccacgacaaatttaacagaaaagaatactgctagagattatattagagagcagctcaaagctcaattgctcaaaaggagaggaggaaagatatcagaaaagctactataccatatcaacaagaaaagctggaactaaagctcgcatgcttaacatcatttttcttataaacaaaacaaaagagagagagagagaggcaaagaaaagagcatcgccatttcacaattccacccctagaattagaagacatatcctgatcactcaactttcccatggacactgtccaacctcactgtttacctccggcgtcgtcacatccggtggcggtgccattcaccaatggtggtgatgtaccattaccaccttcatgtagggaccctccagcgcctcccccagtgcgggggaggagcgacgaggaggtggcggaggagatggccgttgcgagagagatcggcatcaggcatagccccttcccctgcaggtactgcatggcggagcccatgtcctcctccatcagcttcgccacctgctgctccgtcacccgcagtgtgccgccaccattgttgtcgccgttgctgctgccattggccgcctcgccgttcccgctgctgctggtggcattgccattcccattactctgcaaaaaaacacacctaaaatttgagcaaatgactcgagattgtaaaatctctgtgccatttcttcaacagagaggtgatgtggaattgatgggcgtttttgtcacatttgaggtagttgaccttatggtagctcggctgctagtgtgtgttcagacttaaggggtttgaattgtccttagtgggttagtagcttctacaggctaatactattatgcttgattttttttttcagtagtactaccttgtcacttttcaggcgtgtttgtcctttttggatccaattcttgaactaccaagattccttccgaccttatctttttgttgcgttggtacccactaaggtttgatcagtttcttaagcaaatttatggcacatctccttttgatttatgctattttgcaagcatgcatttgtttttagtaactcgtctgacttctagtcctccaaatgccaaagttagaatcactgataagatttaacatgcttatattccattatatgaacttcttgacagatctactttagacaagagataaccatttgctcgtttataaaaataaagaaagttaaatgcatcagaatcaatacactaactttaaagaggacagataatgactacctattatcaccaacctgatggtaaaaaagataacactttccctagtcactttgtgctgtaataaacatcattatagcattttgggctaaacatgtttgtcctacacatatcagcaagtcctcgcctagtaccattaaccattgattgcgtcattggtagtgctctagattttcaaaataaagcatcatataatataagtacctctgatgacatgttagccactagaggcgcgactgcagaagctccccccaatctgctcatgctgagaacctgcgcgatttgagacattcaagggactaacttattagcaacaggcaggaattcatctatctgtagaaaagcagggttagattaccttgacttggagctggaggaacttcacataatcaatgatctcgtcgagcatcgatgccttgtcggtctgcaaaacgaaattccacatcgtcatttcagtgacagtgatccgtgtcactctactttgtgctggagcaaccctatcagctaagatatgaagatggatgtcagtttttattccaaatcccatcagatcagcacccattatcgcttcagatactacaaaacagattacagtttgtgcaaaacaagatatcagacgtgacgctggaagctccagaagtgccaaccatggcatgtagctgtgggacttgtagtgctctctatccagttcatggagaacagacgaggctggaacattagacaagtgcccgtgtctcctgttcttgtgttttgcagccgtcacatagtccaagtataaatgcatgtctcgaagttaagacatgtgcatatattatataacacctagtactaatccattcctttcttgatgttcagttctctaggaacctggtggctaatgcaatgatcaagtccatagtttaatctgcattcccctaaatttgagctgtggctattcatctgttactgttggtggcctaacgggtagaaacatttctcattcatttcggcatcatgtctgacctccctttccccactactgccttcaccatcaattagcatctaatcaccaacccaaatcatccaacgaaagcccgacacgtgtcattcaccaccgttagcagctaatcaccaacccaaatactccaatgaaaggccaacatgtgtcagtgtaagcatcagaacatcaaatcagcaatgcatcatatgcctcatgtcccctctttcctaccctatgatgcacttactattttccaatcatacagtgaagaatgaagatatcacatcatgttaattgtaagagaaacagaacatatgtgttaatactgcaataaatcaacacacttagctggtcactaagttttaagataagatatttacacacacaaaaaaaaaagcagaaagcatgggtgcatcttcatcgcatttcaaggaaagcttcctactttgttcaaagatggcgcaaagaagtaaaacaaagcaaaagaagaggagcaaaagtgaggaaaattttcagctaccttgttggcatttgggaccagctcctgcaacgccttcatcctctcagctatcctctccctccggagctgcaaatcaaacacatgcaaagtctcaggaaatcacaagaacacaacaagttccatctcatttcaagctcttcttactaccgaaaccaccatttgatgagctnctgtaccatctgatagtcaatcaatgcgcagtc

SEQ ID NO: 6380 - DNA, 4081 bp, Oryza sativa
  unsure (1)..(4081): unsure at all n locations
ctgcccttgaattcattgccgagcagttatcagcaaaataaggaaacaatccagattcctgagttgtttccaaccttggtaaagaagcagaatgaattggggggagaagttgaaccgcttcttggccgcgtacctgcccgaacggcggcggctgcatggcggcggcgccatgcattccggcggccccgaacccattgtacagcgcatggtcacctctctgcgaagaagagaacccaaagaaacaccatatatagctcaagtaaaccgaagcttcaattcacccttcaagttgtaatcgttgagctatatagcaagcgatagaaatatagaatcgtacagcgccattgggggacttgaaggcggcgtcgatgtcgtcctgcgaccggtcagcgaacagcgacaggggaaggaacccggcagcgccgccgctgtcatcgccggcggcgaggccgtgatgacggtggaggtcgctgagttggagcatgatgggcttgtcgcctccaccgtcgatctggtgctggcggaggcgggaggcgaggagcgcggagtcgtcgaacgccgcggcggagtggtcatcggaggctcctcctcctcctcctacggcgccggccgtgaggtcccaggcgggcttgccggagccgagctcggaccacaccgccggcagcgtggacagcatctggtcgaagaagtcgtcctgcccgccgccgccgccgccgccgccgccgcgcatttggcgggcgttgggttgcatgggtgagcgtgttggagagggagggagggagggaggagagtgaggaaaggtgttggaaggttgggtttaaaaaggaagaaagaaagctttgtagtggtgtgggcttttataaatctcacttaacaagtctcatctatctatctactcaggggaagttttatagtcgatttgaatgccacatctaatttaaaccatatcatcttcttattaattaataggtactaagaccattcctaactcaatgactaggattgtgtcaatagcattaaataagttgccacctagtataaaaaatgatgtgtcaagtgattaaatgaggaaagagaaggaaaccatgttttgtatgagacatagtttctacacaacatccaagacattatgtgagataggtggcattaaatttaagtatggaatagtggtgtttgcattggaatagtagtgtctagtactattatttttttatgatgtggagtttatgaaaactatgtctagtgtcttgggttgggaatggcctaaggcaattttcaactcaatgactagaatagtgtctatatcagtagggcatccacaatgtagtctaaaactagtccataagcaataaaatattccattcagccacctaacaacattatggaaccagtccatagcaagaaaatagtaaaagccaactataagcatatgggttgcccatataaaataaaacatgttatttctctctatttcctctcccctcttaatactagttgctatctatatacattgtgaagataacaatagttatagtccatatgtgtgggtcccatctatatggactacttttgctatatacattgttgttgcccttaaataagctgtcacctagtatgaaaaatgatgtgacatgtgaataaatgagaaaagagaatgaaaccatgttttgcatgagacatggtttctacacaatatttaagacatcatgtgagataagtaacattaaattattaagaggatcggaagagaagaaggtgatcatcagcaatcttgctataaaccttgttggattacaacaacacctaatccgaccttaaaatggaagggaatgtgggtagctagatgacatgtcgggttcttagctcttccttttccttaggaggaagagtcctcttcccagggaaaacgcgggatggcattttctttctgagtttaacggcgggcccaacccaagttaagagttcagccggcccatgtacgcttggattagcccctgaagtactcaactagtcaaccttgtttaaccctcatccgacgcgtcttccacccactgccaatttcccaaagctttgctaggcgtaactgaatttggaccaagattaggtgtttgacacaagcacaagtagagaaaagtcggttgtttttccagacacatatgcttctcgaactgttagacagtacctttaaaaaaaattatgagaaaggtgttttaacaccaatctttccttttcaagttttgaaataatttatactcaattaattatgcgataatgacccacctcgctctacatatcttctcaacatttcttctcatttttcccttctctcaaacgcactaaataatactttctccgtttcacaatgtaagacatttcagcattgtctacattcatatagatgttaatgaatctagacatatatatgtctctagatccattaactttgagtaaattgcactcatggtacaacaagttgacaggtgggtgcgatttagtacaagaacttgagaatgtgacgtctaagtgcaataacttggtaggtgggtgcgctttaatacaagaatttgataatttagtattttggtgcaataacttggctagatatgctattttggttaatgagtgctatgaaagttcacgatgttaatatgtcatcacatagcattcccgtagatataatcttatataatatgtaagaatatattgctcacctaatttgcaccatcgatttagatatttttttcaccatctcaattaccaactagaaaatttctgcatggtaaaatttgtttgcccttgaattactagaatgacaaaaaaaaaatgcttgtacaaatctacataagtataaccttgagtaggatttaagcacgggtttcgaaccgtctacttttccttatccttatgggaatttaagagagagatcactccactgagtaaccgaaagagaagattcaggcaagtattatcaacagagtacgtaaaagctgagtacatatagccaaaaatactcaaaataattaagtttttacaccacttctcaagttattgtaccaaaatcatacccacatttcaagtagttgtacccataagctcatttattaagtttttgtactaggttgcacccacttggtaagttgttgtcctagcatgctcatttctcaagttcctatactaaattacaccaacttactaagttgatgtaccgtgaatgcaatttactctttaacttttatatgtatatgagcaaaactagaaagtcttaccatatgaaacatgtggagtatataggacttgcatcgggcaaaacgagaattcaagcccatgcatcaacctttttctaagcgatattttgaatcattccaaaaattattttgcatagtttaaattgcctttgctctcttgacattaataactactacttccaattccgaagaatttaaattaagaaaaatcaatccgtggtagcatggtaggacaaggatacaaacaatggtgtgggcggtactatagtaccactgacctgccatgccactacgagtggtggtactggtgtagcaaaatcacaccatgatattacaccaccgtggtaaaattgttataccttgctagtgaaaatagcgtagccaaaaggatacaaatctgaaaataagttctcaaagaatttatattgagagtaaagtccatcaccggtcactaaaattgtatcgttgtgtcatcccggtccataaactcgcaaatcgaccgttcaggtcttcaaacttgttcgactgtatcatcccggtccctaaacttgtagatcactcatttaggtcctccaacttgttaagttgtgtcacccccgtccctaaacttactcatgtgaactctaatgaagacaaactttatatcaaatttgtagccctcgacgcgatctacaactttgtagttgatttttttttattttaagtcatttttttgtcccaaaatgtaattttaaaattaaaatatcaaaatctataaacatgcaacaatattttggtgatgagctacttgcagtagnggtnggntcaaatccgagngggnatcaatctgcccatcg

SEQ ID NO: 6381 - DNA, 7399 bp, Oryza sativa
ctaaagaggctaatttttatttataaaaaggaacccattttgataacaattgaattggattatggacaattagaccttaaataaaaatatttcggacaatttaagtctaaaatttatttatttagacggaggtaaaacctataaagggaattaaagtgtatccccaaattttaaaatattctattttaaaaaacactacttctttgtgtaaccgattttgtccaggcaataaattttcttcgttggtaggactattaaattcatccgtatatggcagaagtgaattaggggtaaaaattgatcacgtcagtccctaataggacccctgttcaataaaaaaatcaagtacctatgtgagaggtaatggttcacaggaatgaaacatcagtggttacaatcttaacagagataacgaaatgatttggcttcgaaatgtataagtgggatcccagcaaaggcaagattattagtatgtagctgggcataaaacgtaatgcacatttcatataaagtttgttttcattagagttcacatgaaagagttatcaattaattttttatgtaaagtttttagaccgtcctgttaagggaccggggtgacacaactgaacaagttggaggacctaaatgagtgatctgcaagtttaaggaccggatgacacagtcgaacaagtttgaggatttgaacgatcgatttgcaagtttagggaccgaaatgacacaacggtacaagtttagggactggtgatggactttactcttatatttaaaaggttcatttttttttaaaaaaaatcattccaaataacgcatgtcactttagagtgcttacttgacacttgtcttctgctttttccctttatgtccttcttattggctattacattggctatagataatttggagctagtagtgggctatactatcaaacttgctctgaatgttgtcaatgtaatagccaattcatacaatagttgtttactatactattatacctggtcctacctttcatacacacattatgtcttggagtccatgctgcagctggctacagctctgtagcctgctgctcttctctcttcttttatctctttaaaatatgtttatagctggcttatagcctgctattgtacctgctctcaataaatgagtgctatcagtctaatacctaaaggaagtatcgatcctacttgtgcaattaataggatagttttctatgtaattaaatatattatatattttgcattaattgcaaaatattacctattaaataccaacatcggattcctacaaacatatataaatacagtggtctacactataaaattgaccattcaagatttatgcaatgaaaagaaataacgttttccaagttaccctcttgtcatattttgttctaactataagaggaaaagagctcaaatacataaacaatggagaaaactctagtcaaatcctcgtaggccaacaagttaatagggctattcaggtatgagcaagaatacttttctttgggctatatttggctttattgtttgatggctaacatatatatgaattataaaagtaggcagaagatggagacatatgtgattgtattgatgtgaatctacaaccagcatgtaaacatccgatgtaagccactttcttaaagagatggctttcttacatatggtggctaaatttaattcgtatccgtatccgaattattcgtattcgtatccgcatctaaactatccgagaattatccgatccaaaagatatccgtatccgtttttattcggagcggacggaaactatccgctccgttttcattaggggtgcccccaatcaaggaaattgccacccctacagcaccaatccgttcacaatgaggagcgagcgcatagtagtgccttccgctatgggtcatgttagatggttcgggtgtttttcttttttttttctcttgcccatttcagctaacacgtattgcatttatatggagtacatgcctacatgcttatgacatgacgtcgttatttagggagccatcgacgatgacctcaagcccattgccgccgctgccgtcatcacactcacggtggttcacgctcgcaacctcaccagttgccgccggtgttcatccaggccttccgccagcattctcctgatagccgctggtgatgtccaccacattatctactccattcgattctaagaaatcacttatttattttaaatttcttactcttattcagatatgctctatttgccctaaaatataagaacctttagtatttaaattttgtcctacttatggagcaatactcccttcaccaaccatcccttattttatttttactcaatcttacctccaaacaccatctcttattatcttctccccaaccaccactcatttaataagagatatcatagtttttttctttattcttaatctctaaaaggaacatagtagtcgttaaacttttggacagatggagaaggtattcatagaattcaagacatttgtctctttgttcacttaatgatattgatcttatcaataaatgaggtattggttttaatgtgtgtacaacaacaaggtcacttaaacatttataacaaagagagggatgcagtgatacctgtgcaattatgagatggtctttactctatatatcttgtgtagttaatactatgatttttcttgtgtaattaaatgcattttatatctgccattaattccaatatagtatctcttaagtgaaaactagcggaacctctaaacctatatatacaatggtctaatgctatgaaatagaccactcaagattaccaaaatgaaagcaaacaatgtttttcaagtgactctcctcttgtcatatcttcttctaactattggaggaaaagagctcaaatctataaacagtagagaaaaagctaatgaaagcctcacaagtccacaagttaatatcactattcaggtatgagaaataattctttttctttctttctttctttctgagtttgggggggggggggggaggggttgtatatttggcatccttgatgacaaacaagaggaaatatcaagagtaaattatattggtgatatacaaacttatcaggtatgtgcaatttactacatgaacttgtaaaatacttgttttggtgtatgaacttgttggatgggtgcaaactaagaccaaaaggacatgtcatggccaattctatcaagttagatgctggttaggataggacgtgcacacgtgaggtgagcatgaaacatactatatttgtaaacttggtttatactttattattctttgttctaccccttgtatcatttctcggtttttttatatcattctccgtgcaatcgttataggccttattaaaccattttagtgaaaatatgcatgtttatgtagcattcttctcaagtacatatttatgtagcattctaatcaatacttaaattagcaagaatagtcttgttatgttcttttggccttcgttcgcacgcacctagttcatttaccaaaatgaatgttttacgagttcatgcactagattacacccacctaacaaattcatatacagctaatacgatttactcaaaaatcaaagtaggcacaagatggagacatatatgattgtgttgatgtgaatctacagacaacatttaaacatccggtgttcaaagaccataaaattcaggtaagccactttcataaacatgagatttgctttcatatggtgggtcaatttattttttttaagtttaaatgcaaaaaacaatatttttaggttctttcatattcatgattatatgatacatactgcgtaggctgaaaactgtaggcaaactcatcatagcaaaattctttctattggtttgtattcatggtaggccatagcttgcttctagattgttctaagaatcaacctttatgcactccctacactttttgccttaacataaaaaaggaaaattatgacttcttttttgtatatatggcccataatatatacacgcagaaactgcactttggaatcattggagcactttgttaggtagatatctatttaagtagtcgtgcgttgcgaatcatttattatatggtgataaagttttacatgtcaaatagatggaaccaagctcttttccagtagggttggatattaaatcgccattagaaggtgcagtcttgcaagcacatctgtctaccttcgactgtcctataggaacaattccgatactgcacaacaacaacatggacaacacaattctacaacgaattggcgagttggctagcaatgagtcacgaatgctggtaagtttttttagttaaatgcttgaactatatactaacgaaaggctgactgtgacaatatagacttttgtatggaactgtcccatgaattgcatatggcatttaacagcacaactagtgtccctgttcataacctaattacaacgtatgatcattttcaaatcaatctttcagtgctgacatcaaaattctcggcgagagatatagtaagacaagatatgcgcaatgttcccactgtaagaacaattataaataaaacaagacattcagagagatccccccccccaaaaaaaactctctcaattttaagaaataagtaactagttttaaatttgaaactttgatggttttttaacaagatattcgatcaaatgaataatatttcaataatactaaagggatttgaaatcagtttattgtacccaattactaatacttcttgggaaggtttatccacgttggtgctagtcgatagcactaagtgaatgaaatttctatgtaataactcattagaattatatatatgtatttatgatgtgtgaaatctgtctagtagcattgaaacatgcataaattggaagataatatccaacacgggaatgactacaaacccaggccccacattgtcttacttgcactggatatgccgatggaacattcaacttgatcatttggtctttgcaattattgttatttttatttgcaagaataaatgattatttttgcttgtagggggccggaattgaatactgggatgaggtatacggaatacggggatcaatatatgtctacgacccaaaggtgaagaaagatagtcaggaccttactgcatcatggatacaaattagtaacttgccaaaagctgcggttggagttgggataggtgttgggtcttgtgtgtctccaagccttagtggtgataactttgctaggttccatatattctgggtaaggcatatgatgggccagaaagaatctatgatggaccatgtaaattagccaactcagatattataaatataattcgttttgattccttattgaccctggaataaatatttatgacaggataatgaagaactgaaaaaaggctgcgttgatcacaattgtcctggtttcgtgtaagttagtcgcaatgttggtcttggaggaagaatccatcccatctctatctataatggaccacaatatgtaataaatgttcttatttttaaggtgttattatattcttaaattttgtatgattggttatataggttctatgtctaatcgtgcaatttatgtaatttattattgctattttttttgtttttcaaaaactaagcaactcatagtttttatagcaatccccttccctatcatctcctagccaaatattttatcttagtgcatgtaaagaaaattaatttattaaaaactaagcaactcatagtttttatagcaattcccttccctatcatctcctagccaaatattttatcttagtgcatgtaaagaaaattaatttattaaaaaggaactttgatgttatagtttcattaaaataagataaattacataattgcatacccagattgagaattgtaacataatgcatgcccagattgagaattgtacgatatttgtgctcgatcaacatggaaactcaggtttgactatatatgtagacttgatatatcaataataagtcgagtaagaacaatctaagctatattaatttccttttgaaattagtatgatccaatgccccgcataaataaaactagtccaaactagttcaaatcaagtcgaattaattacagttttttagtttgattacgcaaacatatcaatattcaatgccaaatattactttagaatttgcattaagtatttgttgtctaatcttgacatgttttaggatccaaagactgaaaactggtggttggcatatggttcaaacaatacaccaatcggatactgaccaagttcacaattctcttacctcaaagccaaagggtgtattatgcattttggggtggatatgttcaaggtccgatagctgtttcagaccctccacaaatgggaagtggccatttcgcttctgaaggatttggcaaaacatcttttattaggaatattcaagttattgaagccaagaataacaagctggttactccaaacattcgtgattctgatcctttttctagtgatccaaaattattcagctatgatggttatggacttaatgataatggtatgcatgtatactatggtggcccaggcaagtatagctaaatggtgttatgtgctttgcaaactgtaacaacataatcttttgtgttggaaataatgggattaaaggttacatacatggcatgacaacacaatgcatgcatcctcttgtttcttcaataatcatgatttcttgtaatagttaaaatgaagagatgctcattgtcccaaagaagcaaatggaacttaataacacatagctagcatattccttctgccattgatgtgttgttggcagaggtaggagtatgataactgtagaggaggctcctccaactgtctaaccggtagctcccattttccatgaccaagaagctggcttgtcggagccaagcttgggagcatccataacgcagggttgtaggaaacccatataagtttgttggttgttgtagaacttcaagacgactttcccctattttcttcgcttaatgctaccaatcttatcaataaatgaggtcttgtttttaacatgtttaggcaggaaggtcatttatacatttatataatactaattaggtggaagtagtcatgcctgtgcaaatatgagatggctcttactctaccatatcttgtgcaattaatactgggattgttctatgtaataaatgtattgtacatctgtcattaattgtaatgtattacatcttaaatgatagccagtgaaacctttcctatataatggtctaaatgctatgaaacaaaccactcaagatttccaccatgaaaggaaacaatgtttctcaactggctctcctcttgtcatatcttgttctaactactaggggagaagagctcaaaccatt

SEQ ID NO: 6382 - DNA, 895 bp, Oryza sativa
  unsure (1)..(895): unsure at all n locations
ggagatgangggatgancagcggctacataacncaccacatgtgtatatctatttaattggttgtgcgttgggagtcatttattatacggtgatcaagttttttttaattaatactgtgatcaagttttttcatgacaaatagatggaacctagttctttcccgatagggatggatatcaaatcgccattagtaggtgcaatctcgcaagcacaattgtctaccattgattgccccattggaacaattccaatagtgcgcaacaacaatttggccaacatgatggtacaacgtattggcacactggctaatgatgatttaccaatgctggtaggttttttaataaaattttgaaattatatagtaataaaaggttggttatgatattatagactattgtatggtattgcctcatgaatagttgttgcatatttacgaagtatgatcattttcgactcaatctttgagtgctaacatcaaaattctcaacgagacataatataagatgaaatatgtgcaatgttcccatcttatgagcaattattattaaaaaatagaaattcagagatcaaatgcattttaagaaataagtaacttattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaat

SEQ ID NO: 6383 - DNA, 820 bp, Oryza sativa
  unsure (1)..(820): unsure at all n locations
agagagagatgaaaaaagttggttgcctntgngcgggtagtggtggactgggaagaggagaggattattaatattcccacccagaggcatgatgtgactgctgtaacaacncaccnannnnnaaaaanaaacccggaggcgcaacacaccancccaccgaacnncccaaaaaaagaaggattttttttaccatgcaagccaacgcccggggggggggcggaggaggaggagggggaggaataagaaaagaagatttattcgacgagatgctgtgcacggtgagggggggggggggggagataggatacggaaagagcgtatgggaacgcatgggaggcgcggtaggaggaggaggaggagcatttgatgaggagtacggggcggagttagaagaatgggcgatactggagtacggggttggacagcatcagatcgacggtggaggggaaaaggcgattatggtgcaagtgagagaccttcaaggttattacgggataggcggcggggatgacagaggaggggctgacgggatactaaaagtggggatggtagatgaaaggggggaggaagaaaatgacggggggttaaaggggggaaaaggggttggacgatttttatattggtatgggtgggtatagaggtgaaggagtacagattgaagggggaatggaagattaggtgtacttgggggatatgtggagggtatgtgggggagtttgttgggagagaggtgaccaatgggtggggaaagggggtgggggcgtgagggaaagaatgggggaggggggaatgaagaggtcgtggttaggggaaggacggg

SEQ ID NO: 6384 - DNA, 7135 bp, Oryza sativa
  unsure (1)..(7135): unsure at all n locations
gctggcagtgatcggctctacgtttgagccctcataaattcacatcattttcacaggccacgtaagaaaagaataatattcgtcgtatgaagtcattataatcttcctttatggatatctagaaggcatatgcatgcatgcattctgcgatattaatatatatatgtaaccggcgctgccggccacgtggttaattagacagttaattagttgatgatgccaggtggtgtttaattactgaggaaaacttctactagacgtctgaatatcttgttgccctgatgataattagtatactgataaatggttttaattaactaggcatcttagtcagctgcacttaagtgcagatcttaaggtagctaggcccagtcatagttccaaactttttttttcaaacttacaacttttccataacataaaaacttttctatacacacataaacttctaacttttccattacatcgttacaatttcaatcaaactttcaattttaaccaaacttttaattttgacgtgaactaaacacagctctagtggggttttttttcttccaaatagctaaatgattgaataatgtatgtgatcactattcgagagcacaaacgaatggattaaacattatgaagttaaagaatagatctaaactagttttgtcgaaattcacatataaaagttttttttctcaaaaatcgtatagtttgggtgcacgtaaaacatgtggcatatattaatcgatcgattaatccttccttagaaaaatgttcaagggtcttccgactagttccacaaggtggtggctagactatctgggttcggagcctcaccccttttaattatttgatattaggttatttcctaatatttgccttttttttattaattcttcctttaaaaaaaagagtaggttgatttaatgctaattgcattgccatgtttatttttttttctttttgtgtggatgacgtcgcacgcgaacacgattcgaaccgaagtccatttttcctgcgcgtgtacatagtatatacgtacgcgtgtagtggacggttgcttttcatctgctttcttcagagaagctctatgtttattatgatacgcatgcacgtcgttcttatatatgtttctataatattatgcgatgattctcaatcatgcatgtttcaatattacctaaccatttcaaaattgaacgcgatctcaattatttaactacatatacgcatgcatgtgtgtatatatatacagtacgtacaccaccggctgcatgccggccaatgatcgatatgatctggacctgcttttgctagcttaatttactcgtatttataattttttttgactgaattatttataattgtttgtaaacactgctccctccattccaaattgatggtacaccaagaccaagaaaagctaataactctctcatattatatttactctagcaacaaacttgatgcatgcatcatccacactattttctagccaatagaaaatcaagatattgcatgtgggttataaatacttgtgtggatgcatgcatcaatgcccatttactccaatgcaccaataacgaatagacttaatgaataaacacaaatatatagatcatttaagaataaccttaaaaaaattatatgcagatcaattttgaatgaagggagtagtatacatgcctcttactacatatttttggatcgatcacttgagaatttatggatggagggcacaagctgcattcacgtacgacaaatgcgatctacacccaatctttgcgcgtaaatttctgatcgatctgcatttaattcactctccatcgaaagttcatttaagagctagctaggggccgaccatcgatccatcccagaagtaattactactctagttattgatctgggcccttcatgcaaggtcgaacccatcaacatgcacgtaatataagctgtgtttagttccacgctaaaattaaaagtttaaagaaattagaacaatacgatggaaaatttgtaaatttgtgtgtaggaaagtttgatatgacgaaaaagttgaaagtttgaagaaaaaagttaaaatctaaacatggccatactctacatctaaaaataacacataagattaagtggtgagatgaaaaagagaaatgaggaaaaatatatgtatcacctttaatcatgtaaggggcaatcttcacacaactaaaaaaaagaaaaaaaagtgaattggacaaacaaataaaataaaattattggggttagtgtgctacagtacagaggtaatataaagatgatgtattgtatataccaccttttatagataaaattgaaggtgtcaactacctttgctataaaacttgttcctatattactcgtttaattataattagcatttaactgcgacgctaaaacgcacgcttgcatgcatggtacaatattggtactgcaggagtatatatatgtacgacgcgcatgctacctgcagtatgtacatgtccctcgtctgtgcgttgcacgcaccgttttagaacgcaaggtaatattggtttaactttgatcgatcatatataaacataattaaaaatataaatttcaggtatctgaagaaaaatggatgtatatatagtctaccataacgagagatttcttcatagtattacacttatgtaatttctaaaatttatatcgaagggctagatagtcaaatttttatccccgcaaaaaaaaaggatagtcaaatttatagagtataatgttaacttagaaaagtcacacacggcttgtttatgctaccagaggaaatagctgtataattaattaattaattaattaagcccgacttacgtacgtactctttctataaaagaaacttaattgcaagctattggtcaacaaattagtggtaagggtaggggccgggtgagcagaaaaaaaactgaaccgaaaagaccgagaccgagaaattcgatcctagacagtcaaagaccgatttttttcgatcaatttggttagtctcctcgggtaactgaataaactgaaaagactgaattaaaaaaatgtttaaatgcaacataaaatccactaagttcaataggactagactctaattttttcacatccctacttcttctaagcatgcaacctaacaagagtctttattcatatgtgcttacaatttctttttttgatttttgtggtggcatttttcactatttttttgcatatataaaaatgttgttgaatttcggtcaggaccgagaccgagaccgaatttgtcagtcctgacatttttgcgttgaaattcggtcttcacattccaaagaccgaaatgaccaaaagaccaagactgaaattttcggtcaggttgtatgcccacccctacgtaagggtaagtgcgcccctcacaaatacacataaacacatataccctacatcttaaattatatggtgcaattaacaccaatataaagaccaagaaagaattattatcacctttcgtttggataactccaataaatacaatgcatacacccaatgggattagagattttgagagggtggatgattttgaaaaagaaataattaaagaggagagagatgtgctagtttattgcatcatgcgtgctttatattatgaaacattgaaaaatatggttgtgtcttatattttgggatggagaaagtaagaaaagtaatattgcaaattggtagttaagggatactgagagcaagtactataaggatatatgtgttggtctaaaagtgtcgcataagataagtacttgatgagatctactccagaagaaaagtgatgagagagactatgagctagtcactagttatacaagaggcaatctacatatataatctccaaagaagagcacacaacgaatgtgagatagtgtgaaagtgaacataaggctgtcatgggttggcctaataatgttgattattttcatacagcttattaataaaaacttatttatgagcatcacttttatatatgtcatagcgactttaaaggcaatgcataaaaataaacttttcttttgagatggaaataataaatctcaatagcatcaaaatcaatttcaaaattaaattttacaattcaattttggtaacgatttataagctgtatgataaaagataggtatagtatatgacatggctaaaattaaggtagcacattcactataaaacttgctctcttaatttaggaacacaacttcttccattcccagatcgatcaaggatcaatatataagttgggacaaagttgcaaggctaattaaagtctttttagggtggaatagtaattttgaattttgatttggtggttgttttagttccaccaccagcttgtcataaactatatattccatgctgctagctagctagatttggcctagatcgatagctagcacttgcaaatttattaggtttggagctttgggatcctacgctgatcatagagagatcgatcacttatatataagcactcgctgtcgngatagatcacataatcctaacacatgagatcctgtaagattatggagtattacacaagtcatgcccagttgtagaattaattaattaacggcgggcggggcgtctgaaaaaaaaacagcttgcaatggtaaaaaaaaaaaagaaatcaaagatatgtgcctgccatgtcatttatcacatgctacgtacaacgtgttggcacatacagtaactgatgagcaattcaagctatgcattagggtgcatttctttttagctaacgattacatgttatcacggacatgtttttttaaaaaagtttataataaacacggtactttttcaatggaatatgagcaatgctagcgcaataaatgaccacacatcaatctagccggaaaaaaaaataaagggtaaatagctaaagtggtcctccaagttttaattatctgaggctcagtttagtccttgacattttaatctatccatattagtccttcaagttttcgttttagttcaaaattatccttgaacttacttagaagccacatggctaaacataaccaacaactctcttgataaatgacacttatactcccctcattcacatatataagagaaaaaattgcatgcaatgatttttttatagataatgcatagtaatttatgtaaaacgaaaataaattatgtacttgcaggtgtatacgatagccattgtttaagtttcatgtgcatatgttgaaataatgggaaatacatctgcaatattgtttatttattttgattttcccttttctaatgtatagttgcatacaaattaagggcaaaacggacattttgcaatggaaatattgactacaaatatccatatggcatattaagtgggcccaaggatgattttaagccaaaacaaatacttagaggacctatgtggataaaataaaacctgaaggaccaaattgtgccttcggtgaaatttgcgggactaaattagctattcacccaaaaataaatgacaaagttacttctagtcaatgtattagtaaattactaatttacccttaataacaaacggatcatatcatttctatcgatagtataatactactagtagaaagcaccggagcatcactcaatattgaattcattcattcatgccatcaaataattgttatgaacaacgcaatttcacaaatcatccatagacactttagagtttagaacgcatcatatccttaggccagattaaccaaaagaacatcaataagcaggactatatatagcaagtactttctgagacgaatattattggtgatcccgggtacccgggtacgtacaaatcagggtgcatgaacgacatagcaaaggcaggactaacaaaaacggaaggcaaatatatatatatatatatatatatatatatatatatatatatatatatatatatatatatatatatatatatatatatatatatatatatatgcatgcagcagtgtgcattcagatcggaagtggtatataatgtggttgtacgtagggtaagaattaagcgtgcgtggcaataacatcatagctttgtcggcaattgttcgtctcttctcctcacatggaaatcttgagagcagagatcgaatcgatcgtcgaagaacgtacggtcctcaaccaattaataagcacatatatatcgtcttgagatatcgatcgagctggcgactgactagctagtaaaattgtttgaatttttctagacagtctgtattaagtttgatcaagtttataataaaatttagcaacatctacaatattaaataagtctcattaaatctaacattgaatatatttagaaaatatatttattttgtgttgaaaatactactgtaattttattaaatcaaatattttttattagaaaaaagaaaaggtctaacgactttaaaggaaaggaagtactgtatattgttgtacgcatgctagcaagcaaatgcaaggggcagtctggcagtgcatatatgatagcgtaatgatgatttgttcctgcggctccctccgagcactggtgaccagtttaggttatgtttagttcacataaaaattagaaattcgattgaaattgaaacgatgtgacagaaaagttggaagtttgtgtgtatagaaaagtttcgatgggatgaaaaagttagaagttttaaaaaaaagttagaaactaaacaggccttaggagtacatgttggtcaggaggacgcattctgcatttctgcggcaaaatcaatcgtattttccgtcgtggtgacacgtcgcggctcgccggggccgggctacgagcgtgaggtccccgcccgttgcagactcagcccagcccggcacgtactttcaacttgcctcgccgtgcgcggagaagaatagtgggccggcccaacttgtcggtgcaccactgcacctgcacgttcgtgggtatcgcgttacggcccatactgctctcgggctgcctgtctacaatacatgggccaacatcgtcataccagtccacttctgacggtatgagcttttgccgtttctccttgcttcttgcatttagatgacgacaacgtactctcttagtctcctactttaatcatttgtcttgcttaaaatactaggcacaaaaata

SEQ ID NO: 6385 - DNA, 13371 bp, Oryza sativa
  unsure (1)..(13371): unsure at all n locations
atgtgcncnctttgattgatcgaccnnctactgcaagnaccncaatactgcaatcaattcgaattaatcgattcccttcttttgcatttgcacatctgcagctaatagtacaaactgaataataataagtaagaaaacagaaccccagagggctcgtaaactgaactacagaacattgctactacatatctcctgcttccactaagctcccctcgattcagctcacggctaacactttctcatcgcatctccatttctccatccaagctgctacccacaagtatacatctgttctccaatctgatgaaactcacactgaccattcttgtgcagcatcagaattcagaacacactccttttccttcacataagctgtctcccttccctgtcagattcttcgtcttcttcttcttcctccatacgatcatggagcaacgacagctattgcacggttagtagattgtgacaagtgacaacggctaaaaacgatggaatcagctgctctccagtttcatctcttgccgaatctcaagcacttgttgtgttttacttcggtcatgttattgttcgaggacgacggcgccaactggggcgctttggctgtcttatccttggagagcttctccatcgcgttgatgaacttcctcagatgcctgatgtattcagggtacgtctccaggttgcagtggccgccacctttcacccataagggctcgtacttctccttcgcgagctcccatagccgcttgccgtgggagaaatcgacgatgtcgtctgctgtgccctgccattgtcattcagcaggtaagttctgagttctgatcacaccaaccggggaaaaaaaaaacagttgagagcagcaatgaactatctcagaacttaataaagtcttagcatgttttctgttgaactgtaactagtaattggacatgagatatatactgaaaagtaaatttgaagatgatttcagacttgaatatcaatgaaaagctaaggaggctttgaatcagaaatgaaaagggtacaagctactcacatgtataaccagcactggacagtcaacctgctttattttgtcgatgttctgcagacatgttagcagtaaccagattaggatggtaaatgacagtcgttttagaagcaaactgaaatcatggtccagagttccagacataccttgaagatatcaaaccaaagtgttacttttaccggatatagaacccgaatgcctgaaagtatagcactgtgaaggacaacccctcttaatttttccaagcgcgaggctaaatgcaatgttggtccacttccaactgattgtccatacaagattagatcctctggttcaatcccgtacaccttcgttaaacagtcataaacagcctctatgtcacagtatgtgttgtattctgatggcttttgaagcagaaaacatgataagaaaaggaacaaaattaggtatgtcttccacaaggcgaacaattacctagcttaattacttattgtaagttcgtagaaaggaaaacatttactatcgttcgttctgatcatcagaaagaattcgttaatcaacaaaaccatgtgccacatatgggaacaactgaacaagcacacatgccactttatgagctagtactacttaaccaagttcttcaagtagggatcgataatcaatcacctagaagttggggttgatggtcccttggtataacaactttgacaaaaggatgactaacagaacaaagttgccatcatggtcgagaatagcagaaagcatgtgtgactttttccgatattcataatgaaagtaaaattgaaaaaggctaaacagccatttgccaaagtcctattccagatgaggccaagaaagacagaatggctaataataattgctttgagaaaagctgcccatatacctatagaagaacaggatgttgattatgaaaaaagcaagggaaacaatccaatccaaagattgtcgcttgagtcattgatgaaaatatggcataaacatacaggagacatcatgatcacaaaaaagtttaggtgacaatctattcaaagaagacaagtttactgcaaattaacctaagaatcaagtttgagctcttaaaatcactgaggaattcagaatcttactttgcctgtagaggccccatatcctgaataatcatagctgcagaacgaaaccaagtaaaaagttcagtcacatgtaacacacaatattggtcatgtccatcaaaggaaaattgtcatgatattaatttgacacaattgtccatgttttatatatttattgatggaaataaatttcaaatcccatgaggatcaaatagcaacttttccagtaggggaaattctttcgttcttaaagttaaaaggcaggcatcaactggatccccaaaaggtgaaatagataccatttgaatgtgaagttcgacaggactccatccgaaataatttatagcagaattattcatgatacatttttactctatccacacagcaagactatatgcaaattatcaatccacgatccaaatgccacaaacagttataacagtattataagaataagatgccaagcactattctcttacaaaaatgatgctctgtaatccttgtatattttaagagaactgcaacaaacaatgccgtaaaatttttttaccccagttccccaatctagagaaatgccacaattctaacaaatgactagaatcgctgaaactgaattcgaaagcaatagcagcagatcacacacagcagcatgcatctgcattggagcagaatctgacagtataaagtacaatgaatcatccaaaaaaaagtacagtcttaacctcgtcggatggcaacctggcaagaactaaaatctaaaacggagggaagaaacgatctgtttttcaactcttccataattgtggtcaggccatcaggatatccaagaaactaaatctaaacataaaagcagaagtcaaagcatttattcaggaaaggagtggtcgtcatttaatcaaacgagcagttcgttcctaacattgaaggtgaagcttaatcaggtgcgaattcaacccctcaaagaaggtttaacaagaacaatggaaagaaaaaagcaaaatcttttgcattgcaggtcaattaacaattctgaacgccatgacattactgttcaacacagttggctcaccaactaaaaaaagatcgaatcaaatcctctttcaaattaaagcgaggaaaaaaaaacataacgaagtgcccgccaaatcggagcttgcaaaacggagtatttacaaaattgatcctaaatcataagactaattgaaagtttgatactgattaggcatgaagagtagagccatagagcgcagcatatctagcaggcaagaacacaacaaatgcaaaggcatataatgaaatgcaaatgcaaatgcaggttcagaagttggaagtggaagcaagaaaagaacaaggcgagcaatggaggagaggagaggagagagggtgacctcatgatgttgacgcggaggtgggcgcggagctcgaggaagaggccgagcatctggccgaggtcggcggcgttgccgtgggagtagagcagcgtgaggcgcgcggaggggtggcgccagaaggcggcgacgacgcgcgtccctcccttggtcggcagcgcgtgcacctccacgccggcgtccgccgacacccccgtcatcctcaccacccctcctccgccgccgccctcctccgccaccagctcgtacgtgggtggctccggcgggaagaaggccagcctcgccgccaccgacgacgtcacgttccccattagctccccctccccgcccgcctatctcgctccgcaacgtgaggccgccttctcctcctcctcctccttttcttgatttcttccctcgtcaagaaaaagaggtgaggtggtggtgtgtgttgcttttctcgggctccttacctaagcttgcttttcctcctctctctcgcgcgcgcgcaatgactctggtggattcgggtagcagttgcagtcggggggttggtttctttggttggttgcgcggcgggggcgtagcgtaggcgtacgtacgcttgtcgatcgatcggcgacgacgacgacaggttgacgaccaccacgtcgcgtgtgtgcgcgcttccgtcttcgtttagtactactcccacacgttttttataaaaaaaacagtctaatactaaacatatcttaataagttgtgttttcctgaaaaaagttggaggtttggagaaagttgggagttaaaaaaaaagttagaagtttactccctctgtccaaaaaaaagacaaaccctaggtttctatgtccaacgtttgactgttcgtcttatttgaaaaaattatgaaaaaaattaaaaagacaagtcacacataaaatattaatcatgttttatcatctaataacaatgaaaatactaattataaaaaaaaattcatataagatgtttttgggacggagggagtatgtgtgtataaaagttatatgggttactgtagcacttatgactaattatggactaattaggctcaaaaagatccgtctcgcgatttacatgcaaactgtgtaattaatttttctttttatctatatttaatacttcatacatatgtccaaagacttgatgtgatatttttggaaaagttttttgtaactgaactggcccttagcaatgttttagtagccacgcacgaaaaattgtgagacgtctcggatactcacccaaggaggcaacaggacggagtattattacaccatccgttccaaaataaatttatttataaatttgtgtgtctaacgtttgattacctgtcatatttaaatcttttttataatttggcatttttattgttattatgtgataaaatatatataatcctttatgcgtgacttaattttttaatttttttaaatgagatagacggtcaaacgttagacataaaacctacaaataaactaatttttggacgaagggtgtactattatagatttaaaaatttattttttaaaaaatgagttttatatagattattttaaaagaaaatgtattgtttaatagtttacaaaacgtgctcccggtaaacaagtgggtagtaaaatcgaaactcactttcaaactcagtgttagatttacatttagcactggcattaaacaccaaaagtagctaaattggttggttagtgttgttttttatgtgaaattctcgaggattttggtgttagcttatgcgtttaaaaatgatcgtgcaaataactatcggctcatccgaatagcagcagtacggtcgctcgcacggatcggatgcattacctgaccaatcaacagtacagatattagggaaaggaagacgttgtacctgcatataggtgactcaataactgatgttcagttagctataataaatgcgtggaagagccaaagagggtaagctgaggcttgtttagagcaagtttaataatacagtggttcaaattatctatagctaatctaatagtctattcagataatagctaactataaaaatatactacaccgttaatacacgattctacccctcatacacacgtaacgtcttagagtttttgttacaattagttataaatctacaggccgatttattctctcttttcttttttcttttcgatatatgattatagctagtttatagccttttattgtaccgctcttaggtggtcaagattcggtcaaaagcagcggcagagcaaagaaaggatgatggagaagaactcgcagcggtgactggtcgatcagacggcgaagatagactgatgcatgcctctccctgcagctgtatacagtatgcttccgtccattctaaaatataataacttttatcccttagtatttatcctaaaatataataacaactctccaccaatattctcttcccaaccaatcacaatcattcatcatttatttttttccacctacctctactaatcatcaatcacaaacctccaccactcacttctacctactttcttaataatcgtgtccaactctaaaacttattatattcttggacggaggggtagcagactataaatcagctaaatacatatcgagaagataaaaaaaagagagaagaacaacgtggcaacagatttataacgaggtctattgagatatgttgtactagaatatgttctatcccatcttaggttgtgtttttgggacgaaaaaagtatatatttatagataattattgtataaattagttattaaattgagtatagatgatttaaagttagttggctataccattgggtgagactgcgagttgagcgagtgaggcactgtttccctggccccacattggctgtcttcatccgacagctgccagccctcgaagtcctcactgatctctctctatacttcttccagcatttctgcttgatcatcatcagcagctgcattgcctggcctactagtagtagtattgctattgctcaattgttatcgagactgttagagactgtttaatctgacgaaaggatagatatatttcgcttaatctgatgattaatcatgtgctgcacactctatgctatggagtagtagtactcgctgggcagaacattctccttgcgcgtcttttgaagcctctgccgctggaatgattggatggaaaagaaagaaaattatgcgtgcacaatgagagccgaggcagccatcggctgtctcgcccatggacaagaaaaggtcactagtggccattgcgttgcaatgacacgaatcaacgaacagctttgagtccaatccaaaaacacatttagttttggtacgaatcaacaaacgcttcgtcgctatgcatccatccatgcaacacactgctgttcctatggccatactccatccgtccaaaaaaaagacccgatccatttcaactagtgtcacaatcaattatttcatttctattggagcattggcctagtagcctcctcctcttttgttactacaagaatgtccctttacttccatagaaaaggttaattaagttttcttttcttttctatcgctgactataattagcacatactccttctgttttaaaataaaccaacttatacatatgattttggataaatcaactatgaatctaaatatccgtatgtaaaagttgattttttttactagagtatctctttcttttaacaatcaagataaacgccacacaacagctagcatggactcatatgaagaaggtgaagatggttaattagaggtagaaaagatcaagcacaagggtaacacaataaaccaactgctccaaatctctctttttgtccctgaccagattagtgaattgccttttgtcaacagtgacgttagctggatctgatcatgaatactctctccccaactgtactgttgataaatatgggaattgggcaatgtggtcaagcaaagggaccatcagttcatcattctcttttgcatttctttatcaggtgggacccacacccaaagctccaccccgggaccacatgcagctcttcctttcatgagggctgatgcggtcaaagggtgaaagggggacggtcaacgggagattaccactacctggatgcatgtgggcataatgatagtagtactagtaattaagagttaattatccatatgcacatatagcagctaagcttagcctcaaaccttggagtgcgaaacactgtaaccaaatccattggaacgtgaccggcacatgcaatgagtgcctaaattagaaaggagcacggcttggaaaagttagtgctcacatcattgtatatttgtaccaacagattgtgtaaatacaaagcgtacaatatcataaaagccacatgaaaataaaagagatgatctagatatacgaaattgattgttcctttccccccaaaaaaaaaaagaaattgattgttccttaccaagggtatttgttagagataaaactttatagtggagtataatcttgtagcaactcatatggaccattaagatcaaaatatggagactcagattatatgacagtccttataactgcatttgatgtaaatcgagagatgtactgtggtagttcctgttatttataacagtcttttctagcttgttccttgtagattttttttcctaataatatactccctccgtttctaaatatttgacaccgttgactttttagcacatcaccgttcgtcttattcaaaaacttttatgaaatatgtaaaactatatgtatacatataagtatatttaacaataaatcaaatgataggaaaaaaataattacttaaattttttaataagacgaacggtcaaacatatttaaaaaagtcaactgggtaaatatttagaaacagatagagtattaaagtacaaagcttttatgcactcaaaaaaaataaccacacttgatctcaatattgagcgagggtcctcccagtactgcagaggatctggatttctcaatatcgagagtcaaatattcgcattcgtatgggccatagagctgagacttgagagaaggaaaacgtgtggaggaaaagtccgaaaatcccatgcttgtgtcctgctatctcgactgggagcacaagcagagacgacgcgaaggctgacatgtgaagtacttctactaggagtactactcgcacaggtctgggcggcaagcaaccgaggcaggaggagccgtacgagtcagcagtcatcatcagccagcgtggcgtcgcattggattcgcttccttcttctgctcccttctcctgccccaaaacgtcgcaacgaataacgatgcccctcggatctgcctgcacccgagtactcctgtgtactctatccattccaaaataaaagaaaaacatgtccaggcactcgatattccagatagcatcatcttatcttagatttgattattttaaaacggtgagagtagtccagtactgctgctgctgctaattggatttttatctgaatatggaagacatattcagatttgttattctaaatatcatcacatcttgttttaggttatcctaagttaatttattttgagacggagagagtagcccagactgtccggtactgctaccgctgctgctaatgttgatttttatctgggagcaaatgaggtctcgttgagttctaggaataaacaacaattcatttgctactttgcttagcttaaacagcaggtcatgcggctcacgcccggtcgaggatatgcgtggcaattcttgctttgtattggtagaaatcatcatcatcttatgtacatcggtgaggattacatgtaccgtgtctaatgtcatgtgcaacagtgtaagcctaattaagcagaggttaatatgtacatggggacgccatctcttaccagatggacggagcagaggagaggcgggctacttccacaccttgacggcgccgtctctgcttcccgagatgagcctgtggctcgacaagttcacggaggccagcgcgaggatcgcgtctcggtggcaccccgcggaatccgcggcggccatggcgagctgcgtcttgtgggttagcctcgacgccgtcgtgggctgtctgcatatttcctgcacacagaagcaagcaagcaaacacactctaatcaggttcaagatttgcagatggggaagaatgtggcacaaaccaataatcatgaagagagatttgacattgatcaatcgaaagttaaaactgaaagatacagcacagaacagcatagatgtagcagaaaaattcatattttacgactagttacctgcacaacttgtacacaagagctggatcttatatcgtacgtctcgtcgtttccagctcctttcaccgagggaccggctatacagaagctttgctcaggccttcaaaaacatcaaaggaaaacgctagttttatatgacaggcacctcaggagattttttttttgcaaaatcagtagtagtatggtacaaatactgaacctggcctgatcccagtagcgtatcttcaagtccgttcctccggtcaataggtcccctcctggcaaaggaagcaaagagcggatgcctggaaggcgtggaggcgggtcacataattcttcaattcggtaattataattcgctggccgggtctcatctctggtatttggatgtattgatggtgcctttggtacaacagcttcattctcagtacttgctgttctaaatatctgcatagttcatcaaatttacagggcatgagtagagtcgtcaagtgactgcacttgatagattagaggtgttcacttcatttttctcaaaaaaaacactgactcttatagaagactaactaattacaaatgtgagtaaacaaggtattttatcaactgtgacagctcaggaaacaccaagcagaaagccatatgttacctggtgacggcttccattctcagcatcccatagggtaacttcattgcagcctgcagcaacaaaaaccacaggtctcccggaagaagaaattgaattcggtggtggtataaacaagcacaatttctctataggggttgctggcaaatatttccatgagttaacgggaagcaaaaacctattatcccacaacgtaagaacgcctcttgaagacccagagatgaaccaattcccgcactggcccactacaagtgccgatacatagccctcctctggtgaagatctaaatgaccaagactcagcattggtccttgtatcccatttatgtatgccacaatgttcagtgctgaaaagaatggttgggctaaaactctctgtggaacagttcacaacactgagaattgcaccttctttcaaatctttcctttttacatcaacaatgccagaatacctttcgatgacactccctacaccacgtgcgcagtcaacagaaaacaagtgcaatgttccatcactagcaccaacaataacttggggagtaccatgaagcattgtcgtacatagagctcggctactaccgaggctatatgttaacctagatctgaaggcaatgtccttttccaattttcttgtatcccatatcttgacacttgagtcatctgaagctgttacgaaaaaggtattgtcggttgatacagcaatatcattgacagataagcgatgctcctgaagatgtgccaccagaactccacggggtttccaacttgtctccagagacaatgctggtctggtgaacgatcctgaattatcagagttggaaatgatatcacctggtatagacgagctgctattcattgagtcactgatgctcccatctcggtgcatgttactgaaatgattttctctagtacgtatgcctggaactgaacttgataaactcccatgccggtcagatcccaaatttgcatgtagtgctgtcccttgcatggagtataatggtattcctttaggtacgccatcataaaaggaactagatccatgtactgcagagcttatatatgctgaactagcagaagaaaaatctttaatgttcaaagacacatcattggacatcttaggtcctctcaaccttgaatcatcttcaatcatgattgatgaaccactttgtaccatggcaggataccttcctccatgcactgtcaattcttttttaccatcacccttcagtaaaatgtctcctgcatcatggacatcctctaaagcttggtacaagactaattttgagaccggaggcttaatacatgaaagaagagcagtttctgatgacaatgatggtggctccctgtgtaaaaaatgcttaagatgtggaaaaaggtatacaaaggtgtctacaggccctatgctctcactgcaagcaacaacaaatcttacagcggaccgtttaacccattggactggatgacacagcaagggaagagcctttccaaataggccaacaatcgcccttttcctcaaataaccacttttgcacatcatagtcaagcagtcaagtactttcacaagcacaacctccatttcatcacttagtgcaaaataaagatagggcaagagatactcctcgacacttctggaaccaataaaatagcacccacanacaatctgaccaaaataacgtgcacggagctgctcatcncggtcatttaaaattgctgaaagtatggaaagaagaaagtcgttagtntgtctatgtccaaagaagtaacacaggtaccctatatcttgcagaagagctctgcggacattaggtgtctgtttctgtcccattaccaactcttgcactatttcataaatagattttctgagtcgtgcaagttgaccattaatgctatcttgctgcctctttactggtgattctacagactgtgatctgggagctaccattgattcatctagaggcctagcatcctctatactccgagaacgaagcaggaatctgtaggctgtcaaggccaacttataaatgttgctggcatagcaaaccctaacactctcctctgtatcatctgggagcaaagagagcattggaaggatgtactctgggaatatctttgcatcactgataggaaagtcttgaataagacaaagaacatcagatagagtttccaaagcagcacagcggactatggcagctggatctgaaagcatcgcaataacatatggaataaccagctgtaagcgactatcatcatctatgtatgtagaacaaatcttcagaagtatgagactagcccttctaagctctggctttttgacacttcgtatgcatgagcaaagtaatgaggcaagcaaaaccatgccttcacagctcaccttgtactctgtttgttggaaaatgtcaaaattataggtatctgattgagcatcataactagacactaacgcaagtaggttactctttgagatcttctgcaaatgtgatacacaattgttctggcccatcaaaccactttcagttcttccagcttgacaaacctgctgcaaggactgaataccatttgcatgggaaacattgggagtaacagaccggtctctgtcttgtgtgatctttgtacttgtacggtcgtccttctccagttccttgaggaggaaattgagatctccaacaatatgcttatgctgtgcaggactgtttatcttaactacaggtacacttttggcatattcttttggtgaatttacagtttgccctccgatgcccattttcccagacagttcattatgcacaggcacagtagcagatccttgaattttctcgagtgttgagccacttatcattatatcatgcatcttttcaaaatattcttgagtcttctcgacctgtcaaaaggcatgtatgtttggatatccatggtcaagaataacaaagtagaagtttaacatagatgtaattgatccctacn

SEQ ID NO: 6386 - DNA, 9864 bp, Oryza sativa
  unsure (1)..(9864): unsure at all n locations
gcgcgcttgaatgaacttcgctcntagcnnancaagaacagaatagccaagagactacattgctttgtatgtgttttttcacctcctgactattaggcaagaaaactgatggtataaaggacaaggcataactaatagctggaccaataaccagaattatttgtgcaacacaaaaggaacaaggaacaataccagaaaccttttcaagggtatgaatagggtcgtactgaccacgccgataagctagaagttgtgaaagctcaaaaagtggctgacctttttaggaaaagttcagcaagaacacacctgtaaagaagacaagccatttaccatttggagaataaggaaacgaaaaatacagcctcagtaaacaagtctaacatagcaaagtaccacataaaagttggagctattaaagaaaaaagattaattttcttaaccaagggtcctaccgtcctagcaaacaatcatgcaccgatttccttttgggatgtgcaaatattttaatgtagacagcaaaacatactgagggtaggtctctcaattataccgtcagttcgttttacttctaactgagcattcctcaatgcgatcaagtgaatttgtaccaaccatgcagcctcaaattgatcaaaattatgttccaaaaagacaatcaaaattattttcaaacgctaacccagcctaaatgttaaatttggtatttcagttaagggcgtgtctcaaatgacaagataccaagtggagaaaaaaacacattggtaacaatggcatatattgacaacaaagaacactttgtgcattgtctatcagcaattatcagatttcatgggacaggaaaaatatgatatatgatttccctctttgtcaagtgagatgccaaatgataacacatccaatgaaattaaattataaaactggcatgttcaagcaaaaggcaactgtgaccaaactattagtataagggattgaaaggtcctatactcgtgaccaaatcgataaagatttataagaagaaaattacccaagagagaatatatccatagatcgttgcaaaggtgcatctgctgcgacttgggtttccgcaccatgctcatagaatctctggaaacattgagttaggtttattcaaaagagttgtaggtaatcaaagatatagcattaagacatccaacagtgcattgcaaaaatgcaaagactgactataaatcataatgtgttttcatattcccaaccaggatgactacatatgttattacatctttggtaataatgaaagaatccaaatctcctagaaaatagcaatagtttatttgtgaaatgatcaagtgaatgtagttttcaacccatatggagatggcaatatactttcaaaaatcaactgcatgtaaacccaatcattgtaaataaaatggaaaaaccattgacgaactgccctgacactatacatgttactctagactaacaaattagtacataattgtattaacaggtttcgaatttgtgcatctgcagtactgcaactacaattttccccgtaattcaatcataatcctttagctcaaacaagagttccccatgtagatttcattttgttgatcgtaaatcagagaaagcaattgccaaaactttaaacagaagtctgcgttatctgcagctcctaaaggaattctttttaaaaatgaatgcactaaaatatagtagcaccaaaagctgaaacatcacaatggtgagagaagggtgtaactaaagatcctaacagcagccagtctaaacatcacttattgagtagttgtttaaatgaataacaatttgcaggaacaagcaatatacagaagaccataacaatattagtgataagggtgaaaactatgcctatgagaacaaataaattgggatatcatcgacaaaagagcataacactttcaaatataattcagattaaagaactaacctcaggtgctaggtagcatcttcgccttccaccagtatcaaagaagaacgaaaaatcagatggatcatcatccgggatgtaagttggtttgaaagatgcaaagtccgcaagatatagccaattccaggaggtaacaagaacattctcacattttatgtcacctaacaagaaaactcagtgtaaacatcaatagacaaaaaaaaaatactgctgatgcacagtaaacccttctcaccatgacaaatccccttactatggctctgctccacagcatggattaactgcacaaccaaatgagctatgttggtaaccatatctggaatggaaagagaataatgactcttacatgttccactagttttaagtgcgtgactcatagctatacaatttctaacagtcaccataggatctgatcattaactctgtaaatgcaaatgattatccagtaacaaccataaaaaggatggctcacctgaaaagcaagccatttcttctcaattttactgaggaaaggccgtgtgcttagtcgatcatgcaggttgctgtagaaatactgcctaaggagatacgctgccttatccgtttgcaaccaaacctgaagacatgggatgtcatgtcagcatatgttacccaaaaataataggagggcatatatttacaatagacgtagataactatgttcacatcctgatggatgcaacaaccgctaaatttcactatttcatacaactatctagtgtgaaaatattacgagggcatgagcatattcctaactccattagaatttaatcaaccatagaaatcgatatcatactctagaaacccctaatggtatggcttgaaaagccctaatgacagtttaccaaaggaaacaaccttttactgcctgatctgaaatttccacctaaaccccacacagagtaaatacgcattatttttctgaatgaaaactacagtctaatccaccaaatacccttatgcaacataacaatgcgctaaagtcccacgaccgattgcgctagttcgtaaagcacgggcaaaattcgatggataccacagcacgcaatcctcacctggaagggccagacgtgggatccctccaacccctcgaaggcgttcctaatccgctccagcctccgctcatgctcctgccaaaaccagcacccacagatctcaaaacgcgatttccaaaccccaaatcgagggggggacgggggcagagtgaagggcgcgcgagccgcgaagcctgccgaattttcttaccttgaggtcgaggggctcgccggcgcgcttgaagtagaccttgacgaggagcagcccctcgtcgtgcttgcagcggacggacttgaggaagcggccgcggctgacgacctcgacgagcacgaggttgtacgtggacgggaggtcgtggaggtagtactccgtcgccgacgcctgcgtcgtcttggcgatcttgttccccatcctcctccggcgccgccgccgctcgccgccgggctcctcgcgctcgctctgctgtgcttagtttttgggtttcgatttcgagggaggtgtgcggcgtcgttgcgtttgcgtggtgcgtctgcgatcggaacccggtgcgagtgccaccgcgtcacggagcggggacggagaaccaaacaagcaaacccaatactaatccgaattgcacgcacgcaacagaatgcagttcgagcacaacacgattaacaatatatggctgtgtttagattctaatttttttttcaagcttctaattttttttatcacgttaaatattcaaacatatatatgaagcattaaatgtggacaaaaaaaatatcaattacacagtttgcatgtagattgtaaaacgaatctttttagcctaattacgccatgattagacatacgtgctacagtaactaatgatggattaattaggctcaaaagattcgtctcgtagtttacagtcgaaatctgtaatttgttttgttattgatctacgtttaatacttcaaatgtgtgttcgtatatgttaaaaaaaaattggctcgaacgaaacacgacctatgtctaagttatatatccctcatttcatatcgtataagtagaccaaacttggttaagtttaactaaacttatagaaaaaattagcaacatttaaaattatcaaatttagcaacagaatagagttcgagcacagcacgattaacattaatatgtcaaagttatatacaagtataatgtaattgtaatatatttatttatatttgaaaaattgttaagagaagatttgtagacaaatttatagtaaaaccaaaaaaatctgaacaaactatcaagcttcttttttccctttttttcacggttaagttattgttgatgttttatattaaaaaaagaaaatgtccacttcaccaactaacctaaactaccaaggcaacgagaacagggaaaccaagcacgacactcaaccaacgccattcaccacaggaacaagcagctagaaaaaaaagagactctcgcacactgaagacatgatgttatcattatcacaccatcaccctcgtgatcgggtgactccaccttcgttgggaaacatcagtgtaagggtaacaacctagcctgcatcaaatcatagcttaaataggctcatgttatcgttaccacacgtcatgccccgctgatgctatagctccaacttcacaactaccaaactcactgatgtactgttgagccagtctaacgtacattacagatgataagctttgaagccccacacaagagcgaaaacacaatcggtgaagtctaacttatgaaaaatgactaaagaaaaaggagtgagttgatcaaacggtgttcatactatacaacatagtatgtcagtagatattaggccttgtttggatcatctggtctattaaatagctctccggaatcttgctatttaggagtattaaatgtagattactgacaaagctaattccataacccctaggctattttgcgaaacaaatctaacgaggtatattaattcatgatcgcggatgatactgtagcatcactgtagcaaatcatggattaatataccttgttagattcgcctcgcaaaataccccaggggttatggaataggttttgtcagtaatcgacgtttaatacttctaaataacaagattccggagagctatttaatagcccggaggatccaaacaggatatgagaaagaatcttcacttctattcaaacattctgagattttattggttagtcaacaggatcacaataaaggacgcctgtgaagagcaactgaaatgattatttactctgtttagcattataagccgttttgtgttttgaataatacatgcatgcatccttgtatgtgtttttttagacgcaaaaggtagagagactctaccttattaccattgcattaatggtggtcattaagtaacaaagccggtggctggcaagagattataaggggggaacaaagaggaaggataaagaaaaaagaaagatagaaaaaaaaaggaagggtgaagaagaagaagaagaagaataaaccgatacacaaaaataaaagaaaacctagctaagtttgtctgcccaagtgttgatgttctcgcgaaggctgggctttaggcgatgaacccacaactggagactttctcttatttgaagcaggatgtacgtaacgcttgattcagttagcttgaagatcagctagttgtgtgccttccaaagaccgtgcgaacaagctgcaaagcacgcaggccatcccagtttctggtgttctgacaaggtatccaggattgattccacgaaatcttgtatgttagagctgcgcacggctggctcatagaggttgagcttcttccagacttctcctgctaatttgcaatgaagaatgatgtgatttgctgtttcaatagctgggcaagagatacattagtggagaaaccatctcacaatagtcccagttctattaaaaactgggactaaaaaacgatttttaatcccggttaaaaaatttttgatcgactaaagatgatttttagtcccggtttatcccatgtcagatgtatggcagggggtcgaggatctttagtcccggttgatactaccaacactttagatcgatctttagtgccggttggagttatcaaccggaagtaaatatttctctcccacatctgatcggttaagtcccagacagatatttagataagattagaacatcccctctcttcctcttgtcagatccaatcctcttcctcctctccttcctcttctcctcctcctcccctctcctctctcccatcagccggcccttcctcctcctcccctctactccctcttccatcagccgggcgggcggcggcgacgcgaccgcgaagagggaggaggcggcgggcaggaggccggcggcggcgggtggcggcggcgggcaggcggccgggccccggctcatttgcttttttttatataatttgtatttcactggatgtatatttttttttagattttatgattcattgcattgcatggatctgagatgtataatttgtataatctgtgatgtatttaatttgtgtgtagtcttttaggatttgtgatgtatttgatctgtgtataagtaacttaatatttggaatgttgatttggggatgtgcatcccattcaattcgggagaaaatatatggattaacactagccattagcaaatcaacagtaaaataaaaaaaaaaggatctcgaggaactgtcgattcacctcaccaaccggaactaaagattccccctctttagtcccggttggtaacctctttactcccggttggtgttaccaaccgggactaaagagattcgtagtctcggttgaaaaaccgggattacaaagggttctaaatcgggagtaaagagtatttctccaccagtgatacagtgtgggttggaatcccatttttccttgtatgtgtttcacacgtgtctaaatttatactcctgtgtgttagggaatctagataggtaatggatcataaggtaaaacgtaaaacggagggagtaatacatactcttattgtgaaacagagtaaattagttttcttcctcgtacactccgagaggtgaggcaagcatggatacataaaaggcatattcgtcatttttgcgtaaccttacagtcctgctcatggtcatgttgcagcacgataggtagtttggtacatgatcttcctgagatgtaaataacttgtaatgtacggagtaaataacttgcatatcatatgtaccattacaactcatgtctgtaaaaacatcctcaggtgagtcaggtcctgccgatcgatgctccagtagctcactttgccttcaaagcaacagaaagtgcgctctctgataataataagttgatgataccccatgcgttgctgcgggatatttgaataactttagtaaaaatataaatttataaactttgaacatgttgcattagcgttgttttttttgaaaaaaagaaaaaatgatatattgtgtaatcataataaaagaaaagctaaacaacaaaatagttatgaatccaattaatccataaatcaccaagaacaaaaaaaaatgatggtctatgatgatgtcgttcatgatttactccttgatcgatgaacaaaataggcaagacgtagctgaggagacccatactttatgaattatggttgatcatcacataaaagaactctataacaaatagttcaaatgaaaaaaaaaagctatcatcaaggtaattcacatataattttaggggatcaccaagtgaatagaatcagctacagtgtaaaatataaagacataacaaactacaataacatgatttttgatcaacagtgctacatacctgcaccaaaattatgccaaataatccaaaaggcttcacacagtgacagtcattagcaatgcagttgctggccggacatgagctgcatagtggcaaacctgcaatagtggcaattgagacaaaacaccaatctaatatctgtaaagcacggctatgtgcgaggcaaaggctggtattttattctattatatctaaaaatatatctgtaaagcaaccaacaatgaaaaatataaccaatgcaatacagtgtgtgttgacagaggaagatacctgctgccgtgcatgtgacagagtcattatctaacctgaagaaacaaaacaggacatgccaatactattccctttacgctagtgttatatatacaacatggcttctcgatcgacagtttccttgataattgtgtggatcagtggataacatcgctcgattttatagacatgaagcagcagaaattgaaggcttgataggaaatgtatagttagcaattgaaaaaaaaacagacgggaattcatgtaatcctccatggaataaacctgcaaagaaagtgaagtaatccaaagaagagattgaaaggagtgactttccactggcacaaatagtgctccaagggagagataaaaaaatagagagaaagaaaaggatgaaggtattaggaccattaaaaagtaaaaacatggatgaaggtattacaaactattcgaaaaatggcccaatttgcatcatatagattataaagagagacttacatatttagctggactgaggatgaacctacaataatggatatcatggcatggaaagaaacaacctcctccagtcctcgtagtcatccaggaagcagcagcatcaaccttcatacccacttctcttcttgaatcataattagcagaacaactcgcgtacgtgtcgttatataaaagaagatgagaagggaggagacgttccaataatgcaagcggtggttattggaaggtgaagattaaaaggcagaagtggggcagccagcgacccttcgctccctaccgcgggaggggctggactgggccgatcgagtactatagaactgagcagggcaggaaggacggcaaaaacaatctgatctgttaaagcagagcgatccaatggacgggaatagacagtgacgtggcaaagcgagagagcaggaaaatagatttagtggggatgacttgtataggtatataggatactcaattaaaccttcttatacttcacgcctataaaggtaaaaggtagaaaatatgctttaacgcctcaatttttgggacattagaatctattttagtaaaaaccttgattttaaaattttagatctttgtaagaatgtaagtgccaaaatctcagttaaaatttcgaaacaattacccctatccaaattcaaatccatgaattcggatttcttttccaggttcattttacaattcctccgaatcccaagtccttaaatatctacacacaaaaaaaaactctcccctaaactcgtagatcaaatttaaaactttgatttgaagctctccattgaaatgccctctctttcttttcctcaaattcataccaatattcaagtctcttccaaaaatatccaagtattggtatttcagcccttctataaaatatttagaatttcatgagaacaaaatataaaattttgaatcaaatccccgtttcaaatctttcaattatccttcaaacaattcttggaaaaatctcaacattcactattcattcgggccgctcttttccttttctcccggaccggcccgctctctctctctctctctgtgtgtgtgtgtcttaactgggccaataataatttgctgggcccgtagttagtttgcccactgggatggatggtcaagatgtggccgtttcgaacgcactgatatgatgatttcttcaccaaaaagaagtattcttatactgtatagggggtcgtatactaccgtataactactagatgttgctatatagttactccttggtnnngtcncatgcaaaggtcatcaatgcgcgg

SEQ ID NO: 6387 - DNA, 5984 bp, Oryza sativa
  unsure (1)..(5984): unsure at all n locations
aatgtgacaggcaaggcttattggatatatataatggaattgcattgatatagtaatgtaaattcataagatgatggaaaggtaactaacccaacccacaccacacccgggagtgagtgcactgcgctgngcaaaacactgggaagggtggacaaggagtggccgnnncnaacggactgatattatgatacctacaccctcaagaagttttcctttggtgcataggggggcgaatactaccgtgggactactatatgttgctgtatagatactcctactttcacccatctacccactcgatacacactttgttaacatctaaattgggcacctaagattaaaataggaaatattgccaaaatttggaagtctaccggttcctccgaagtgggccggtctgaccgccgtatgttgggcggtcagaccgccggttgagggccggtcagaccggcggtgtgtggccagtctgaccggcaggtccgagtccgactctgtttcgtcgggtctcgaagtttccttgctcaggaagacatgtttcgggtttcctttggtttctaccccgagttggacgtggaggagggcctatagagggcaagaccaacccctatataagggacatggccggttcattgtaagaaaccaatctacaatcaatcaatcgaatcgttttttatattgcttttagttttctcttagtttgtccatctttatcggtttgcaccgtaaaccgtccgtcgccgctgcgagagtgcgacatctctttgtcggtttgtcctgaaaaccttccgtttttcccacgagacgggtagctatctagaaatcggctccgctagccggtttagttatcaaaacccatctaggtttagctctttgctagatcgaggtggttggcgactctaggatcaccgcaaggtttaagatgctgcgatcgtgcttgtcaacttgtcaaaaaagttgccaacacgatttttggcgactccgctggggaggagatccgttcatcgtcaactcaacttcgatttcgccatgacgaagccgccatccaagacggaggtggagccatctaatgtgatgccagtcacattggatgacttcgaaggagaagatcgcaaagctatggaggaatacatcaatgagctcacacgggaggcgttgatgagagcaactactaggactcgtcaaggcatgatcatcaagcccgggccacgtcccaagctcactcccgacgtggtaagtaatgacgaggtatcacaatctatccaacaacaaattgcatctacaatagattcatctatggctaattttaaagatagattagatgtaatgtttaaggataaagttgatggttttttaaggagtaggctcgattcttttatggatgattacacattaaaggataaagcctataccactgttgatcaacctcctatagatccaatgggtagtaaaaccgacggaacggcgttcacggtcggtccgaccgggcctgacggccggtcagaccgcaacatagccgtcgatctgaccgtccagacggccggtcagaccgggtattaccccggcggtcagaccctgggccagtcagaccggcacaatcgtcccaattcaggctatagatccaatgactaatgctagttatttgtatcactttaaaacatttgatcctcctgtatctactgccaccactaatcctcaagttcccccacatattcctaatgcttataatgatgtttctagaggctatcctcccgatactatgcaaggccaatataatcatattgcgccacaaacacatcctattaggccaccaaacccaccgccaaatccacaagggcctaataacatggaggatatgattagtgatattatgaggaatagattcgggattgaaactaggaatcatgctagagcttacaaaaagccatatcctgattattatgataatgtgtcgtttcctcgaaattatagagttcccgaatttgccaagtttagtggtgaggatggtaagaccacatgggagcatgtaggtcaatttttagtgcaatgtagtgaggctaatagtgatacttttaaattgcgcttgttttctttatctttatccggtaatgcttttacatggtttacttctttaccggcaaattctattcatacttgggctcaattagaagaacaatttcatgattatttctatactggggaaactgagcttaggttatgtgacttgacatcggttaagcaaaagtataatgaatatgtcattgattatattaagagatttagagatgttagaaaccgatgttatactttgaatataactgatagagatttggccggtcttgcttttaatggtttagttgctcctcttagaaaaaaactagacggccaacaatttcttgatgttagtcaactcatgcaaagggctctggctcaagaaagccgggctaaggataataaaaaatttgctagaccatttgacaaaaagcctaatgttaatgtagttgattaccctgaggctagtgatagtgaggaggagggtgatcatgatatttatgttgccgaatggtcgtggaataataaaaataagccttttgtttgctctaacttaatgccgactcctcgcaaagatcggcaaagtgaggttaagtatagttttgacgtggccaagtgtgataagatttttgattaccttttgcaagaaaaacaaattagattacctaaaggccatgtcataccatcgcaagaagagttgaagcgtcgagcatattgtaaatggcatgattctcattctcactctactaatgattgcaatgtgtttcgacgacaggttcaatcggccatagatgaaggacgattgaagttcaccgatggctccaagatgaagcttgatcatgatccttttccggtgaatacaattaatttcaatgataagaaggtgttgattcggccggagcaagccgaatctactaagggaaaggaagtggtcattggtgaaccaagatcaaagatgatggtgccaaagaagccggaggttggtgtttggaaggagaataagagtggagcttcaacttataaggctcctaggaagaccaaagtgacctttgatatgcttttggagaaatatgagaggcaaggtggtgagaaaattcgcaacaaagggaagagaccaagatcacctcctagggaacgatttggtcattcaccaagacggtcgcattcaccttcatatcatcatccacaagacatgtcatggggtccctatccgatgccgccgccgggttattcttatccctacttcatgccatggggggcaacgccgccaatgtaccatcatatgcctccaatgcaattcaaccaagggtggggaggaccaaggaggacaattcatgagcgtttgtcttcgccaaacaatagccggttctatggtaagaatcgggctaatgaagaaaagagggaaggaaagcgcgttaaggtggaagagaggacttcggaagtaattactatcaaagtgggtcccatgatgtgcctatacattctgtagatggagttggaaagtccccaagcaaaaaatccgaagccggtaccagctcctcgcagacggtcggtctgaccaggccctctggccggtctgaccgcggccatgttgccggtctgaccgggccatcaggccggtctgaccgtcgacccgatagtggtccgaccgacgcctcaggctggtctgaccgtgtgccacacgtcggtctgaccggcgcgactggccggtctaaccggtggtctacggccggtctgaccgggctccagcgccggtttgatgagaggattgtaaagagcgatgtgagggcttcatcattttcaagcaaagtcaatagaggacattatttacctcctggaacagagccgaatcctaggtggatgcctaaggatttgacggctactcaaaagagaaggttgcaacgtcttcggacccaagaactaagggagaaaaaggccgaagatcaaagggataaaaggttcaatgagttgcgaccaccaccgatatggaggcctaaatccatagagaaggcaaaaccgattgatgtacaggagaaggaagaacaatcggttgataaaagtgatttatctccaaaagaagacatgtatataaatatggtatatatgttgcctatggagttttgtgctatggatgaagccgaggttgctcaattctcattaggtcctaaagatacggtttttgagaagctcgatgaatcaaaccatcatatgaagcctctctacctcaaaggccatgtggatgggaagccggtctctaggatgctagtggatggaggtgctgctgtgaacttgatgccgtactcgttattcaagaagttggggtgcgaggatgatgagttgaagaagactaacatgattctcaatggcttcaacggtgaaccaacggaggcgaggggtatcttttcggcggagctcaccgtgggaaacaagacgctaccaaccgctttcttcattgtcaatgtgcaaggtaactacaatgttattttgggccgttgttggattcatgccaattgttgtgtgccttctaccttgcatcaatgtttaattcaatgggacggcgatgatgttgaaattgttcaagcggatacatcggccgaggttgcaatggccgatgctacttttgagtggcgtcatgggaatatccaatgcttatcggggagggatctttctagctatgattttattagtatctctgatggcaaatttgtacctatctctgtaaagccggctagtgtagcacggctaagccatataaatttgtataacgagtaaagaggctaatttagagtggttacaaaaaagggtgcaagaatatcggtctacaaagaacgatattggagaaaccgttgaagattttgatgaagtggagaagcttggacaagggtttacatcggccgatccattggaagaagtagacataggtgatggaactaaaccaaggccgacttttgtaaacaaaaacataagagccgattataaggttaagataatcaagctacttaaagagtatgttgattgctttgcatgggagtaccatgagatgccgggtcttagccgtaagctcgttgagaatcggcttccaattaaaccggtttttagccttataaacaaccacctcgtcgttttaatcttttactatatgaccgagtcaaagaggagattgatcagttgttgaaggtggggtttattaggccatgtcgttatgcggaatgggtttctagcatagtcccagtggagaagaaggggagtggtaagattcgagtttgcatagattttagagatttaaataaagccactcccaaatatgagtatcctatgcctatagccgacatgatgattaatgatgcctcgggtcataaagtgattagctttttagatggtaatgccggctacaatcaaatctttatggcggaggaggatatgtacaagacggcttttaggtgcccgggatttgttggtttgtttgagtgggttgtcatgacttttgggttgaagaatgccagtgcaacatatcaaagggcaatgaatttgatctttcatgatttgttaggtattatcttagagatctatattgatgatattgttgtcaaatcggatggtatggaatgacacatagcagatttgaggttagcttttgagaggatgcgccggtatagtttaaagatgaacccacttaaatgtgcttttggtgtgacggcggggaagttcttaggattcatggtgcatgagagaggagttgagattgatcctaagaagatagaaaaaattcatgatttcaaagtgctgacatgcaacaaggaggttcaaaagttgctgggtaaggtgaattatttgaggaggtttatttctaacatagtgggtaaaatcgatgcttttgttcctatacttcgcttnntntggtnngtcctagcncgagnagcattcaatnnggccac

SEQ ID NO: 6388 - DNA, 10528 bp, Oryza sativa
  unsure (1)..(10528): unsure at all n locations
cccatgattgcacttcgctcnngcncancccnngatagaatatgatttggcttataaaccattgaaatctataaaaggccaaattgtatgtgattttatagttgactatcatatagatgttgcttatgagggagaggtttgcttagttgaagttataccttgggagatttattttgatggttcttcttgcaaagaaagtcaaggcataggggtagttttgttttcacctaatggcatgtgttatgaggcatcggttcgtttagaatattattgcacaaataatcaagccgaatacaatgctttattgttcggcttacaagttatgaagatggttggagctaaatatgtggaggcctttggtgattcgaaattggtggtgcaacaagtcgccggagtctacaaatgcttggacggatcactaaataggtacctcgattcatgtttagatattattgccaattttgataattttgctattagacatattgctaggcgtgataattctagagcaaatgacttggcacaacaagcatctggttataatgtgaaaaagggattatttctgatattagaagagccggtgcttgattttaaatctttgtgcgaaattggcaaaactggagactaggggcggtctgaccggcgttgcacggccggtctgatcggtgaccaggggcagtctgaccggccgtatgctgccggtctgaccggcgaccccgagcggtctgaccggccctgcgtggccggtctgaccggttttgggcagagcgctggggggcacgcttcaatcgatttggaggccgaattaattgagaattcggatatttgtgtccaggatacagaagaggattggagaattcctttgattcaatatctaaaagatctcacgcttaaggttgatcgaaaaattcggcggcaagcattcaaatatacattgcttgatggagatttgtatcgccgaaacatagatggtatcttgttgaagtgcttagatgaagatcaatctaaagtggctatgggagaggtacatgaaggaatttgtggaactcatcaatcggcccacaagatgaattggttgcttagaagagcgaggttttattagccgaggatgattgatgattgcttcaaatattatagaggatgtgaggcttgtcaacggttcggcaatgttcaattggcgcccgccgctgtgttgaaccctataatcaaaccatggccgttccgaggatgggctttggatttcattggtcaaatttatccttcgtcatcaaaggggcataggttcgtgctagttgctacggattacttcaccaagtgggccgaagccgtgcctttgaagaatatgactcatacagaggtaattgactttattttgaagcacattattcatagattcggtattccgcaaacattaactacggaccaaggtgcttcttttatgtctaaggaagtgaagagttttaccgaatcttatggcattaaattgttgagttcttctccttactacgctcaggctaatggacaagctgagtcgagtaataagacattgttaaagctagtgaaaaagaagattgaggaacacccgaagaggtcgcatgaggtgctttctgaagcattgtgggcgcataggatatataaacatggtgccactaaagtcactccttttgagttggtttatgatcaagaagccgttttaccggtagaggtaaatcttggttctcttcgctatatcaagcaagatgatttgtcaagtgaagattacaagatgttgatgggggacaaccttgatgaagtcatcgacaagcgcttgaaggcattggaagagatagagaaagagaagaagagggtggccaaggcgtacaacaagagggtgaaagcgaaattgtttcaagttggagacttggtttggaagacaattttgcctttgggtactcgatccaaggagttcggtaagtggtctcctagttgggagggtccttattgagtgtgcagcattgttcgagggaacgcatactttttggagacactacaaggggagcgttttcagtaagcaatcaacgggaaatacttgaagaaatacttcccgagcatttggcaagacgcttaggaggtactatggccggtaattgggttatcgtcctaaaaccaaaaacatgttctatgcttttagattcacgttgttcatcaaaaaggcagggggcatgtgtttacacccaaatttggcacctaggattaaaataggaaatattgccaaaatttggaagtctaccggtttcctccgaagtgggccggtctgaccgccgtgtgttgggcggtcagaccgctggttgagggccggtcagaccggcgatgtgtggtcggtctgaccggcaggtccgagtccgactctgtttcgtcgggtctcgaagtttccttgctcaggaagacatgtttcgggtttcctttggtttctaccccgagttgaacgtggaggagggcctgtagagggtaagaccaacccctatataagggacatggtcggttcattgtaagaaaccaatctacaatcaatcaatcgaatcgtttttcatattgcttttagttttctcttagtttgtccatctttgtcggtttgcgccgtaaaccgtccgctgccgctgcgagagtgcgacatctctttgcaggtttgtcctgaaaaccttccgttttgcccacgagacgagtagctatctagaaatcggctccgctaggcggtttagttatcaaaactcatctaggtttagctctttgctagatcaaggtggttggtgactctaggatcaccacaaagcttaaagtgctgcgatcgtgcttatcaacttgttaaaaaagttgccaacacacttcttaccaccggacacaagacaccgcaaaaagaggcagcgcaaccagccaccgcacctttccccccctccgcgcgccgaccatgtcgtcgtcgcaagctcgccgcccgcgtttcccgaggggaccggcggccgccctcctgcgttaccagttcaagacagtgaggccaccgacgaaggacatcgtggagctcctgcccgagggagggtctcgcaccgtcccaaggagcgtgctgcacggaagcgcgcttgcggacgagaacaagttcaagtccctgagcaagatggagccggcgatcgtggcggccgcacaggaagatggcgatctggcggcggcggcggcggccgaggcggcgccggcgccggcggacgaggagtaagagaagcctgacgccgatgtggatctagctatcgtcaagttttttcatgtttcttagtatcttagttccatcggatcgagtaactgtactatgtttccatgttctggtatatctgtatgatgcatggaccagttatcgaaagatctttggcgctactgccttgttccaagcaaattaattctctatgcgtcatgaattgtgttcttggtgccgtctttgcataattaatttgtattcgttcgtggtcgccgcctttgcttgctcatccaatgtcatcgtcatcgacgtgtcctcgccgttgccggtgcgcgtgctcgccgtggaattggagccgtgtacatatcccaactgaattagcaggactagttaacccgtgcccttttcttgtcgatgtttccacaagtatttttttggataagttatataatttttttataaagtactacgaacagaacactttcttttgcaattaaaaaaatgcaaaaatatatgcagaattcaccactagtggtacattatctttttaactccaattacattcttatcttttaaattccatacgttgctttgcgccttgcatgttgcatgcgaaggagtacgtaccactggacggggcaggtcgatggcaggagagcggtgcaccaaatagaccaggaccatgatagttgcaagtgaaacgggcatggtggcccacatgtcgatcgtttaaccgcgtagaccgtgtccacgttgggatccaccagcagcagcaccggggggaccactagactcccagagcttcgtgtgatgtgaggcaacacaacgcggacaaaagcccaggtagactcattccaccagtgcatgatatcataggcaaaggagacctcacatatcagtagcacggtccacgaagagcagggcgtagggaggggagccgcggagcggcctctgacacgaccgggaatcccgggagaaaagcaatgcggtagggtgctaagggcggttagatggagatcgaacggccacggcgtggtagacaaccaaagccggctggtatcgcgggcgccagtgcgaaatgggtagtatttgaaattttcttttctttttcacaagtaacttttttcttcgtcctcctttcttattttttttgtaaatttgctcagacacaaaattccgatcctacgaaacaatattaagtcataggccaactgaatctaaacaaaacagaaggaacttaccttgatatatacgaaacgagagttgttcgagtttgctatcgacattatcgctttctataatataccgacgactttaacaattgtcctataatacaccattgggctataccttcttttcaaaaattcccaaaatactcttatgtacatacaaggttaacaattaatttatctaatttgaagtttcaaaaaaatatgaaaacttttgtgtggactccttacacaacatagaattttgtatagaagttttcaagttgtttatatttctattttttataaacaaaaatataacttatttgttaaatgctatatttttttgaaacttctgatgaaataaatcaattgttaatcttgtactccctcatctccaagatttgatttttttagggacgaagagagtatgtttctaagcatattttaggtatttttgagaagaaggtccagcccaatggcgtattgcacaataattgataaagtcgccggtatattatagaaagagacaatatcgatggcaaatcattgaactcgaacaaactcagtggtatagaatagattctctcatacgaaaagcagacaggtcacaaatattcataaccaacgacaccttaaaagaatactaatataacataagctaaaaccattgaaaaaagagtgcacagcaacaacatggtcaaaggcgatagtagagcaacggtgacggggaggtttgattctcgagacttgttatatctatccagaatttcttttctcttcttcaactcgaagtgtgatcttgtcaatgcttctttgagtggcatgtcgtacagacgactatgaactacaacatcacatatttttgtctgcggtgatatgtagaagagtccgcatttcaagcgacggtccttgtaccgtctgagcttgttgttgataacatctatcagatgatttataacatgtagctgcttcccgaaagctatccacctgaccaatcctaatttttgaagcttgcaatagtaatccaccattattatcttttgcacttgtagtattgcttcgcgtcccaatgacgttgtcttaaccatggtgcgatgctcactacaagcccatgtaccttgctcgtccctagcgcatagtctatacttcttttttctaatcttaaaccccttctttctttgtcctttcctgaagaaaaaaaaaacctggcgagtaagaggagaattaaacttcctaaaacataaacatgaaaaagctaaactggcgagtctaaacatgaaaagctaaattatggctacataaagaagaaagacgaatctaattgcaaattatgtaggaggaaaacatagatggatttgtaatttagctttgcatatgcacgtgtagcgacgactgacaaatacaattatactcagatgtcattgtgtgtttttattctcaaacatatttgcaaataatatttgcatatttgcgtggtcgtttggggattgaaagtctattgatacatacttgatgtgactgccgcaagttagattcttgtccattggctttgctttgagatgcaaacctgtgaatcccctgtcgatcgcggatgtcttttgttttttgatggctcgatcgtgaactgaacagtatatactagtagtatatatatcgtagtagatcatgacatcatgtatgtgtcctggttggtatccagaagctctttttgtcgtctgacattaaggtactacaaccgttcagttgtggggaacaaggggattcacagattaaactcgcttagttaaagataatctatctccaatctaccatatctttactattataaaaattaaaaatatttttattaaattttgtcacgtaatccgtgtttgagttggttttcgaagatggttcggccccttttgacgtttcgtccgtttctcgtcacgctggttccgtccgattaaattcatatcgatcaatctttttttttctttccaacgtcagcgttcgagtctgcatcggttgcgagcgaacgagaaaccgtgtagcttccggtatttttgaagcgagcgccgtcgttgtcagttcaactcctaaaaccatctcccctccgccaccgtcgcatcggcgccttgtctagtcgccgtcttcgtgctgcccgggagcagtaacaacagactgttggcccaaggaaattgggctaagctttcgctcggaaccccctaccgccgtggttcgtcgcctaatccgaaaccaccatctaaacatcagcggcacatggcttccgccacacccgaccgacgtccctccgccggccatcttccagtcctgccaacgacaagactgccaccacaccacaccgacgtcctgccatcggccgacttcattgaaccaccatccttgagagctggctcaggacccctccgttccaccacccgctgccctcctcaccagatctgaccgaaggagaacctgggactgggtggcattgcttcggcaacctgagcttctcccgctgacaagctaccacctcaatccagcctacaaacttcccgcaaagaaaaggaggagcaccaggaaggtcgagggtgccgaccaacaacgaaaaagatgacccaccaccgctagctcctgttgcactaccatctgggcctgcaccgacaccggaaacgctaccgctccggctctagcgccggcgccccctttgtccggcttccttgatccacctagccgcgccgcgccgcccacctagccgcagaaggcaccgtgacagcttcccagctgcccggccgctgaggcctggccacgccatctcgcgcctgcaccaggcctcgccgttgctagtcggaggaggcgtagggcggctgctcgtgctgggggcggaaaccgtaggtgggctacggaaggcttgtcggcggagtagtgtggggcatcgtaggaggtggagggagcggagcaagggtagccggactcgtcggagggtcggagcgggcggccatggggcggcaacgccgccgggcaggccacacccctgagccgccgcgcacctcgttcacatccacctccgcgtccagggcggccgcacaccttgctgccacgcaccaccgagccgccaccgccacccctagatggttgataatgtcacaacgtgtctttacaaatcactagctccatttttacctcctgtccactgtccacttcattctttcagtggagaaagatagcttcagatctccgtgattgctgtattttggaaccgagggagtgatgaccagagtttacattaccgtttccaacatgagaaccgttttcgataaaatgggccacgaagtatactcttgatctgggtctaaatttctatagtatcaccctcttaaagaccagtttaccattgttgacgagcccaacaaggcatatattaaccatcgaaagtagcccaattaagaaattgcggaaaaaataggcccagtccaattagcccattctatataatccccagccgcccacttcttccgcccttcacgcatctagggtttcgccgccgcctcttcgtccccgccgcgacgatggtacgctcctcgatctcgcgcccttctctcgtggaatccatgccggccggccgacgtttcgctgatgtgatcgcttgcttgtttcgtttcgccgcagccgtcccacaagaccttccgcatcaagaagaagctggcgaagaagatgcgccagaaccgccccatcccctactggatccgcatgcggaccgacaacaccatcaggtgatttgatttgcttgctcccctccttcttgctaagtcttttgctcctcccgcgttcgattcggcttaggcatatctgctgagatgtcgtggtttggtttgtgttgttcaggtataacgcgaagcgcaggcactggcgccgcaccaagcttgggttctgagcaggaggtggcaccggctgctgcctgcggattttgttttatggatgtttcagtgtttatgcaagcttaggatgtgattccatgatgctttttattaaggttttctgaaatgttaagggtagtagtactctggtttactgaggataccatgctatgctgtgctgagtaaaagaaccattctaatatatctgccttgttgaagttatttctcaggcttattctgtttcatttttaaatttgttattgcatagctggagaggtgaattgttctcaatatcgttgggagtatgattgctctattgttattctattgggctgttgttagagtagagtaggcacatcctaccaaaagctttccgtcacaaaatatagcaacctaggattggattagatgcggggtttgtctatatttgttggactaggacgtgtctaatccagttataggttggtatattttaggatggagtgggatccttatgcaggtcaagctgttggtataattcttctgtgtgtatggagtttatgtggattacgtggttttgcaatggtccttataggaaaacaaactaatgctgtgcatctaccattggtacaattctatgcaattgaagctaatgcaacttattttctgactgtaataatgttgcaaattgtgattgtctacgaattggcaaccatctttctcagatagttactagatctctttattgaacaatggcctcattgggactgcttgaaatatattattcccctgattatctacttgatcatagggataaattaaatatttttagaaacaaaatgaacaaatagtttagaacatgagggctacacaatgcagtagaaagtgtttgagaaagcatatttttagaagtgtggagcaaacactccacggccatatctgctggagtgtacatttttggtcgtacaacagtagtggaaccctttttttttttttgctgtgttctacttctatccatgttaaactgaaagtagtcaattcatgtgcttgttaataccaacatgagttctgtatcaatcatagaagactttggttatgtttgggctttatatttccatgctgtaatgcttgtgttctgctgtgaactatggtcatttgaccgagatatgcactaagggatcgtttatgcttgtttcattggtgtgctattctacatgagaatacatggatataatacatggcgaatcctcgccaactcgcgagcttcgtttgaacggcgagcttagggattctgatcccgcaattaaaaaaaataaaaataaaaaacaaagagagggagaaaagcttcggcctgaaaaggccgtggcctggtaacctgagttgggccctctcagcccatgggttgctgacgggaccggcccatataaggccacctatttcagccatcggcccatcatcatccatccaaagggcccaacaatggcaaaaaaaaaaaacacgtcggcagtgtagttttgtgaaattttaggaccataatatctaccacgtgccaaaatacatgtggttttgtatagcttgaacctaggatttattgaaattcaccttcctttttttaagggaaaactttgagcacccgcctcccccaggccgggcccacttatatctgatatctttcataggtcatagactgccctcacaggccaacacatgtcttttctgcacactttgtcctcactcgtgtgcacccgggaagaatttcccggtcggtcacccatcccaaattgctccaggccaagcacgcttaaccctggagttctttggagattggattccggaaaaaatgttgcaacttgttgatatgagtattctattaatcctattaagccctaggccgggatgttacaccctcaccccctcaagagagatcgacgcccccgtcgatcaaccctaggccagaaacgtcctctcttggccacgttcatgtgtccagtgccagcgcatgtgccatgctgtgtaaccactcccggtctacaccagccatgcgcaccatgcctgcgcaactgcgacacacacgctcgtgaaaccgcgagagtcggctctgataccattttgtaacgtcccgcctcccccaggccaggccctaggccgggatgttacaccctcaccccctcaagagagatcgacgcccccgtcgatcaacctaagtcaggaacgttctgttt

SEQ ID NO: 6389 - DNA, 39679 bp, Oryza sativa
  unsure (1)..(39679): unsure at all n locations
cacctagggcgagaacggtcttctctggcccacgttcatgtgtcaagggccaagcgcatgtccattgctgtgtaaccactcccggtctacaccagccatgcgcacaatgcttgcgcaattgcgacacacacgctcgtgaacccgcgagagtcggctctgataccattttgtaacgtccggcctcccccaggccaggccctaggccgggatgttacaccctcaccccctcaagagagatcgacgcccccgtcgatcaaccctaggccaggaacgtcctctcttggccacgttcatgtgtccagtgccagcgcatgtgccatgctgtgtaaccactcccggtctacaccagccatgcgcaccatgcctgcgcaactgcgacacacacgcacatgtcttttctgcacactttgtcctcactcgtgtgcacccgggaagaatttcccggtcagtcacccatcccaaattgctccagaccaagcacgcttaaccctggagttctttggagattggattccggaaaagaagttgcaacttgttgatatgagtattctattaatcctattaagccctaggccgggatgttacattggatggatcatggacagagacaatgtagctagggggtgtttagatggggctaaaactttttagcccatgtcacatcggatgtttggacgctaatttgtagtattaaacatagactaataaaaaactaatttcataaatgagagctaatccgcgagacaaattttttaagcctaattaatccataattattaaaagtttactgtagcatcacattgtcaaaatcatagcgtaattagactcaaaaaattcgtctcgcgaattagtccaaggttatgaaataggttttgtaattagtgtatgtttaatacttcaaattagtatacagacattcgatgtgacagagacttagaataagtccctggaaaccaaacaagaccaagtggcaactgtcaatgagcagcactgtagccatctcctaagagcatgtacaatagcagactataagcctaatataaacatattttaagaagataaaagagaatagcaatgagctacatatttgttgtcagctacaacacggactccaaaacacagtgtgtgtgacaggtaggactatgcgtcaatagtgtagtatatgtttataggtaactattgtatgaattggctattaaattgattatagatgatttggagttagtagttggctatattactaaacttggtctaataggaggaacactcaaattatggggataatgacagcacaggacaggacacacaagggatgcttctgtctctcaaacacatcatgcatgcagtgatgcagatgactcctccattgtctttctcaatcatgtgccccttgacaatctgaggccaatgagatcagaagaactcaaaagccacactcctaactactgctccctgtgtgcatctccatggatttggctggccccaacaactcgaggaacaacaggttttgtgtccttctggcgacttacctttcctttctgcacaaagactgggacagcaaactggctaaaagcaaagaatctgtgtcatggatgtcactggtgactcgtttacatgctcatcaaatcggaatcaaaacaaatgcagctatggaaaaccatcctaggtacctttagtaacagtaacataagcagtgacaaatgctgctaggggattagtaccacttactatcagtaacaaatcactagcttcatgtttacctgcagtccacttcattcttgcaatggagaaagatagcttcatatctctgtgatcactgtattttgggacagagggagtaatacattggctacgttagttcagacgacgtgaaagttcagagatttaggatgtgcatggacaagattgaatgtccggtgataaaatgggaaatgattcagcagaggaaggaatcaaaagatcgagtggtgtcacacgattcagaaaacgcagataggagcagcagctttcgcaccgagttcgagccgctggctgaatcatgcccagcgcgacacgcagacatgaatgcaagctgcagcaggcaggcaacagcaaacatcactggtcaagactcaaaagaacacactctttgattagcctccaatagaatcaaaagtacctaatacatggtgcattggtgaccagggtttacgtcaccgtttccaatatgagaaccgttttcgataaaaaaaaactgctgatttttggtcaactccgtacgaaaactagctgaaatcgatcggttttcacaaactggatcctagcggtttcacaaaaattgatcaaaactgtgaaccatggtggtggcattgcagagacgctgtcctaaataggatttaatctttcggtttagtcatttatataggggtggacaattttagaaatttcggtccgaaattatatgaatttttaaataaaatttaattaaatttgaacaaaatattaccaaaatcacgaaaatgaaaaaaaaatcagccgaaataatattatatcgagggtctgaaatttcgaaccctggtcctaaacctctgaacctaaacacaaccacacggtccaatcaaccaatcccggcctgaacctgaaactggggtgattgacagaaacacacaatgccctgcaagtttcagggagaggctgaccggaattggcaagtcatgtggaggcacatgccggccatgatgaggtgcatcctccctagatactactctcgtatcgtcgtcgtcgtcgtcttcatgttacatgttcatgtcacaacactcgcaatcacaagcgcacaaagaaaggacgcccgcattactctgatgatatgatcggttcttgcagcagctactccctccgtcccaaaagaaagacaaaccctgtatttttgtgtccaactttaactgtccgtcttatataaaatttttttataattcgtattttcattgttgttagatgataaaatattattaatattttatacatgacttgtctttttaattttttttcataattttttcaaataagacgaacggtcaaacgttggacacggaaattatgtttgtcttttttttttgcgacggagggattatagcatacgccatgatcgatcaccacgttaattatctgccgttttcggacgcttgcgagaacaaggcgccgcccctggcctacttggaagagtcaagcttagaggagaagaagaaaaaaaatttcaggtcgtggcattcgtcatgcttgaggagggacacagaactctatccaatcatcatcatactaatcaacctcttgtctgaatatgattgcttcagggattaagatagcaaactctggagagcgtcattaattggttcgttttttcagttatgaatcattcagaatcttcagcttggtggtgcactggtgcataaactactgtaatgcggattggaagatcggaaatgcaacaactatctcaaaagaattctcatacgctgatcaagagcaaatccgagatcaggattctgaataaaggctgatttttttttactctatgctggatgctaaatagcctgactaatgatactacttggtagtaatatacacgtactagtggtggtgaagaactgaaagaacacgtatgcattcggatgcagtgctcgctggtgcaagaacagagtgtgtgtgtgtgtgtcacacagtgctagtagcagatctccatggagaagttggagtcgagcagctcgtcgatcatctgctcgacgtgctgctcctcgaggaacctgccgctccattccgcgccgtacgtcgtggtggtccgcgcgtcgtcgtcggcggcggcggcattgccgagcggcggcgtcgtggcggaggccgaagaggccgcggcggcggtggcggcggcctccctctgccgctgcgtggcctgcacggacgccaggttgaaccggtggagcttggcgacgagcgcggcggagaggaacgacgaggacgcggcggccgccgccgccgccgcggtggcgtcggcgagcgggaagttggtgcgcgcgcggggcccgcacatgatcctcgccgcctcgtcgtacgcccgcgccgcatcctccgccgtctcgaacgtgcccagccatatccgcgtcttcctgcaaaatcaccccacggtgcaccaccatgagcgaacccctaaccaaccaagaaacgcacggcgacgacggcgaagaagaagaagaagacgacggtgtcgcgcgcgcacgtacaggagagggtggcggatctcggagacccaggagccccagtggcgctgccgcacgccgcggtatcgttgctgcggcctcgccatcagcttgtaggcttgtctatggcggcggcggcttcgcgggtgatcgtcgccggcggcaatgggggcagtgatcgagcacttcgccgacgtgggtgcgcgttgccaggttgcaggggagggagtgtggtgcgggagccatggaaatgggctataaataaggagggaaacgtcggaatctttttcattgctcggatggctgctcgggtggggcccacataaaatgcctcagtagcattgggtgtatggccactgggcccactagactgttttaagctcgtcttttcgcttatacttatacttataagttaaaaattgaattttaagttgattttggaatatgttcatcgaagtttattttttagcatttgcgatcgttaagaacacgtatataaaagtagtatttacaaattatttttcgtttgtaaatatgttgtttggcttttttaaaaaaaataagtgcaacgatgggccgtttgtttagtttagtttgctttggtttgattgtttggttgatccttcttgctttggtttggttgatctttagttgtgactgtgatctgtatattcttttgatttagttttacttgttagatagggaatagtaataaaattgactagtaagaccatcatgggcgtactactactttatctatttcctaggaatgttacagaagtttctttgaatagtttaattctgatcggatatgggaatgaatggatagagaaatcaattttaacctatttggaaatttgattaaaattgtagtatttaaagtaaatttttaccaacccatagtagaacaacgtacacgtattccaagttgtattttgaagaccggttcaaccttcaaaacacagattcaacaggttgtctgaactgatcgagttggattgtcagagatcaaactggactgaactttcgttcacttcacctatcacaggattaaagatttacttatcacagaagaggagatatgcagagatccagagacagatgcaaagaaaaatctcccatttgatctcactgactcttctccctgattatcagacaacccatcatgctgaagattatcatgccatttcgccatttttcctgtggccttgcccaagaacatgcaagccagacaaaataaacctcacatggacggaaaagagccatctgtctccaagcttgcgactgatcacacaccatgcatctatcatccatccaattttggtgtgtgctatccagaaaattaaacatatgtgataagcatgatatgatctagacctagctacccaacgtctcagacacaccacatgtgaccctttccctttcacctcatctatagctatagctcccctgtattaaatacaaagatgataaggaagagaccaattaaatggcaaatgggtcgtttgattctctgccattagtccaaacagcattcatgcatgcatgacatgaacatgccatttcgatgtgtatttaattaagtttgtaacttcgatttctgggacattccagatcaaactgaaactgtttgaaaacgagtacagaaaaagtatcggagaggagtcgaattcttggtctttatgattgattagttctgaacagaggatagagatttgtgagcttttaatcttgacgtacgccacatgacgatgcaattgtttcacaaaggtggatcaagttaatccagtcaattcagtcgccgaattttttaggaagactcgaagtcaccgacgaaatatatgctcgaagaatgaatattacgcatgttgactcgcaaatcgtcgctaactgtcccccactctgcttgtgatttttaatcatgatcaatatatcgatcgacctcaaagcaaaagagagtatccaaggaactgtcactgtgcactagctgctaatactacatgtatatgacgcttttaatttttagatataatatttgactatatgtttaaatttgacgtaaatataaaaagatataatttttttgacgcaaaaaaggatataaatcatatttaaagtacatttaaaaatattttttcgtaaacccgtaaaaagattgcacgtcaaaagtactttttaataataaaataagtattattctaacaagatgaatggttgaatgatatgtctaaaataaatattccgttataggacgttttaactttggttaaaatcaaactactttaaataaaaggtagtaatatttacagcatcagcatagtttcattaaatctataattgaataaatgttcataatatatttgtcttgggttaaaaatattattatttttttctataaaaattagtcaaacttaaaataatttgactttgaccaaagttaaaacgtcagtatcatatattttaaaacggagatactctatcattgtctataaatcaaaacggcccgaatcgacgacggagatcctagaaagaatcgagaataatcctccgcctaactcaatgaccgggtgagcacagaacagaaggaatttagacctaaccacgatataaatactgcaaccctctcgtaggtcagtgatgcatggtaggtaggtaaagccttgcaagctgcattgcagataaaaggaagaacatggcatccactgatgataagactactactacatggatgtgtatagggtctacgtacccaatccgtgtatagcctactataatagtactaggctactagcagtgcgtcatatcttacactaatccaatgaaatgaatacctccataagttactcccaacaaccatatgtagcatcaaaattcagtctgacattgcatatattggctccaaactcaaagtctgaagatatatggatggagtccgaaagacaaaaccaggaatcgagagttgcatatatatgcacatggatgatcaggacttgatgcatcgaggagtatgcaagcaagcatggatcggatggatggtccctggctatagctaagtaggctatagctatagctaggagagatgagctgagcatggatcagtggccggccgacgagtcgcgagttgcaatcgtctctggaatatggatggatcatgcatgttcacctccactgcgtcactgatcgatgctaattgctagctggtggacgaggggtgcagagagcggacgaaggatcctctaccgttgaagtcacgtgactttatcactgtcacgtggacccccgatgattcgtgggtttacatatcagtgacaaaagcaccgcgcaaatcaccagcgcgcgccaactttcgttgcatcgggaagaagaacgtagtgtagtaacaatgcgatggtatcgcgacgcatgtgctgcggccgtgtgcgtgcgtgcgtctctccgttgaatcgtcagctcgcgcagcgcacgcacgacgcgctgcggcgccggcggcagccttatagcctggaggctggaccgcgctcgctgtgtgatggcgtaggctgcagtagctgcagtgtttgcagctagctagcgcaacggtctcagcgagagctggagcccgcattgctgctggcctggctgcctctctctcgatggctctcgcaccacgtggagttcagtgcgcgacgcagataggataggcagggtttcagtgttccacagacagggacaatgcaagctctctcatgagcatagtagtacgtagtatcaggggcgcggattcaggaaggactaacagaagagaggccgaagaaactatacaaaactatagccctcttttttaatgggtgtatgataaaaaaatttagtgagacttaatggaaactctcatagttttaacgcttgtagtggtgactctacacgccgtcgctcccatggtagatccatcactgctagtatccaactatccatggtggtaatttgcaaatcgcatgcatgctcacgctccgatcgatcccctcgatgaagatgaatctgatcagacatttgctatgatcgctggctggaacactgaagcctgaagttacaactggtttattaacaatgagctaccatatcctgaaaatacaataccttgaaacttggagctatatatacagcctatttttttatataagctctcgtatagctgtaagcctgtaaatgtggacaaagttcagttcttgtattgttgtcctgttagggagcgctgcagatggccactggtttcagcctttcaggggccctccagaaaccacctagccatatttttgcacaaattttatcttgatttctcttatagttaactgcctgacacgtaagaaattgaggatcattccggcaaaagaatctagctctgtagctttagctcactagcttttacagtggatagctgctgttctttgtagatcccttttgtatctcatctgttccatcccctttgcaaaaagaagaagtgatcaactgaaatttagcaactaacaatttgttaacaaccttcttgccgaaaaaaacaggaggaaaatttctttcagactgtcaccaaagtcgagaaaaaccaggatcgatgcagtacttgtttagctgcaatgtcttttatgttttgctgcactagtctgtctgtctgcaggatcggagcacactgaaagcaagcgcagctgttgcacatgctgcatgcacacacactgaagaactgacggctgaaacgatggtccaggtgcataacgaacttggtcttggtgcaggtagagcctgacatagtcatgttactgtcaaaccacaagtcccaaccatcctatgtaatccaaaatggacaatggctcaatgtgagacagctgctacaacatttcacatttcaaggatatcttgaccaaagatacacttttctgacaatttctgtcattttttaattcccagcaaaccgtttaagctaccttaaaatctttgcagaaagattgtaagttgtccacaaggactactgtgatgaacacggcttgtctattcggagataactctataattagttcgcccatcattgtccggtatgggtattacttgttagcttgctgaagtgatcaagcagacctgatcatgtatggatgattgctaattagttttctgctggtcaattgcagtcattagccctcgcgaatgatccgcatttcgtgggatcttacttgacccgactgacacctaatgattgggacgcaatctaggctgctactaaatgaattttaactagttgcgtttgacaaagattaagacgaacagtaaacaccctaaaactctgaaaaatgaaaatccagtcaaaatatctccccttaatttcttctgtcacggcttcagctattcagctgtattttggggagatgcagaaactgaactttcagcgaacagcacgacacgcatcgttcgcatcacatatattcatatgccgtcatgaaacttcaatttgtcccctgcaaatcacggtgaattgcatgagaactgcctgccggtgagagtgcatggcaacacggcatgcagatatgcaatgcaagatgcaactcacctgaggatcatggcagacagaacgcaaaaacacccacatggctgcgattgcgacctgataaaaccggggctaacgatcatatacgagcagaatcagttaagcagattagcattggtccggagacagccactcatgcagcagatgatgctggggataagctagatgatcgccagcgactgcctgtctgcctgtgccggtgatcgcgatgttcttgcagagattgggcagatgtgaattcaattcaggcgaccgatcgatcgacggcagccatccagcactgcatcatctagcatctgagtgagatcgatcgatcgatcgaccagaaaaatccccatgtgacaagaaccaatccagcgattgcgatgtccacagggatgaagacgtcgacgcattatcgtctcctcaaagattcatgcattcatccatccatatgttcgatgaatcgatgtctctcgttcaagattgcatccatccatgcatgctggctctctgtgcagtcattttgcctgcagtgcaggacgcgtttaggagaggaggagatcgacataagctgtctttgagagggacatcttgtgttttcttctcgttgtttagggcgcgaacgcacgatcaagttgtctagctgcgacgtgcctacgaaaaaaaatgtaggttttcaggtgagaagaatgagataatggacggctccggaaattgcggtccgggcatacatatagctgggtttgtagatgatacggagtcggttgttattcaactgccagttgctaagtgactgtaggcccgttgaatggattgaaatagaatcttgattcgttctttgaacacacgcacgtaaaccctacccggcaaatcctgtacctcacaggtacctcactgtcgacgggtacgtcgcctaacactgaaagcacaacaccgttaaatcctagaaaattcgctcccatgtcaacgccgttaaatcttggaaaattcgctcccatggggggtcgaacccaggaccttaggtgctactgagacttttgtaaccactaggctacatgccccttcgctttttcccaattattataactacacgatagcacaaacactgccgcgttttggagcctcataggcatggtttaattattcggtttggccgattctatcataggtcaccaatataccgaaatcttggaaaattttgaacaaatgttggtcaatttttaacaaaatattaccaaattcaaaaaaatgatggccggaataatatcgtattggaggtccgaaatgaccgaaatctccatctggaattttaaaaaccctgcccatcggttgcttattggggaataaaaattaattggtaactaaatttttttacgtcaagtaagtaaaatttttatatatttattcataacgatttaaaagccaacgctaaaacaaaattacgtggaaaatatctaaacatcaactcgaaatcaattttgaaaattttaatttttgcttttgttttggcttattagaccaacccatgagtctcttaattgcagatgttggaaaatgttcgagatttttagtcttgtgtcaagataatttttcaagcttgtttagaacttggaagcgatggatttgacaacagaaaacataaagattctgttctaaaaaaaagacgatataaagattctgcctgaatgtagaattttcctaattttgagtggaaattattgagctgctttgcgtaaattcattacgaatcctactacgacaaggtgacctttcagtaataatcaaatgggccacgaaatataatcttgatctgggcctaaatttctattgtatcaccctcttaaagcccagtttaccaatgttgacgagcccaacaagccataaattaaccatcggaaagtagcccaattaagaaattgcggaaaaaaaggcccatcccagttagcccattctgaaccgcactggtgcccactatataatccccagccacacacttcttccacacttcacgcacctagggtttcgccgccgccgccgccgcttcttcgtccccgccgcgacgatggtacgctcctcgatctcgcgctcttctctcgtcgaatccattccggccgaccgaccgacgtttcgttgatgtgattgcttgcttgtttcgtttcgccgcagccgtcccacaagaccttccgcatcaagaagaagctggcgaagaagatgcgccagaaccgccccatcccctactggatccgcatgcggaccgacaacaccatcaggtgatttattcttcgcgctcagtctttgctcctcccgagttcgattcggcttaggcatatccgctgagatgtcgtggtttggtttgtgttgttcaggtacaacgcgaagcgcaggcactggcgccgcaccaagcttgggttctgagcaggaggtagcaccggttgctgcctgcggaggctagggttactgagttatctgcatcattttgttttatggatgtttcagtgtttatgcaagcttaggatgtgattccaggatgctttttattaaggttttctgaaatgttaagtgtagttgtactctggtttactgaggataccatgctatgctgtgctgagtaaaggaaccattccaatatatgtcttttgaagttatttcacaggcttattctgtttcatttttaaatttgttattgcatagctggaggggtgatttgttctcaatatcgttggaagtatgattgctccattgttattctattgggccgttgttagagtatgattgctccattgttattccatcctaccaaaagcattccgccacaaaatatagcaacctaggattggattagatgcggggtttgtctagatttgttggactaggatgtgtctaatccagttataggttgcaatattttgggatggagtgggatccttaggcaggtcaagctgttgatagtaattcttttgtatgtatggagtttacgtggattacgtggttttgcaatggtccttctaggaaacaaagctaatattgtgcttgtaccaattgtatgtatggggtttatgtggattacgtggttttgcaatggtccttctaggaaacaaagctaatattgtgcctctaccattggtgcaatgctatgcaattgaaactaatgcaacttattttctgactgttataatgttgcaaattgtgattgtctacgaattggcaaccatcactctcagatagttacttgatctctttattgaacagtggcctcatttgggactgtttgaaacagattattcagctgattatctacttgatcatagggatgaatttaatatttttagaaacaaaatgaacaaatagtgtagaacatgagggttacacaatgcagtaagttttttttgagaaagcatatttttagatgtgtggagcaaacactccacggccataatctgcaggagtgtacatttttggtcgtacaacagtagtgttaccttttttttttttgctgtgttctacttctatccatgttaaactgaatgtagtcaattcatgtgcttgttaataccaacatggattctctatcaatcatagaagactttggttatgtttaggctttatatttccatgctgtaatgcttgtgttctgttgtgaactatggttatttgaccgagacacgcactaaaggattgtttatgcttgtttcattggtgttctattctacttgagaatacatggatataatacatggcgatgatgcttttttttggttggatggtctgtctaggttcgtagctcagaagagtgtactagcttaaggatggggtcttgtttgtcacagcagtgcaaggtgtgttttaggtttgggttgactgtatgattcaatgcctaaccttttatgctgaactcgatcatatggtttggctatgtttgtatgagactacatgctagttcattactgtgaattatatgacgtacgaactggtgtaaatgatgtcattattgattcgtctactaagggccaagtttgggacttctgtccatttgtcttacagctcagtttgacatcaatgatctgtccattaggttttatgccaagttacatactaataatcttgcctgagctgtgagcacacttctacatttcggtgccgaatcatttcgttctctctgttgagattgttccgactgatgtttcattccactggcctttgaattagacgccgactgcaaattgatatacacatcttgctgcgtaagacgagtttacgtttgcctttatgagcccaaggtcacgtttgccatagccgcatgggttgtctagccgagcccacgaggaaattttatggccgcgacaaaatctcttgtatgctaagtgtattgccatcaattattgaaagaagtaagtcattgagtgattactcattaatttccctttaaaaggctattacctccgtcctaaaataattgtatttctaagattcaaaattcgtcccaaaataattataattctagagttctaattgtcccatcgatctcattcaaatttctccttattttaccatcaaccatcttctcactctcatataaacactatttaatgagaggtatcatatgctttcttctcaaatatttatatatgctaaataacatagaattacaattattttgggatggacgtagtattttattgtaggatgctaagtgtattgacaccagtcgcttagggtatcgggcgaacgtacgtacccacaagcaaaaaaaatcgcacctacactcgtgtgtgtatccggcggatccatcgacaaaaaatgccatccctatatatcctggtacgtctccttggtgcaaggccgtacgataggaacgagtttggaaaaccgaagacgttggtctgacacgtagacgactccggaacgaatttctccgtgtcgtcccgtcgtccggccgcaacaaaaaaaaaaggtttgaaaaccaaaagacgttgatctgacacggtagacgactcgggacgaacttgtccgtgccgtccggccgcaacgaaaaccaccaaacgtgctgcaatgcatggccattggccagcaatcaagcctatccggtgggtgcggacggacggcaggcgcggcgaacgggaggccagccgcgcgtcgcgcccggggagacacgcatgcaaatccaaagccgctagtggagcgcgcaacgttgccgagtccccgctgcttataagaggcggcgaggcggtgccacggccatctccgtccttccatcccagccgcgcgcgcgcgctcggactgacccccacccccaccgaggcaaagcctcgtactccttccctccaccaccaccgcgcgccgtccgcgcggctgcggctgcggctgagggcgaagccctccccctaccccnnnaccccaccccacctcatcactcaccaccaaactaataaacccgtcctcccctcccccccatggcctccatctccctcgaggacgtccgcaatgagaccgtcgacctcgtacgtaatatatacagtcgtgcaattcttttgtgcgttcgttcttagttttttttcttgttttgtttgtttgtttgcaggagacgatcccggtggaggaggtgttccagcacctgaaatgcagcaagcaggggctgtcggcagcggagggacagaacaggctcaacatcttcgggccaaacaagctggaggagaagacggagagcaagctgctcaagttcttgggtttcatgtggaatcccctctcctgggtcatggaggccgccgccatcatggccatcgtcctcgccaacggcggcgggaggccgcccgactggcaggacttcgtcggcatcgtcgtcctcctcgtcatcaactccaccatcagtttcatcgaggagaacaatgccgggaacgccgccgcggcgctcatggccggcctcgcgcccaagaccaaggtgctcagggacgggaaatggcaggagcaggacgcgtccatcctcgttcccggcgacatcatcagcatcaagctcggcgacatcatccccgccgacgcgcggctgctcgagggcgacccgctcaaggtcgaccaggcggcgctcaccggcgagtcgatgcccgtcaacaagcacgccgggcagggcgtcttctccgggtccaccgtcaagcagggcgagatcgaggccgtcgtcatcgccaccggcgtgcacaccttcttcggcaaggcggcgcacctggtggacagcaccaacaacatcggccacttccagctcgtgctcacggccatcggcaacttctgcatcatctccatcggcgtcggcatgataatcgagatcatcgttatgtacccgatccagcaccgcgcgtaccgcgacggcatcgacaacctgctcgtcctgctcatcggcggcatccccatcgccatgcccaccgtgctgtccgtcaccatggccatcggctcccaccggctgtcgcagcagggcgccatcaccaagcggatgaccgccatcgaggagatggccggcatggacgtgctctgcagcgacaagaccgggacgctgacgctcaacaagctcaccgtcgacaagacgctgatcgaggtgtacgggcgggggctggacaaggactcggtgctcctgtacgcggcgagggcgtcccgcgtcgagaaccaggacgccattgacacatgcatcgtgggcatgctcgccgaccccaaggaggcccgcgccggcatcaaggaggtccacttcctcccgttcaaccccgtcgagaagcgcacggccatcacctacatcgacggcaatggcgaatggcacaggatcagcaagggcgcgccggagcagatcatcgagctgtgcaagatgagcaaggacgccgagaagaaggtgcacacgctgatcgaccagtacgcggaccgcggcctccggtcgctgggcgtgtcgtaccagaaggtgccggagaagagcaaggagagcgagggcgagccatggcagttcgtcggcctcctgccgctgttcgacccgccgaggcacgacagcgcggagaccatccgccgcgcgctgcacctcggcgtgaacgtgaagatgatcaccggcgaccagctcgccatcgggaaggagacggcgcggcggctcgggatgggcaccaacatgtacccgtcgacgacgctgctgggcgacaagagcagcgagatgagcggcctccccatcgacgagctgatcgagaaggccgacggcttcgccggcgtgttcccggagcacaagtacgagatcgtgaagcgcctccaggaccggaagcacatctgcggcatgaccggcgacggcgtgaacgacgcgccggcgctgaagaaggccgacatcggcatcgccgtcgacgacgccacggacgccgcccggagcgcgtcggacatcgtgctcacggagccggggctcagcgtcatcgtcagcgccgtgctcacctcccgcgccatcttccagcggatgaagaactacaccatctacgccgtctccatcaccatccgcatcgtcctcggcttcatgctcgtcgccctcctctggaagttcgacttcgccccattcatggtgctcatcatcgccatcctcaacgacggcaccatcatgacaatctccaaggaccgtgtcaagccgtccccgaccccggactcgtggaagctcaaggagatcttcgccacgggcatcgtgctcggcacgtacatggcgctcatcaccgccctcttcttctacctcgcgcacgacaccgacttcttcacagtattacaaaacacatagtacattttatacgttctcttagagcagagcctctttgattcctttgtatcctcctattataaaatgactggaaaaaaaaacgcaggagacgttcggggtgaggtcgatcaagacgaacgagaaggagatgatggcggcgctgtacctgcaggtgagcataatcacctgggagagtggtgggctctgcccccttcccgctgtttggagtcgtagtatccgagtcttttttttttcccttggtttttttgtttccctcctcttttgatataagtcggtctggtttagtgcgttgagtaacatatattcttttcttctgatatattgacgtgcaatctttttacgtgttcgagaaacaaaggtgagcataatcagccaggcgctcatcttcgtgacgaggtcgcggagctggtcgttcgtggagaggccaggggcgctgctggtgatcgcgttcctggcggcgcagctggtggcgacgtgcatcgcggtgtacgcggagtgggagttctgcaagatgcaggggatcgggtgggggtggggaggggcgatctgggcgttcagcgtggtgacctacttcccgctggacgtgctcaagttcatcatccggtacgcgctgagcgggcgggcgtggaacaacatcaacaacaagacggcgttcgtgaacaagaacgactacgggaagggggagcgggaggcgcagtgggcgacggcgcagaggacgctgcacgggctcaaccagtcgtccaccagctccgacctcttcaacgacaagaccggctaccgcgagctctccgagatcgccgagcaggccgcaaagcgagccgaggtcgccaggtaaaaacttgctctatcccatgatataataatggcaacatatcctatgcacacaggccctcacgtgtacacacgtgcacaccaactaaaaaatgtcaccaaaaaatctagaaaaaatcatacacatactttcaattgtattacacctaagattaaaatcttaacgtcaaattcattatattttagccgtaacaaaaaaaacaaagaatctgacagttttaaggttgcaattttgttagaattttatcttttttgttattctctatgtagaataaatttgaagatgcgactttgcacgtagatgtaatactattgaaagtacatgtatgaatttttctaaaattttttgtgataatttttagttggtgtacacggtgcgtacacgcgagggcctgtgtgcataggatacgctccctataataatacagtactccctatgactcccttaacttttttatcaacgtttgatcatttgtcttatttaaaatatttatgtaattatcatttattttattgtgacttgatttatcatcaaataatctttaaggcatgacataaatatttttatatttgcacagaaaatttgaataagacgaatggacaaacgttgtttaaaaaattaacagcattatacattgaaatacggaggtagtacatagataagacattatctagattactactagtagaatgtcttgtccggtactacgcttctatattacgggaccgatgtagtacattctctgtactgcaaccaaccaatgttcaactttctagctagcacactgcttgatttctcatctccatggacagactgagggagttgcacacgctcaaggggcacgtagagtcggtggtgaagctcaaggggctcgacatcgacacaatccaacagagctacaccgtgtaacatacagcatgccatcgatgtgttgttgttgttgttcatacctgtgttttactcctccccatctgcaagttatttggagatgggggtttcgacttgtgttttgacatagatgtttcttcccttctttgtattttgttaacagggaatagttcccgatacaacaggtggtgcacttttgagtatagtcaagttatttgtaagattttggctttaagccggtttttttggcaatgttattgttcccattgcagatttgcagtctatcaactttgcctcaactcagtctgtatactactgtttagtcaatcatcatcagttttgacccagcaaaaacatgccctgattactcagctgaattctgctcctttaaattcttgtctgggcactgcagaatattagccatttatatccatgaattaatactgtagtttaatacattagccatttcagaaccctggttacatggtttcactacagttacatctttaatactgtagtttaactacagtttcatcaaggacggagtgcatttcttctactcttgcagattacaatggtcatgtcagtgatcaaccgaaactcaaacatgtccttgtcttctcccagagattacagtttcagtgaactcatagccttatacagtctgaatagaagttgtcctcgatttataaatactccacagttcacctcaagccttccggacaatgacatggcgctctctcttgtactccacttcatccctttggtgcatgatcagaagggctcttcgcacctgaagcagccgaatggtagcataagaaaaatgatactaaatcaattaattaaatagcaaatagtatgacaggttcctcacaatggattcattcatccccatcctatttagttcatcgatcaggcgtcgctcggatatgtggcttccaattcccatccttctctttatttgtgcctcagcttgctgttggaacaaaatgggcaacaaaattcagaaaacaaagttgacaagttggcagttcacttttggatgggaagattaaccttgatctcatttgcaatatctggtgataggttcaaatgctcattgattccagatcttgcggcatcaacagtggagacattgaacagcctaaatgcctcttcaacatgctctggtgtagccacacttgtcctgataattattcaaagtgccaattaggaacattataaaacatgtaagttatgacccactggaaataaaagccaatatgtgaaaaatgtaagatataaatatactgctagttgagctactcgcaaaaagaaatgtcaaatgtatagtaatgctatattctcacaatctcatctttgcaagagattcactcaaacgtataatggcttcaagctgccgcacagtgatgggtatagctgcagccctccctgtttcatgagcttgttgtctcattttctgcacaatgaaaaaaataaataagtagaacagtcttaataacagttagactaagtgaaaaatctttagcacgtgcctgtctaatctccacatatttgttctgaagcatctctgctgccttttctgagagtcgtggtttacaagtaacacggcaatactcaatgtacctacacatgtgaggattatgcatttacaatccaagaacatcatatcaaaactgtgtagtatgtatatcagaacatagaaggccaaccacacctttttagccaattctctccttcactagcatctgtattcttggatgaagcagcagcaccactggcatgcaccttaatgatgtggcttgcaattcgctgcaattggaagtttatttagtctctgaagcacatcaatgagctggacaaagaataatgcgtcataccttgtcttgatcatacattctgacatctttaacaataaagattagatcaaatctagaaaggatggttgtctgcagatcaatgttatcttgtgcagtctgaggagtagcaatagaaaatgtgtcaaactgattgccttgcatataaggctagaactgttaatacattttcaaaatatgaaaatagtacaagtcaataataaaaactttgactgaccttaagatcatcgtagcgccctgcaattggattggcagctgctagtaccgaggtccttgaattgagtactgttgtaatgccagctttggcaatcgagatggtctgctgttccattgcttcgtgaattgcaactctggaatcacagcataaaggtaactcaatatggtttcaactttgaagagtaaggaaaaattacatgtgcaatgcttattttagtttctagaaagaagactatagatcaatgcttaccggtcctcaggcctcattttgtcaaactcatcaatacaaacaactccaccatcagccaaaaccatggcccctccttccaaataaaactctcgctgtacagggaaaataagtcttttagttctaggaaacagaactttgagtaaacacaataatccttgcagggaagacaagcttacagagctaccgtcccgaattactgacgctgtgagaccagctgctgatgaacctttcccagatgtatagacagcaatcggcgctgtcttctccacaaacttgaggaactgttggaatgtacagtttcatgtcactggactagagataattcatttctaatagcgaaaaaacacttgcctgtgattttgctgttgatggatcacccagcagcaagacatgaatgtcccctctcaaacggacaccatccggtagcctctgccatagaagaaagtttagttacagctcattccaactagccactggatccaacacaactttgtattttcacatattagccactgataagatcaaaaatataccttctttgagccaccaaacagcaagcatgcaatagctttcttgacatcagaatggccataaattgaagggccaatcattgagcaaatcttgacatatgcatctggcctctgtgcaaattctttgaattccatttcctacaaaccaacaagaaaattaacattgtaaatatgctgtaacactcttaaaaaagaaacttggaattttggcaaagcaatctacctcatcaagtgtaaaatttgagggaccattcgagttggcatctcgggactgctccaaccccacaactctaatgtaaggctgtttgactccaacagcacccttttggctgcaaaatgaatatttgagcgtcatcagctatgcaagtagtctagctcaacaaaatggaaacaaactgagcagatgttttagatccaacatactttgcagatgcttggtagacactgtagataccaattacagttaatctagttccaggaacaatggtctgaacaagatgcctgtctacggacagcagcatattcctcgggagctcaccagttggaacatcctgttaaccaagtaatatacagcttggtgattgctaaatcctaaggacatataaccaataaacctagaaaaccatagcatcgcagcgaggacatataatgcagtaacaaacctcaggattttcctgcaatttgagggtctggagatccacatacttgctcttatctggaactgcaatccaggggtccaaggggcaaggctcttctccaggctgaaaaatggtaaagaaaactcactcatatacatcagaattaaaacacaaacaagacaataacccaattatgtttagccggagttagacctgaggaacatggtcgcacgatcgtgggacaatagccccaccaaggccaggcctacacggcaccgttttcacacttctgcagttcttgcagagcagcgtgacatgagtggccttagctttcaccctcgacgcggcgattgtgatcccggcaatcttcaccagcttggacatgtaatccgcctggaatttggaatacagttgtgtcaatttgaaattcttcacaaggctactaacaaaatcgtttcagaactgaccccaatagacctcatggacaggcagttctcctttgaggacaagaagatctgcacgtcgccggtggcgggctcctccatctcgccggtctctccagcgaccttggaccgaaggctcgcgaggacctcggacgcagccgtctcaaactacacaaaaccctaaatcttaacacaaaaaattgacatcaacagaacccagagccaacaaaaattcagaaagaaccagcacacaccagcggtaggtaatcagcgggagacttccggatcttgtcggacagctcggcgtcgaaggcgtcgaggtcctcgatggcgacggtgacatggtcgcggttgtgcaccaggctctcgctgcaaccatcaaacaaaaacacactggattggtcagagcgaattcgaccatccgacgaggcaccagatctgggagggagggggggcgcaccggtaggggaagtcgccggttgggccggtgaagccgcggaggaactccttgaacttgcggagggcggagtggcgggtgaggtcggcggaggggtcgccgccggggccgccgcgcgggaactgcgcctggtcgctgtagaagacggcgccctcgtcccaacccgacatggctggatggctggctggctgcggcggcggcggcggcggagagagagggagagagacgcgtgggtgcgcgggcggcggggaaaggggggaagacgccggagaagtggcgggaagagggtaatagaggaggagatttggcgggaaactgggggagatttggcgggaaactggggaggtagggtagggtaggagaccggagaggcagctaggcaggccggtttttgtgggcctgggctctcatagcagggtgctaaaggagtagaatgtgccattttggcccaaaagcatggcgatttgccgatttttagagtaaaaagtatagttggggtctctcatttttttgtcgcggagttataaaaccgtcgttgaaccgtaaaaccacacacagtatatcatataacttataaaaccagcgaaaataagatcccttgacggtattgtccgtagttttgattgatgtgatgcctacgttgctcctttaactaggtttttgtctcacgtgatattgacgtgacgcttatatgataatttgatcccgaaaaaaaaataaaaagatatgacttgaaaaaaaataaaacataatatgcggagccatatatcagtcaaacaaaaaagataaaaaatagtgggacccactaacccacttcctccacctctatctcctctcttcgccgacgagccaaagctatccggagttagtgcggaggcctgccaaggggacggagagcccagtgagtgtgcacggagagagaggaagcaaagaggccggtgagggggcaaaattcaaatccatcgtcgcccaacactacatccaccacacggatatggaggcggcgaggaggctcctccaatgaagagtggcaagtccaaattcgccgttgccaacatcacctcaactgcatggagagggagaaggcagggaggccaacgagctcctccaagtctaaatatgccgtcgacgacaccacctccaccacagtcgtcgctgccaccaagcacaggagagaagcaagatggcaactctgatgttgagggcaatctcgaagctgtctcaccgcttgctcagacgacgcatgccaccggcttcggtgccaagatcaacgacaacgacggccaccccgctgcatctagagaaggagaggggagaaggggaagaaggccaccggtcgcatctgcgagggaggctgccatcctcaaaaccaaatggttttcgtgaaaacattagatcttggtttgtaaaaaaaaagagtcggttgatattagccaatttttatataacgtgcgtaagggctggtttagatggcaaaattttttattttggggtgtcacatcgaatatacgaacacacattcgaagtactaaaacgttgtctaataacaaaccaaattatagattccgcatggaaactgcgagataaatttattaagtctaactaatccatcattagtgaatgtttactatagcaccatattattaaatcatggtacaattattaggtttaaaaaattatcttgtaatttacacatgtaattgattttttattaaaccacgtgatgggtgtaaagttttttttgttctggtaaaaaaaccaacaagcccccacatcccaccgattctgaattttcccaggaatctgagcggccgcaaggcgtcacgcgaaacccgtccaacccaactccactccatcctctgcagccgcagttgtgacggagactccaaggccatcaccatccacccgctctcctcctcctcctcctccgcttgatccctccatctcctcgatcgatctccacactccactgcgcactgcaccagcaacgcccccccctgatccctctccacggctgcaccggagatggcttccgcccccttcgccgtctcctcctcaccggcggcttccgccgtggccgcgcgctccaaggcacgggacactcgtcttactcatcttctgtgtttggtttccttgatttggatttggattttttttttaattaactcatgccgcggttcgttggtgctcgcaggtgttgcgaggagggaggagcgaggcgaggactggatgccgcctggggatcacgaggaaggtggtcgcctgtttggattatgatttctgcctctagcttgtttagttgatggtttgttttggatggacatgggttctatcgtctatcttatctgtgatttaatagtgatactgattgcttcctccctcgattagaaattatggtttgtttggtttcactatgaatgactacctgtcagttggcactgtgatctcttttacgacaataatagtaattcacgattcaggagtttatctgctttttgggtatgatatctctgctaatttaatgctcctggagctcttctaatcagggatgggtggctcttaattaaggttttgaatccatactgtcatatgttgacacctaaaagctctttgatgtagaaaataaaatcgaaatgatatatagaaatcggttgagacttgagaacacgcagctgctgaagcatgactaattatcaagctgctaataaaatttggcgatggccttcattggaaaggcatggtgttttgatcctgtaacggaattctgatattttatgtttgttaggaactctcaactcttgagaaatataaaattgactgtatcgagatttattccatgtcaagcttcagcatatggttgtgctttggattaacatcctttcattgctattctgttgcagaattttggacgtgtcatgatggcccttgcagtagatgtctctcgttttgaaggagtgccgatggcccctccagacccaattctcggggtttcagaagcatttaaggcagatcaaaatgatctgaagctcaaccttggtgttggtgcctatagaacagaagagttacagccttatgtcctcaatgtggtcaagaaggtaagtctaataatacctatcatttccttaatataactcagttcttgttgtgacacactattcttacacgtggtaggctgaaactcttatgttggagaaaggagaaaacaaggaggtatggtgtattttccttcaaattcaagtagctggattataaggaattatttctggagttttctgtatttctgtttctgaaggttgatgacaaaattatgttttttttggtgcagtatctgccaattgaaggcttagctgcatttaacaaagcaactgcagaactattgtttggagctgataatccagtactcaagcaaggacgtgtatgtgctgtggcctatgcagctcttgctgtacttattttgtaaatactaagattttctggaatgctgctacagcgaagcatgtccttatatttagtaaacattatttaatgataattccttctgtaggttgctactcttcagtctctctcaggaaccgggtcgctgcgccttgctgcagcatttatacaaagatatttccctgaagcaaaagtactgatatcatctcccacttggggtatgtatgtgaattaatgtgcttaatctttgagcattcaacttcatttttcatagcagagtgtctcattggcaaactttgaactccaatctatattcttacaggcaatcacaagaacattttcaatgatgcaaaggtaccttggtcagagtaccgttattacgaccccaagactgttggcttggattttgagggaatgatagctgacatacaggtcgtgttttctaactcatttatattcaatactactatctgtgttttctattttaaacttgatgagcattgtttagcataactttgtcgttcaaattggcatgtatccatcatagaaatttacacctgtcacttgtctgtttactattgttaattgtcaattttctgtttactattgttaatttctatgtgttgagtattggtttgtgatattgatttgtgtgtccaataggctgccccagatggatcttttgttctgctgcatggttgcgctcacaacccaactggaatagacccaactccggaacaatgggagaaaattgcagatgtcattcaagagaagaaacacatgcctttctttgatgttgcatatcaggtgaaatgttctcactttattatttcgtttttctctgcatgaaaacaaatatcttactgactagcaaatatttctctgcagggttttgccagtggaagccttgatgaagatgcatcttctgtcaggctttttgttcaacggggactggaagtgtttgttgcgcagtcttatagcaaaaaccttggtttatatgcagaaagaattggagcaataaatgttgtctgctcaacacctgaagtcgcaaacaggtgatactttaatctgaatgattgccttcgtagtcaaattgttcgtttctatccagttattgcagcgaatgttaataatagattattctgtttagtgggtaatatggaccaacctcttattgatgtgcaaagcaacttgatttttcatggtaggttaacaagacttctaagcaaatttcatccaggcaaaaaatgttgtaaattcttggaaattagtgttatgtacagattaatagacactagtttttactccagaaaagaaaccaccagcaacaataattggtctcaacccaaacaagcaaagcactgaatttgatgttaaccataaacaaaactccacagacaagatgtatacttcaaattttctcttaaatcaacatgtggcataagaaccacagttcttgatccacttcagtggtatacaacatatccagtgtggaaaatctcatgaatactggtacatggcatttactttgctttttatataagcctgcacacacacgagagtcctaggaccacacaaggacaacttaagatttgtaacgtgagctcagatttgactagcgctagttcatctagcccgtgtgattttacaaactcggtaagaaaattaaactatataactccagtttggacaaagacaccaaaccaactcatcatagttgattttcctggttggtaacttccctccttgatcctctcttgcttatcgtgcataccatacaggcatacacagcttccatgcaaagtacatgccatgtgcaaaaatgccatcctaatgtttgcaacagttgctttgtatgaatcaatacaaaatagtactcttactgtgacactgcaaagcttatttttaactgaaattcctttccttgcagggtgaagagccagctgaaacgattggcacggcccatgtattcgaatccccctattcatggtgctaggatagttgccaacgttgttggggatccaaccatgtttggtgaatggaaacaggagatggaagaaatggcagggcgtatcaagaatgtaagacagaagctttatgatagtttgtctgcaaaggacgacagtggcaaggactggtctttcattctgaggcagataggcatgttctcctacacgggcttgaacaaaactcaggtgacatatgctttaaattttcacagataacacttccattcttctatcgactggtgatttctccatatataatgtgactgcaaacactgcaattcacacaatacactaagtattcttaatttgattcgtttgtatttgcagagtgataatatgaccgacaaatggcacatatacatgacaaaggatgggagaatttcgttggctggattgtccctggctaaatgcgagtacctagctgacgccatcatcgactccttccataacgttagctagacgaggattcaggtcactgctattgtggttaatccttcaatatgctgggatttttggttccttccagcttgagttcttagccaggattgtatatccggcgctacgtaatttggagataataatgaattttgtctgtgcaacaaactttgcatatgctttgtcgaatgtacactggcactatgttagaagcttgaaatatcgaattgaataataatgagactagcaataagccaaactaattccaattttacctggtctgcatggttcattcttttatgctcattgctgacaaacaaaactggcccaagccgtgccatataatgggtctggttagggagctttgtcagctgcagtttcttacagaattaaaagctccctaaacagtttttccagaattaaaagctctcctatatagtttagttttccattcagattataacttcagattttaagaagttatagttatagaatctaaattgctgtaaatgaattaagaagtcagaagccgaaaaactcataatattctcataagctagctgcttctcgaaattaattttaagcaaagtaagtaaacccaatatcactgaccagcctaccaagcactcaagcagtacacaagcgcatgggaagcccaaagctggcccagccgcgacgtgctgtcctagtcaacacgactttgacccgttccattcttctcttccatgtgacatgcgaggatttcacttgacaaaaaataaactgaagggaaaaatcgaggaaacagggaaaaaatgttgggctgtaaatacaacagtatgtgtgtgttttatgtgctggcccatctgctagagggcccatctagtcatgtatatgtaaataaggatagcaatacagagaaggtgaagcttccagagaaaattggctgccaaaaaacttcatggtatcagagccgaccggccggcggcaggcgacggttgaaccctagctggccggaggcgtggaggcttgagcagggtagagagtgcgcatcagcagcggcgcggaagagcggggccagcgcggcgcgtcgaggaggaagaagccgagcagctgcaggtgcggagctgctgctgctgcttggggctgagctcgcaggtgcatagctgctttgggctgaggcaagaaagaaagtgctggtaaacagctggtgttggtgctcctcaggaagaagtggctcttgctctgtagtggcggggtcacagcacagtgaagactttgcatctcttgtgggtgtgtgattggcaaggaaaccgaggtaaaagcacagctactgcttttgtgatattgactatttgagcaatctataggaagggaaaggtagaacagggggctcagatctgctagttgggtttctactggtttgcagtttcagaatttgcattatggcagaaaatcaaggaatagaacaagtgatgggtaaattggtggacatgctagcgaaaaaatttagtgaggcctcaactacaagcaatgcaattatccctcatactgaatcaatactgaagattgagttaatgcaaaacgaaatcaagttggagggtgtcaaaaattatttgagttggtcaaggagggcattactaatactaaaaacaaaggggttagaaggatatgtcacaggagaagtgaaggagcctgagaacacatcaagtgtagaatggaagacttggagcactaccaactctttagtggtggcatggttgttgacttcattaatcccagctattgctacaactgttgagactatctctagtgcgagggagatgtggaaaactcttactaaactatactcaggagaaggtaatgtgatgctaatggtggaggcacaagagaagataagtgctttgagacagggggagcgctctgtggcagaatatgtcgtagagttgaagagtttgtggtccgatttagatcattatgatcctcttggattagagcactctgattgcatagcaaaaatgaagaaatgggttgagcgtagaagggttattgagttcttgaagggtctaaatccagagttcgaaggaagaagagatgcaatgtttcaccaaaccactcttcctaccttagatgaggccattgcagctatggcacaggaggagcttaagaagaaagtattgcctagtgccgcaccatgttcaccaagtcccacctatgcaattgtacaaggtaaagagactagagagtgcttcaattgtggtgaaatgggacaccttatgcgtgattgtcatgctccacgcaagcctacttatgggagaggaagaggtgttgatagaggtggaacaagaggtggaagaggctatgctggtaggagcaatagaggaagaggttatggatatagaggtgattacaaggctaatgcagttactctagaagagggttcttccgggactacacctgacaatgttgccaactttgctcattctacttcaggtagttttaatcaagcatttatgtctatgaacacttctcattcaagttggatattagactcaggtgcatccaggcatgtcactggcatgagtggagaatttacatcatataaaccatattcatttgcacacaaagagaccattcaaactgctgatggcacatcatgtcaggttaagggggagggcatagtgcaatgtactccatccattactttgtcatcagtgttatatgtcccttcttttccagtgaatttaatttcaataagttctcttgttgataatatggattgtcgggtttcccttgatcgtgagaattgtttaattcaggagagaagaacagggaagaaacttgggattagtatcaggcgtgatggactttggtacttggacaaaagaaggacaaatgaggatgtgtgtgcactaatggcttcaacaagtaaagaagtgactgaggtattacttttgcattgtcgactaggacatatatcttttaaaattatgagtaaaatgttcccggtagagtttagtaaagtggataaacatatgctgatatgtgatgcatgtgagtatgggaagcatactagaacatcatatgtgagtagaggacttcgcagtattttgccctttatgctaatccactcagatgtgtggacgtcgcctgtggtttctatgagtggaatgaaatattttgtcacctttattgattgctattcccgcatgacatggttatatctcatgagacataaggatgaagtgcttaaatgcttccaaaacttttatgcatatattaaaaatcattttaatgctcgggttcagtttattagaactgataatggaggggagtatatgaatagtgaattcggtcactttctttctttagaaggaatattacatcagacttcttgtcctgatactcctccacagaatggagtggctgaaagaaaaaatcgccatcttttggagatagctcggtcactaatgtatactatgaatgtacctaaatttctatggagtgaggcagtaatgacggcagcttatctcatcaaccgcacaccatcaagaatacttggaatgaagacaccatatgagatgatatttgggaagaatgaatttgtggttccaccgagggtgtttggctgcacttgttttgttagagatcatagaccatctattggaaaacttgatcctcgagctgttaaatgcatctttataggctattcatccaaccagaaggggtataagtgttggagtccatcagaacggcggacatttgtaagtatggatgttacgtttagggaatctgttccattctatggtgagaaaacagatataagctctttatttgttgatcttgatgatttaactagaggtgaccatgatcaacaaaaggaaggtgaaatcttgggtctcaaggagaatgaacaatcaaagggaaagattatggttggtgaaattccatgtgctataggtgatcctgtacaagaacaagaatggagaaagccacatgaagaggaaaatcttcaagtttacacaaggagaatgagacttccaacaactcaacaagttgaagttgatgatcaagtatcagatgatcttactcatgtgcaagtgtcttcggagtcagggggagaacaaatagaaattagagaagaagaatcaaacttgccaattgccataagaaaggggatgagaagcaatgcaggcaaacctccacaaagatatggttttgaaattggagatgaaagtggtgatgagaatgatatagccaattatgtatcttacacttccttgtcatcgacatacaaggcctttgtggcatctctaaattcagctataattcctaaggattggaaagaggcaaagcaagacccaaggtggcatcaagcaatgctagatgaactagaagctcttgagaagaacaaaacatgggatcttgtatcctatcccaatggaaagaaagtggtaaactgtaagtgggtatatgcagtgaaacaaaatccggatggaaaagtggagaggtacaaagcaagacttgtggctaaggaatatagccagacatatggaattgattatgatgaaacgtttgcaccggttgcaaaaatgagtacggtaagaactataatatcttgtgcagttaactttgattggccattacatcaattggatgtcaagaatgcttttctacatggcgatcttcaagaggaggtatatatggaaattccacctggatttgctactttgcaaactaaaggtaaagtattgagattgaagaaatccttatatggtctcaaacagtcgccaagagcatggtttgatcgatttaggcgtgcaatgtgtgctatgggctataaacaatgtaatggagatcacacagttttctatcatcatagtggagatcatataaccattcttgctgtttatgttgatgatatgattatcactggaaatgattgctcggagataactaggctgaaacaaaatctaagcaaagaatttgaagttaaggacctaggccagttgaaatattttctgggtattgaaattgcaagatctcctagagggatagttctttcacagcggaaatatgcattggacttgctcagtgacacaggtatgcttggatgtcgcccagcctctacaccagttgatcaaaatcataagttatgtgcagagtctggaaatccagtgaataaggaaagataccaaaggctggttgggagactgatatatttatgtcatacacgacctgacataacttatgctgtcagtatggtgagtcgatatatgcatgatccaaggagtgggcatatggatgctgtctataggatcttgagatatttgaaaggaagcccaggtaaaggcctatggtttaagaaaaatggacacttggaggttgaaggctattgtgatgcagattgggcaagttgtcctgatgatagaagatcaacttcaggctattgtgtgtttgttggtggtaatctagtatcttggaggagcaagaagcaaccggtggtgtctcgctcaaccgctgaggcagaatatcgggcaatgtcagtgagtttaagtgagttgttatggctaaggaatcttctttctgagttgatgttgccggtggatactccaatgaaattgtggtgtgacaacaagtcagcaatcagcattgctaacaacccagttcaacatgatcgaacaaagcatgtggagttggatcgtttctttatcaaggaaaaactggatgagggagttttggaattagaatttgtaatgtctggtggacaagttgctgattgtttcacaaagggtttaggtgttaaaaagtgtaatagttcatgtgacaagatgggtatgatagatatctatcacccatcttgagagggagtgttgggctgtaaatacaacagtatgtgtgtgttttatgtgctggcccatctgctagagggcccatctagtcatgtatatgtaaataaggatagcaatacagagaaggtgaagcttccagagaaaattggctgccaaaaaacttcaaaaaaaagtcgtcctccatctcaaacacgtttggtgggtcagcgtagcaaagcagtacaaccactgggttcgtagaatcgcgtacgtacatcatgcggtgcacgtgaggagaggaggcagggccgctctcaagtcggcatcgccctttcaattatcacacccttacgtgtcgctgccttttctttattttttttctcaccaaaagctgatgatgaaacgatacctctcccctccctcctgtcctctcctttcgcacccatcaccaccaccatacaccccaatgacatgtgggccatggagttaacgccgggtcccaccacgctgcaaaggttgggggccaaaggtgagagaggaaaaaaaaaagcctctccaccttctgtcgcctcgggggagggtactgacaggtgggccctacggcccgcgtataccgacgggttgttgtgcagcatccgagaagagagatcacgaatattggaaattattttttttggcatcgaccccggattatgcgagtgctttaggggtaagggcggaattaatttggtgggtggagtgattaatgataaggacgcgcccggggggtggggcccacgctggggaaaccgccttgtgttgcaggccgccggaacggcaacacacagctgtcgtttaggcccaccacccaccccacttacgcggctcccacggcacctatttttttcttttttttctctcgaattttatataattattttatttgctccttcaaaataatttatgcccctatttttccaaataactcaaaagaaaaagaaggtatactctgcgatggcaagggcgtgaaattataccaaaaaaggagggcaggagcctaatattgacaataattgagccgcccatgtcggtcatcacccaaaccgggccactcagcggtgcagcgcggggcccacctcccctccgagtagaccccacaacaacatccatccgtccgtgtaaagcaattcctgcatccgacggcgctcgtgcggccacgcacaacaaaaagatctcctcccccaacacccgacaagcccagtgtttttcctttctttcataaaaataaaacaaattattttattttattttaataaaaaggaaactgaaccacgtcgtgtggcactcgtactcatccatctccgattataaaagacgcctcttagccaagcgtttctcccccattgtgttctctccccccacccttccaatcccaatctcttctcttcccctctcgttagggttaggtttttattttctctctctcgatttctctcttcgcttccacttcccaaaattctcgagtcaaacctcgtggcgttcggccatggcgacggcggcggtgctcggatcccacgacgccctcgacaaccggatgcatctgggggccttcgccgtgtccccggcgtcgaagccgaggcggaggcggcacagcaaggcggcgtcgccgccccccaaggtggcggcggtgagctcgccgccggtggttaagtcggcggcgagggtggcgtcgcctcctcccaaggctgcggcggcggcggcggtgcctcaggggcgtcgctcgccggtggcgaggaagcaagggtcgccgacgaaggagttgccgaagcagaggctcgtgatgggggagatccggatcctcaagcgcggcgaggagccgccggtttcctcgccgtcgcctgctccggttgcggcgcaggccgcggcggttgaccagcgggcgccccgtgttccggctgtggcgcaagccgcgccgactgaccagaaggcgcctcgccccgccagatcgaagcagcagcagcacacggccgctgtgccgacgaagatcaagtccgtcgccgacgcgccagtctacgccggcccggccttctcctcggcttcgcctgagccgagctccctccccttcccggccttcatccgtcgcgccgaggccgaggcgacccgcggcctccgctgcctcctccgcatcggcgagctcccttgacggcctctctcaccgccgtcttccccggagccgtgagccgtgcacgctcctctcctcgtttctcctcctcttctctgatggatggattgcttggtggtttcgatccgatcgaaagcttgtccggatcagatcccggctgcgttccgatcaaactctcccggtattttttcagaggacgagtttgggggaacgcatctgccggtggttggatttggtagtggttaggttttcaaaagtttcgtggtggaattatgttgggggtttgcttctacgaagaacaacactaggttgattagttctttgtcttttgagtttggtttttaggtggtgtcttggttgggaaaaattggggttagtttggtggaaatttaggctggcttggtgttgctgatctgttagtacagcagtagtggtaataatagtagaggtttggttagatgaataattcgtcggtagtgattgtgatttgtggtttggtgagcgtgagttcaatgtcaggtgaagaatagtagcactaaattcgtgttaggtattatgtccagtgtcaaaggcaagacatatatagttcttattatcagtaattaagttatgttaggtgttatctttctgttcgtctgtaagatatatatagatcttatcgggtaatcaaatcaactatgtatcagatcctcgcagtggtgaatttcattcaacacatcagtggatgtttggttatcttcttttttttctcatgctgattagctgtggatttgtgttcttactttgtgcaagtaataagtagactacccttggattctcaacgaggttgcttcacaatcatcatatgcataccaagatttaattaagaactgccacttgttatacccgcagtttccgcttaagttccgctgtgtatttgttcttattcggatgataaactttgcttgttgatgtggtaatcgccaaattgcttaaattagtttgtgtacgcaaccgggtaggcggattgctggcgtctaatctaatatttcaacttgcaaattgaggtgcatcttgctttaatccaagtcctcttgctgaacaatttgctcagtatgatcgatcccagtagtagaggtgattatccccacctgatgttttgggtacgtttcagatgggttggggcgatataggttctcattgcgtatttgcaaacgataaataatttgtaattaaaacttctaaataatttgtaattaaaaatttatatacgtcgtcttagttttagcgatctaaaaatagaaaataaatttagataaaaaaaaccttaaaatcaactttaaccataaacttaaaatcaacttttaacctaaaatttaaattttggctgctaatcataaacggaaagttggtgctgataatttctgagagttcaatacgaaattgatcgctcaacttgatagggtcaggtcggcgacccaccggaagccgctggtagttgagatagctgaggtcaatctctctcctggcagcgtgtggtggcagactcgcccgaggcatggccaggaagctgcatagcctacgtcgtttcgacgtggcactcgccctcgcacgcgatgcagccacagcctcttgagtttcggagccacacaagcgatgagccgatgagcatgtgagagctgatgagttaaatttgactccgttcctattactgccaaaaacaaccttaccaaaaatttgtgaatgtcaaattttaattaagttggcagaattaccaaatttagtaggatggaattatgttgtgccaaaaaattttatatgttaccaatactagtatttaagtaacaaactaaatgtatctatatatttaaattttatcaaacaatgatatgatttaaaatgaaaccaatctaaaccggccctttacctaaagttgggtctactttgacggagttcttctgcacacggtaaaatacggtggcttcaagccttggacgtgtaccagccaactactagtccaaccacgactgacggcacacggcacggcatggatccgtgctttggtcaaaaagccgagtcaacgcccaagacaaannnnnnnnnnnnnnnnnnnnnnnnnnnnnnnnnnnnnnnnnnnnnnnnnnnactctgtaccatctgacaggtcaatcaatcccatc

SEQ ID NO: 6390 - DNA, 906 bp, Oryza sativa
  unsure (1)..(906): unsure at all n locations
ctggcatgatgaccatctgntcggacacnnccttcatcaaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttataatttggagatttttagggtgtgacaactagttaagttataataacccaaggtatcaaggaatagagtaatcaagaacaaaagggctataacaaggcaataggttaattccacccaatgacattcgaaaataaatgcaatagttgaatagaaacaatagctttaaacgggatcaacatgctcaaagggttgtttgggatctgtgtgacttgccttgctagccttggaactcttcaaagtcttctcctgcaaattcggactctccaggaacgtcggactctaaagagaaaagagcaaaatcaccaaaacaacacataaacaagcctgaacagtacatgtggatatttttaacatgtagatctcaattttagaaaaatttagagacttgaaccaactaaatccgagctaagatgaattagttatgaattttcatagattaaatcggattaaatcatttatatagattttaattgaattatgacgcaataatgaattatttttgaaaaggaaaaagggattattgcgtcagcggactcggctcatggtggaccgggtgcacggcggcggttcacggaaacgaacggccgagatcgatctatccaaaacggacagccaagatctaacggtctacgaccggtctacgaccggtctacggtggacgtgatgagctacttgcagtagaagccgagatcaatcaaangccctcg

SEQ ID NO: 6391 - DNA, 9262 bp, Oryza sativa
  unsure (1)..(9262): unsure at all n locations
cgttcgcgtttgatttgttttcatgatatgtatctctcgtgtatatacatacgtttattagaactggagttgcggaagttgatcatatatttcgtgttnncncnnccnnnnnnccaggggntttgagtgataactgctcgtcagnagaccatcagcccctgctcggaacctgngtacaacgacgttctgtggtcctctaacatacgcttgaatttatgggcctccttttcactttcacagtcctccttggcatcctacaacatctgaccaagatcatccgcagcgtcgttattatcagcatccctgtccacctcgcccgtttgatttccttcaaatccagcgtattgagcccagtccggaatgttctcatcttccacttcatcttcttccatctcaaccccttgcttaccgtgggatgtccaacaattatagcttggcatgaaccccgactgaaacaagtggaaatgagtagtcctggatacagaatacttcttctagttcttacacttattgcatggacaaccaataaaacccttatgcttgttagcttcggccactctcaaaaaataatgcaccccgtcgataaactatttggaccaccggtcagcgtacatccattgccgatccacctacatgtaatgaaaaaaagtcatacataaataaatattcataaaataatgacagtcatacaataatgatcaaataattaaaaactctttcaatagtcatacaataatgacatatcattattcatacaataattataaaataatccaacaaacaattcttatttattatttttgaatttttaaactaatattaatgttgtacttcttttaattttcaatttagtttggtttctattttccatgattaattttcattatattttaaactatgagaataaaacttttttaaataaacaaacaaaattcctatatattattcttccccacacaatttgtttctctcatcaacttacaacaaagttttggagacaaaaaatgtgtgaaacatagctccaaaagtaatataacaacaaaaaacattggaggatgaagttactaaccttttagatacctccgatttgtatataatcaccaaaaaaattcacaagaaattttggcatgacctcccctcttttttggagaaaatttgaagcttgctcgggctggaggaggaagaagacacatataaagagggagataattagtcccggatgatgttatcatccagggctaaaaatcgccgagatctttagtccccgggggcctgacaaggcctaacatctttagaaccgagactaaagatgatcttaccaactgggattaaagatcatatatgcccgctgtagccaccaaccgggactaaagatgatctttagtcccggtttttagtggaaccgggaatattgtgaatttcggctgaccgaccaaagatggtttctccaccagtgctatgataagatctcttgtagtgacggcttgtttggttattagagaggcagtttgagacatacggcatacagtttcatactgtgtgcgtgccaagttggcaattggatcctagtagcagcaaattttgaaacactcaacccaacccaatccttcttctcttaatcttctcttcctactcttgtgtttgtgtgtgtgtgtgtaagaggctagtagagttagctagcctaaatttttttgcacgttgcagctactagctgtgctgctggcttgtcgtcctctgcttgaactttaaagagagagctaatagatcggtgatccgcttgggtttctggtgatcatatgcaacatggactagctacttggatttgttcaaaggatctgcttcttggatgctgtctgggcacgtcgccatgcatgcgaattttgcggatggagtcaaaagctgcatgcacggagctgatttaattaagggcatgttcagattgtagtcaaaataaaccttaccaagtttttggcaatgccaaaattttggcaggatttcttatgtattaaccaaatttggcaacaactaaacgtagatatttttttggtaactttggcaaaaaatgatttggttgaaaatgacatcaaagtgaacaggccctaattaacttgttgacagctactccctccattccaaaatataaggcataaccacccttaactcaaagatcaagaaataattattatcatcttatagtttgaatcatgctaataaatataatgcatgcatccaataggattagataacatgagagtaaaggatttaaaaaagtaataacttaatgaagaagatgtcatagttaattgcatgcttgcatacatgccttatattatggaacatctaagaaaagtggttgtgccttatattatggaatagagggagtagtacctaattaagcatgtgtgttaatttattattaactagtaatctgcccgtgctaacgctgcggcgacatttagaaatacaaattaagatcgatggatatagctattatgttgttaattaaattgccacatgcataaaataacatagttattatcctggttcaaatggagtcattagtgacaacataccatggtaaaagcaaaagtaattaaactttggaacttggcaccttgaagcatcaaatccttgtctaccttgctgtctccctgtcaccccggccccacttaattctaaattaaatggatgagagaaagagattaatatagtttagtgtgatagtgccaacacatggaaaatttagagcttctagttctgtccttctacatctctcttaaatgtgggaccaagtccttatggggcccactaatcatacaaccatagccaacacatcatctgctcttctctcatttaaatcttcttttatttctcaaaaggtgagagaagggtttaaattgaatttccacccaaaatgccactctaccactccaagccttctaggaaacatctatatatgggcctatttgtcgtccaaatacctgcaaacaaccttggtgaatcatctctttatcctaaattatattttcaaagagagaaagagagagagggccaatttacacccaaacttcaccatacctctcatcttctcataggaaacatctacatggggccactagacagccactcatacttggttgagtgaagtacgagtgggatcacagcctcaaaccattgccaactcctttaaatcgtctctacccctcatgttgacaactagctctcactttccacctttacttttaccattcactactgcaaccaagatttttgtgtgagggctaaaacgatttttctgagcgggtaggcggcccgcacgcacctaggggtctgggaaaataatgatttttgcgtgcgggtggtgcacccccacgggaaaacaaaaatccgaaataacatatttttttttaaaaaaaatgaaaccctagaatctggcggtgggcttccgcccgacggccatagtgccgcctgcctcccgccggcctccccgccacccgccgtcggatccgcgctcccctccggccgcaacgccgccgtcgcccctcccctccgccggatctagggagggaaggaaggggagaggaggggagctggatcccacgtggggagaaggaggctggctaccggatccgtgcggggacggctgccaccgcaggattcttgcattgacggccaccgccgccggatccacgccctccaccgccgccacgtggaggaggccggcacgctcctactcccaccgccgccgcgccgctgctgtcgccgcgcgccgccgccgctgacgtcgtcggcgttcccggtgtccagagtgccaccatcgccccactttgccattccagtcgactcgaatcatctcctgctgtaccattgcgccactgacgtcgccttggtccctggagaacgacgcccacatatgatcaagccaatacgccgccacgaacgctgtcggtcgccgttgctctcctgctgcctctgcttctcttgccgccgagtcaccgacatgtgggcccggttgtttagccacttcattaggtgctaaggactttaattagtagaaattgaaatcttgtaatgttctttttgtaaaattgctttgtttgccatgtgggcttatggacctaaatgcaattcaactaatgcctagggacctttttgtatagggtttagggtttaccaactcgacccgaacaaagcctaatcctcctgatcatcaccttcactgaagcactcctcctctgaagaatgaatattgcaagaatgagcatatgacatactcaacaagccacacagcaaatatgcaagtgcacaggataacaaaggatggcataattaagctcatttgcataaacagcatttaataaacatttgagagaatagtaaaacagttaagtaattaagcaatattaaataaacactatacaacacacccattttgcataggcccaaccttatctgaacaaccaacccctgattgtacaaatcaaacctccaaaccaggaatataccattccaaaccaggagtcaatttagttatcacagtattttcattaatagtgagtaatgtgagactaatcacgaaaaatattgttagacccacccataaccgcgggcacggctattcgaatagttttacactgatcagagatgtaccactgtacccacaagacacaactccacaacatgtcaccatgcgcctcagtaccaccacggtaccttggaaaagaactgtgacaatacctctcacacaacacaactcaccacagtgcactgttccgggatcatagtctccccctcataaccagaggcaatggagtccccagcgacccccacggacttctcgctgcttcacagtctggcacccccgtaatgaatcatgctatacaaaaggtaaagccgttgctcacgctggcttgtcgttggcacggtaaatgtttcacaacagtagctcgtgaaccggtccttaattgttatgagcacgaccatcaaaacgatgtactcacaacccacctttcatcaggtttatgtatcaattaattatcataacacgattaaccatcgtaagctaccactaaatataaccataagtaatatcgtaatatgattaaccccattggtgagctaatgtttctaagcatggctaagcaattatacctatatagcacttagctgaaccaaaccaatacataaggtccaagctattcaatttattacccataggaaaataaagtcattgtcggccattaattaactgggaatggctcaccacccgacgacattcgaaaataatgcataagttgaaatgaaacattagctttaaacctgttcaacatgctaaaagcattgtttgggatctgtgtgacttgccttgagcttcttcaaacacttctgaaccttcctcaacgtaaacgctctcctccggaacatcggaaactaaagcaaataaacaaaatcaacaaaacagtacaaaaacaagcataaacagtacatgtggatatttttaacatgcagatcttgattttagatgaatttagcaacttgaaccactcgaatccgagttacgatgatttagttatgaatttccgaagtttaatcgatttgcaactaatagaaaaaactaataaaaaggatttatgacgtcatcgatgacatcatcgctggccatggcacggctccacgcgaccactggcgaagaggacacctacacgaagaggacgatgacacgaactcaccggtgcaagaaactacgccggacgacgacgtacggcgaccggctatgaggaccaacggcggcgcggctcgactcgacgacggcggcggcgttccagcggcttgcgacgacggcgaaggggcgaccgaggtactcctccaccgtgcgaacccggcggcagcgacggacagcgacgacggcgatgctagcggcggcgcggcgcgactggagagtcgccggcgactacggcggcttgagctacgcggcgatggcgctacgagcaacggcgggactcgggacttggggcaaacggaagaggacgattaggggatgctttatataggcttggattagagagattggactccaaccgagaggaatggagccgggaaaaactagggttagttaggagagataaactcaaaacgaattcgatttggtttatccgggcaaaattgatctccgaaactctaggggaaagggagaggataaggaggagatgatttcccctcaagcaatcggactcgggggcgaccggttgaggaggaatcggaggagaggcggcggtgctcgggctcggctcggcccagccggaggtaggggatgaccccgacatgtgggccccacatgtcggcggctagaggagaggagggacggctgggcttggattgggccggcgtggctgcacggccacgcgcgagggagagggatgttgcgccggaaacggcccaacggcctaggggaggattttaaagactttttcaattaaaataattcgtgaaatgatgtttcatttattaaaaatacttcccttgctcaaataattcccagaaaaatctagaaaaatagataaacaagcaaagtatttaataaaattttatctagctcaattttatgttgaaatttttcctagattattagagtttaacttgtaggtttttaaaataatttcaaaaaatgcattaaaaattgaattattaaattaggcgattttcagggcgtgacaaacctaccccccttaaacggaatctcgtcctcgagattcagaagaactggcaaaaagatgaggatgagctgacttcaattcatcctcccgctcccaagtggcttcttcttctgaatgattgctccactaaaacatacagaaccgtatgacgcgattctgggtgtttctctcactcacctccaaaattctgactggcttctcaacataagttaaatcttcttgaatctctaaacgctcaggatctgcttcctcggtaggtacactcaaacatttctttaactgcgacacatggaaaacgatcatgtattccctccattgacagaggcaactctagttgataagctacttcacttcttcgactcacaatcttaaaaggtcccacaaaacgcggtgccaatttctctttggtctgaaaacgatgaactccccgcagcggcgtaacccgtaggtatacataatccccttcttcgaaagtcaaatccctacaacgattgtctgcatagctcttctgacgtgactgagcaactcgcaacctttcttggataatcttcactttttcttctgcctctcgcaatacatctatcccaaaaacttgacgctcaccaatttgatcccaaaggagcggtgtacgacacttacgaccatacaatgctttgtatggagccatttgaagactagcttgataactgttgttatacgagaattcagcatacgacagattcttatcccaacttccaccgatatctagaacacaggctctcaacatgtctcctagaatttaatttactctttctgtctgaccgtcagtttgagggtgataggcagtactgaaattcaaacgagtacccatcccttcttgtaagttctgccaaaacttcgaagtaaactgactacctctgtctgacactattttcttgggaacgccatgtaaacatacaactcttgccatatatagctctgcgagcttatttcccgtgtaggttgttttgacgggtatgaaatgagcaactttagtacgcctgtcaaccactacccaaatagaatcatgtcctgccgacgttctgggtagaccggtgataaaatccattcctatttcctcccatttccactctggaatcttcaacggttgcagcagaccggctggcttctgatgctccgccttgactcattgacacacatcgcatagagccacatattctgctatctctcgtcgcatgctggcccaccagaattgttgcttcaggtcttgatacatcttagtgctcccgggatgaatggaatacaaagtttcatgggcttctttcatgatagtatcctttagctccttattatcgggcacgcaaattctttctcctagccacacagttccttgctcatcctctatataaccgatggctttacctcttctcatgttctttttgatttcttggatatcaggatcattcacttgagcctctctaacttgatcaaaaagagtaggctgagcttctaaagcggcaacaaaacctttgttgactattcccaagttcaacttttcaaattcctcgcataactcccaaggtaggtgtcgaccttctgacatattacagtagcttttcttgctgagagcatctgctacaacatttgctttacctagatgataatccttgatcaactctaaccaccgtcgttgacgcatgttcagatcaggttgagtgaaaatgtacttcaaacttttgtgatccatatacatctccgtacggttaccaaaaaggtaatgacgccaaatcttcaatgcatgaaccacagctgccaactctaggtcatgcgttggatagttattctcgtgggggcgtaactgtctaggcgcataggcaatcaccttcccatcttgcatcaaaacacaacccaaaccatgtctagaagcatcacaatacacctgaaaacctttccttggatcaggcaagactaacactggcgcagtcactagccttttcttcaattcttggaaactttgttcacactcttccgttcacttatacttcacatccttctaaagcagtcgagtcattggtctagcaatctttgagaagttctcaataaacctgcggtagtaccccgcaagaccaagaaaactacgaatctctaaaaccgtcttgggttgcttccaatttagcactgactccacattgcttggatccacggcaactcctccagctgagatgacatgaccaaggaacttcacttcgggcaaccaaaattcgcatttactaaacttggcgtagagctgatgctcatgtagtttctctaaagcaagacgaagatgctcttcatgctcttctttattcttggagtagataaggatatcatcaataaacaccatgacaaacttatccagatattccataaacactttgttcatcaagttcatgaaaaaggccggggcattagtgagtccaaacgacataacggtacactcgagcaaaccataccatgttgtaaaagcagtcttaggtatatcctcctcactgatgaggtncttgcagtaganggcgaatcactcaaggcct

SEQ ID NO: 6392 - DNA, 10495 bp, Oryza sativa
  unsure (1)..(10495): unsure at all n locations
actgaagcaaaccaaaccatgtggtaaagccagtctaaggtatatcctcctccggatttgaagttggtgatatccggaagaagatctatcttggagaaagctgtagcaccttccagttgatcaaacaggtcatcaatcctaggtagaggatacttattcttgatagggacctcattcaatgctggataatccacacacattctttgggtatgatctttcttctccacgaagataactagtgctccccacggtgaattattgggtctgatatatcctttctgaagcaaatcatccacctgtctctttacctctgctaactcattagctgccattctgtatggtctcttatggatagggttggttccaggtactaagtctatccggaactctatgtctctcttaggtggcatacctggcaaatccccagggaacacatctggatagtctcgtactattgggatctcttgcaaagcaacttgatttaatgtcaaaccgtgagattttggggatgacacaaagaaagacactgtttgtccattgctacttgttaaagtcacattacggttagcacaatctataactcctatgtgacgggttagccagtccatccctaagataacatcaagatctttggattctagaaagataagtgaggatgggaaaggtatttcttctatttctatagtaacggaaggacagtactgcgttgaggatacttgattgcctggggtattaactagtaatggtctcccaagactaataacttccatcccatgattgcccgcaaaacttttagacaaaaaggaatgtgtagcaccggaatcacaaaacacagttgcgggtatagagttaataggaaacgtacccaaaaccacatcaggtgcattctgggtttctgcggctgcaacatgattaacacgagcctttggtgctggagcattggagttgttctgaacatgagcattcttcacacgccgaggcattggacacttatcagcataatgtcttggatcaccacaattgaagcacacccctggcttgcttccctgttccttcctgacaggatgattctgagttggagctgctacatgacgagtgaccatattacgattatcgttgctgggattaccagtgttgttgttgtagaactggcgttgagggcgagcaactaaagaggatcctccctgtgggtatggtgcagcttgaggtcccaaagcaatgcgtgcctctggctacaaccctgttgagccttgaaatgagcagccctacgctttttctgttccatcctattatacttgtcttcttggcgaatcgccttgtccaccaactgctggaaatcccggtaatccatagccatcaatgcataagacaactcatcattcagtccctctaaaaacatctcatgacgttcttcatcagtgcgaacatcttctggggcataacgagctaagcgattaaagtcatggaggtactctgtgacagaacgggatccctagttgagtgctctgaactctctcttcttaagggccacaacacttgatggtatgtgtgtcttcttgaaagcagcagtaaactcccgccaagtgataggctgtccctcggctctgtttagacaaaagtggtcacaccgctcagcagcaggaccatgcaactgatgtgaagcaaaggaaaccttctcctgctcggtgcactgaaacaaatccaacttcttttccatagcattcagccaatcacctgcctctactgggttagtggtgcttgagaaggtaggtggtctcacacgtagaaaatctgccaacttgttctgcggaggtggtggtggttgattcttgttatttgcctgctggttctgcgcttgctgcactaacagattaatcaactgggtttgctgggccaaaacttgggcaagtgtgggatctccttcattgtgaccatttccacttccagtgcgggtgttcaccatctgaagaaaagcatgggcaaaatgaaagaacgacagagagatacccttagaacggagaactttaattaattcaaattctatattgctcttaactgtgtatgattacatttaaattgaattaacactatctcaccagctaacttactctctgacaagcaaaacaactaaacttatgtagttacatcccaccaatgatgtaagcaacatgctaaacccacacacgcacaagcaatcttaagcaagcgaactaacacagcgaactacggcaacggtcaaactagacaacaactctcgccttgcgtcggaacgaagagatggatcttcctcctctggagtagctggctctctttcttctgggtcttcctcttcttcctcatcacttaagacatggatgacaggttcagcatgatcaggcacagcgtctcccaccacacgagtcttcgaagctaactggagacgaggtggtggacgggttctcttccttgcggtgaggcgaagcttgggtgctgacggtcgtgcttctcccttaagcccagctagtttcttctgcagacggtacaccttgctctccaacttacaaatcctgccacggttccagttttccctatcatgagctgctttctcccgctccacgcctactgcatccatggcgctaagcatatacacggcgtgcatcacaatggggctaccttcactttggggacagttgtaagttccatagtcttgaccatgaggcttgtgtgggtgatactggaaagctgatgactctaactcctcatcaaagcgatgacgtagctctccaatggccaccaaggttgcttcttgacaagcatggctgtactttcttcccccagcttcaaactttatcgacggaaggtcttcacgatcactagtcaacgtcacgcgaacacgacacttctcctcattggggtcatggggaatctggtgatactcaggggcaacctcgtaacctacttcaaatgccatcattctcagcaagcatatgacatactcaacaagccacacagcaataacgagcatatgacatactcaacaagccacacagcagatatgcaaatgcacaagataacaaaggatagcataatatgacatacccataaccgtgggcacggctattcgaatagttttactctgatcagagatgtaccactgtacccacaagacacaactccacatgtcaccatgcgcctcagtaccaccacggtaccttcgaaaggaactgtgacaatacctctaacacaacacaactcaccacagtgcaccgttcctggaacataatctccccatcataaccagaggcaatggactccccagcgacccccacggacttctcgccgcttcacaggctggcaccccgtaatgaatcatgctatacaaaaggtaaagccgttgcccacgctggcttgtggttggcacggtaaatgtttcacaacagtagctcgtgaaccggtccttaattgttataagcacgaccatcaaaaccatgtactcacaacccacctttaatcaggtttatgtatcaattaattatcataacacgattaactatcgtgagctaccactaaatataaccataagtaatatcgtaatatgattaaccccattgatgagctattcaatttattacccataggaaaataaagtcattgtcggccattaattaactgggaatggctcaccacccgacgacattcgaaaataatgcataagttgaaataaaacattagctttaaacgggttcaacatgctcaaagggttgtttcggatctgtgtgacttgccttgagcttcttcaaacacttctgaaccttcctcaacgtaaacgctctcctccggaacatcggaaactaaagcaaataaacaaaatcaacaaaacagtacaaaaacaagaataaacagtacatgtggatatttttaacatgtagatcttgattttagatgaatttagcaacttgaaccactcgaatccgagttacgatgatttagttatgaatttccagagtttaatcgattttcaactaataaaaaaactaataaaaatgatttatgacgtcatcgatgacatcatcgccgggcatggcacggctccacgcgaccaccggcgatagagagctcggttgggctatccgaggacacctacgcgaagaggacgacgacgcgaactcaccggtgcaagaaactacgacggacgacgacgtacggcgaccggcgacgaggaccaacagcggcacggcttggcttgacgacggcggcggcgttccagtggcttgcgacgacggcgaaggggcagccaaggtactcctccaccgtgcgaacccggcggcggcgacggacagcgacggaggtgacgctagcggcagcgcggcgtgactggagagtcgccagcgacggcggcggcttgagctacgcggcggcggcgctacgagcaacggcgagacacgggacttggggcaaatggaagaggacaactaggggatgctttatataggcttggattagagagatcggactccaaccgagaggaatcgagctgggaaaaactagggttagtttggagagataaactcaaaacgaattcgatttggtttattcgggcaaaattgatctccgaaactctaggggaaagggagaggataaggaggagatgatttcccctcaagcagttggactcgcggacaaccggttgaggaggaatcggaggagaggcggcggcgctcgggctcggctcggctcggcccagccggaggtacgggatgaccccgacatgtgggcccccatgtcgatgactagaggagacgaggggcggctcggcttggattggcctggcgtgggccgcacggccacgtgcgagggagagggatgttgggccggaaatggccaaacggccaaggggaggattctaaagactttttcaattaaaataattcgtgaaatgatgtttcgtttattaaaaatacttcccttgctcaaaaaattcccagaaaaatctagaaaatagataaacaagcaaagtatttaataaagttttatctagctcaattttatgttgaaatttttcctagattataggagtttagcttgtaggtttttaaattaatttctaaaaatgcattaaaaactgatttattaaattaggcgattttcagggcgtgacattgatatagtttaaacatgtaggttaccgaatctttaattttgggacccgacaaggtgtgtgggtgggggcccctgcgatttgggagcctagagcggctgtaccgctcccccctcccaagcttgccctgaatacatgggccttgaaaggccacatggaatcttatgacgatttctgggcttgatggcgacgaaaatggacgtcatagactctatgacgacagaaggattgtcactagattagtaacaaaaagataagctttctttatagaatgccattagagacgcatgataggtaacgaatgatattcgtcacaagaatgtcacagagttcacaacatagtgaatgatctatatatgggcctatttgtcgtccaaatacctacaaacaaccttggtgaatcatctctttgatcctaaattatattttcaaagagacaaagaaagagagagagggagttaaagtccaatttacacccaaacttcaccatacctctcatcttctcctaggaaacatctacatggggccactagacagccactcatacttggttgagcgaagtacaagtgggatcacagcctcaaaccactgccaactcctttaaatcgtttctacccatcatgttgacaactagctctcactttccacctttactttcaccattcactactacaaccaagatttttgtgtgagggctaaaacgatttttgcgtgcgggtaggcagcccgcacgcacctaggggtctgggaacatgacgatttttgcgtgcgggtggcgcaacccacgggaagacaaaaatccgaaaaaacttaatttttttttaaaaaaaacgaaaccctagaatccggctataggctttcacccgccgcccgccggccatagtgccgcctgcctcccgccggcctccgcgccaaccgccgtcagatccgcactcccctccggccgcacagccgccgacgcccctcccctccgccggatctagggacgaaaggaagaggacgggaggggagctgtatcccgtgcggggagagggcggccggccgccggatccgtgcgtgtacggccgccaccgctggattcttgcgttgacggccaccgctgctggatctgtgtagggacggccgccgcccgctagatcccacgccctccaccgccgtcacgtggaggaggccgctactcccaccgccgccgcaccgctgctgtcaccgcgcgctgacgccgctgccgccgtcgggaggagaggaggggagagtggagagagtggagaggagatgcaagagagagagaggactgaggagaagctctacgtggaaattttaaagtggaaaaagggatagaggggaggggagaggagagaaagaggaaaattttaaagctggtgagaggggaaagagggagttagtatttttgcatgcggctctctcaataggtccgcacgggaagatcggctcattttcgcatacagtccatttaagaggaccgcacggaaaaatcgatttttccatgccatcctcttaattgaaccgcacgtgaaaatgagccgattttcctagaagcaacgagttaccgcccctacggaatataaaagggtccctgtccaggaaaatcgtttctatattagtgattcgagaagttccttctctacctgatcgatccattttctttgtttccgttttggcatagattgaatacttggtggtgcactcgtcggcgtttcgagtgtccagagcaccgccatcgccccacatcgtcgttccaatcgactcaaaccatctccggccgaatcattgagccaccgacgtcgccaaggtcctagcagaaagacacccaaatatgatcatgccaatacgccgccgcaaacgccgtcggtcgccattgcccttttgttgcctctgcttctccagccattgagtcaccataagtgggcccgggtgtttagccactacattaggcgctaaggactttaattagtagaaatttaaattttgtaaggtttattttttaaaattgctttgtatgccatgtgggcatatggttctaaacgcaattcacctaatacccagtgacctttttgtatatggtttagggtaagccctaatccctactcagaaattactatttcatggatttattacttgatataatagcttgatgagtatattgtactcacccttgctttaaccccctctttcagaatcaatttggagtttttgccgaagccaggagtttaatcatataaattggtttcattccaacttagttcccaagtatagattagatatatggtttaattctatagcaaaacattagagttggctcatcctatagcttctacggtaatagttagccacaatcttgtaaataccctattattttatgtaaagaaatctccattggagccttaatcaaatgtatgcgatgaagattcagattgttgaacatgtatcaatctactaatccaggggttcatatagtttaaacatttaggttaccgaatctttaattttgggacccgacaagctgtgtgggtgggggcccctgcgatttggccagcctagtgcggctgtaccgctcccccccccctaagctggccctgactacaagggccataaaaggccacatggcatcttatgatgatttctgggcttaatggcgacgaaaatggacgtcatagactctatgacgacagaaggatcgtcactagattagtaacaaaaagataagctttctttatagaatgccattagtgacgcataataggtaacgaatgatattcgtcacacgaatatcacagatttcacaacatgacttgaaattcaatttttataacgtaaataagcgtcacctataataagatctcttgtagtgatggcttgtttggctattagagagacagtttgagacatacaacacacagagctaattgatcggcgatccacttgggtttctggtgatcatatgcaacatggactaagttacttggatttgttcaaatgatctgcttcttggatgctgtccggccacgtcgccatgcatgcgaattttgtggatggagccaaaagctgcatgcacggagctgagtaggagacgacgtagacagatctgcacatcgtggaccatgctgcttgatgtggtcggatgtaggtgcagtaggaataatccttttcataatagtgaaactaaagaatttcacttgccaactagtttttttagagtctgtacagaaatgaaactttttgaaaagtgctccagatgaccaagttcaattcaccaaccgtaatcgcgtgttggatttacatgaaaaatacgagacagacaaaaatgatatctttcggttctaaattaatactcccggccatttgagagtgtaggatggtaaagggcctttcccaccccaaaagctagccattgaggtgaggggctcccccacttatatcttaggtcctttgcccttccacaaccaatgtgggactattcaacaatctcccccttcacacattggtgtctctcagcccttcaccgccccttcaccgtatccgggcccccaccggcccacggtccatcaggtatacgggtcccgcaggcacccacggtctatcaggccttcacacacgtgtccatcgggccagagaagttaacctagcctggctctgataccaattataggatcgtaaagggcatttcccaccccaaaagctagccattgaggtgaggggctcccccacttatatcttaggtcctttgcccttccacaaccaatgtgggactattcaacagagaggagcaatatgtacatatgcatgcatcacatctcagtgttttttttcttttttttccttggagttttaagaatgctcataattagggcatgcaagttgatccattagtatattcgcaatatttgatgatttttttcattttaaaaattgttgacgatattagcttaattttggtatggaaaatatcggttaatttattcccaatttttatctcaagcgagaaaatgaaccatgagagttgaggtgctaattaaccacaggcaaatattcattttaatttgttgtgtatatatatatatatatatacacgagcatacatgtgaagatggaaatatgtgaaaaatataatggtgctagtagatttgtctaaaacacttccacaatacaatgatcatgacactcgatcaggtctcaaagttaaattttagggattgtgtcaatatcaaaattatcaatgaataattggccagagggccgggattagcaagggtctactactgtcctgccatttcattaattaattagattaagtccccgattccttgcatccctaattggcctacgagaatcgacaaaaatcgcaagatgagaggattgtggtaggtaatcttctccaactgtgcctctcaatcggccataacatattagctagaaggataaacaaacatcaatctgccttcacagttttgatcatctcatgagacacatatatataaaccacccataagcaagagtctccaaggtgaattaattaactatgttgatacacatatacttaattggtataagagcattagtagtggtagttaattagtataaaagcatccatcaaaaggagactgttagctagctaggagaccgggcaagcaaagcaaagcattgatcttgatgaatcctccagagagattaattgcatattgtccagttccccctgacctattatacacatgcaagtgctctatgtacttgtgcggtgcaacgacgagcaagagtgcgtacgtttatagtagaactgagggggtgcgccttatatacgccggacgaggaagagtgcgtacgtttgtagtgatgtctccaattttagtttctgtcatagtgaaatattcgacgtttgacacctcgaaccatagaaaaactggagctgtgaaatgttttcttcttttttatgcgtggagcactgaaatattgacagttttgtttttttctataaaaaaagaagaagagttgacgacttgatgggcaggctctcctcgatggagggagatgagcttaaaaagtcgcaataaatggaccgatgtagtggaaatgtggagtggagtggagcagtaataaaatttaaaacgccacgcgtagggcatatcgaccacgactggactctccttgagatcttcgaacagtgtgtgcttgctagctgaactgcagcagtggaacagtaataaaatttaaaacggatgtgcagtgttcacagaggatgagtgtgctatgtgttctctgcttgtgaatagatatggcgatctctgcatgtgaatagtgatgancttcttgcagtagcnagacaatgcacntcaaatggcgcag

SEQ ID NO: 6393 - DNA, 1142 bp, Oryza sativa
  unsure (1)..(1142): unsure at all n locations
naaaaggtaatttatgattttcgctgtctcatcatgattatgccaaatatacatatacctaactcatgaatttttctatgcctacctctcaccatttatgctatgtctaagctagacgattttgttatggccatacctactcttaaatttttttatgtcggccttgactcagccgccccaatagaagcgacaaaactgctgttgttgcaagagttggattccttcaagaaagtgatagatgaatctgaggcatcaagggagcagtaatcaaagaaaattgaaagtttgattggcctaaatgctccatattttgctctgaaatgttgatagttatgttaccaatcatgtatcattgtcattttcatagccttcatcatggcgttgcgaatattatgaatataccaatggatcaacctgcacgccctaagtgtgcgcattcttaaaactccaaggtaaaaagacaaaaatgctgaagtgtgatgcatgcatatgtacatattgctcctcccaaatggacatcatgcaggatcgggacttgacaacacattaaaggctctcatgctacacgcttcttgcactgtagttaaacaagggcatcgagcggtagttcgataacaataagattcattagcaccaacataaccccatccattccaataaatatggcacgcatgtattttaagatttatctttgaccaagaattagttttaatttacaaagatatttgatagaaaattagcatcatttcaacctgtttttcaatacgaatacaacaattctatgtatatattactagtcatcaacctgtgcacttgcatgggctagaaaaattacgtgacatcaattaactagcgtggaagctttattggtgcctccaattactagatataagattttttctttgtttctcaattctttcggtcaataacgagcatgtgtgttattcatagaaacggaggtaggtagtatttgtaagaagtacggtatcgaatttcaaaaaagttccgaccttgtccgataatatacacacatattaacctacataggcaagctagccagacctagaaatataccatttctaaacctattcggtcacttactcacgttggggagcctaactaaactaacatggactcacatg

SEQ ID NO: 6394 - DNA, 2594 bp, Oryza sativa
aaccacaatgaactatttaggcctggttttttaccggtttggtgattttggttaattgctttagtttccgaaaatccggaggagaagcgtttacgttgagaaaggttcagaagtgtttgaattagctcaaggcaagtcacacagatctgaaacaaccctttgagcatgttgaacctggttaaagctaatgttttatttcaacttatgcatattttcgaatgtcgtgggtggtgagctttcccagttaataatgccgacaatgactttattttctatgggtaataattgaatagcttggaccttatatattggttgggttaagctaggtgctatataggtataattgcttagccatgcttagaaacattagctcattaatggggttaatcatataaggatattacttatggttatatttagtggtagctcacgatggttaatcgtgttatgataattaattgatacataaacctgattaaagtgggttgtgagtacatggttttgatggtcgtgctcataacaattaaggaccgtttcacgagctactgttgtgaaacatttaccgtgccaaccacaagccagcgtgggcaacggctttaccttttgtatagcatgattcattacggggtgccagactgtgaagcggcgagaagtccgtgggggtcgcgagggagtccattgcccctggttatgagggggagattatgatcaggaacggtgcaatgtggtgagttgtgttgtgtgagaggtattgtcatagttcctttccaaggtaccgtggtggtactgaggcgcatgctgacatgttgtggagttgtgtcttgtgggtacagtggtacatatctgatcagagtaaaactattcgaatagccgtgcccgcggttatgggtgggtctaacaatgtttttcgtgattagtctcacattactcagtattaatgaaaatactgtgataactaaattgactcttggtttggaatggtatatttcctagtttggaggtttgatttgtacacctaggggttggttgttcagataaggttgggcctatgcaacatgggtgtgttgtatagtgtttatttaatattgcttaattacataactgttttactattctctcaaatgtttattaaatgctgtttatgcgaatgagcttaattatgccatcctttgttatcctgtgcatttgcatatttgctgtgtggcttgtcgagtatatcatatgctcattcttgcaattttcattcttcagaggaggagtgcttcagtgaaggtgatgatcaggaggattaggctttgttcgggtcgagttgcttgtggagtggagtcgccaaagatgtttagtcttttgttttttttccgctgcgtagaactttattctttgagaggaactatccacctctgtaataatttattttgcacacattaattagatatttgatagtactctattatcatttgttattgtgtgcctcggctgattcctggatgagggtttaacgcacatgtaagcgtttggaattttggatagaaattccgggcgtgacaatcaacccctggatcagtagattgatacaggttcaacaatctgaatcttcatcgcatacatttgattaaggctccaatggaaatttctttacataaaataattgggtatttacaagattgtggctaactattactatagaagctataggatgagccaactctaatgttttgctatagaattaaaccatctatctaatctagagttgggaactaagttggaatgaaactaatttatatgattaaactcctggcttcggcaaaatctcaagtaatgagtgcatgaaatagtaatttcatgttttagggtaagccctaaaccctatacaaaaaggtccctgggcattaggtgaattgcatttaggtccataaacccacatggcaaacaaagcaattttacaaaaagaaccttacaagatttaaatttctactaattaaagtccttagcacctaatgaagtggctaaacagccgggcccacatgtcagtgactcggcggcaagagaagcagaggcagcaggagagcaacggcgaccaacagcgttcgtggcggcgtattggcttcatcatatgtgggcgtcgttctgctgggacctaggcgatgtcagtggcgcaatggtacagccggagatgattcgagttgacgggaatgacaaagtgggacgatggtggcgctctggacaccgggaacgccgacgagcgcaccaccaagtgttcgatctatgccaaaaaagaaacaaagaaaatggatcgatcaagtagagaaggaacttcatgaatcactactatagaaacgattttcctggatagggaccttttagattccgtgagggcggtatctcgttgcttctgggaaaatcgcctcatcggctctgttgtcaaacgcgttttgcactgtagttaaacaaaaataacttcgccgaacttcttccctcataaaattattttcaccatatttcccccctcttttctagaaatatggcccgcattttctctaagaatcatttttgtccagaacaagtcttcaataccaagaattttttccgaaacc

SEQ ID NO: 6395 - DNA, 1011 bp, Oryza sativa
  unsure (1)..(1011): unsure at all n locations
gatggcnatttgaatatattacccgctttcnncanccgnnnctacccctcatgttgacaactagctctcactttccaccttcacttttaccattcactactacaaccattatttttgtgtgagggctaaaacgatttttgcgagcgggtaggcggcccgcacgcacctaggggtctaggaaaatgatgatttttgcgtgcgggtggcgcacccccacgggaaaacaaaaatccgaaataacataattttttttaaaaaaaacgaaaccctagaatccggcggcgggcttccgcccgatagccatagtgccgcctgcctcccgccggcctccgcgccacccaccgtcggatccgcgctcccctccggctgcaacgccgccgacgcccctcccctccgccggatctagggagggaaggaaggggagaggaggggagctggatcccacgcggggagaaggcggctggctgccggatccatgcggggacgaccgccaccactggattcttgcgttgacggccaccaccgttggatccgtgtagggactaccaccgcccgccggatcccgcgccctccaccaccgccacatggaggaggcctgcgcgctcctactcccaccaccgccgcaccgctgctgtcgccgcgcgccgccactgctaccgccgtcgggaggagaggagaggagagtgcagagaggagaggagaggcgtgagacagagaagactgagaggagatgctctgcgtggaaattttaaagtggaaaaagggatagaggggaggggagaggagagaaagagggaaaattttaaagtgggtgagagaggaaagagggacttagtatttttgcatgcggctctcttaataggtccgcacgggaaaatcggctcattttcgcgtaaagtccataaaagaggaccgcacggaaaaatcgatttttcccagacgcaacgagttaccactcgtaaaaattatgtttgatacaagncggtacacgggtagtaccatncccgcagc

SEQ ID NO: 6396 - DNA, 4193 bp, Oryza sativa
  unsure (1)..(4193): unsure at all n locations
aggcaccagggctccttcctgccaagcatgcttggaccttctttccgccagctcaaagctttaccgcgnaaggttcttccggatcactagtcaacgtcacccgacagacactttctcctcatgggggtcatagggaatctggcaatactcggggcaaacctcgtaacttacttcaaatgccatcattctcagctccctgacgaatcctagcacctcgatcgagtttttcggcggatggggcggcatataaaggaacattgaaaggaaggaattaatgcatatttttaagttagctgcacaaactagacttaattaaattggacccaaagaaaaagaaaataaaagaaaaggagcaaacatgactcaatttttttttctttttggaacataaatcaaccttgaacagagacaaataacttttgacaaatgaataaattaaaactaaaatatttaggatctaccaggagcacggtacagagtcaccattaacagggatgagtagtactgatgccatcttgattgaatcgataccataatagatgtacagtgccgactaaccaatgaaattcagaaaattatactatttaataccctaaacagtaaagttctttttctttcaaaataaaagaacaaatttctgttttgctaaattagaatttaataaattttgtacataaccttgcatgtggtgccaacttaattaatttataagagaatagagaagagcagttctattttccaaaataatttgaaggaaacttaaggtttaccatttggcttgtcctaaggtcaaggtggctctgataccaacttgtcacgcccggaatttctatccaaaattccaaacgcttacatgtgcgtcaaaccctcgtccaggaatcatccgaggcacacaataacaaattgataatagagtactatcaaataattaattaatatgcgcaaaataaattattacagaggtggatagttcctctcaaagaataaagttctacgcagcggaaaaaaaaacaaaagactaaacatctttggcgactccactccacaagcaactcgacccgaacaaagcctaatcctcctgatcatcaccttcattgaagcactcctcctctgaagaatgaatattgcaagaatgagcatatgacatactcaacaagccacacagcaaatatgcaaatgcataggataacaaaggatggcataattaagctcattcgcataaacagcatttaataaacatttgagagaatagtaaaacagttaagtaattaagcaatattaaataaacactatacatcacacccatgttgcataggcccaaccttatctgaacaaccaacccctaggtgtacaaatcaaacctccaaactaggaaatataccattccaaaccaggagtcaatttagttatcacagtattttcattaatactgagtaatatgagactaatcacgaaaaatattgttagacccacccataaccgctggcatggctattcgaatagttttactctgatcagagatgtaccactgtacccacaagacacaactctacaacatgacacaactccacaagacacaactccacaacatgtcacaacatgtcaccacaaaaaggaatgtgtagcaccggaatcaaaaagcacagttgcgggtatagagttagtaggaaacgtacccaaaaccacatcaggtgtattctgggcttctgcggctgcaacatgattaacacgagccttcggtgctggagcattggagttgttctgaacaggagcattcttcacacgccgaggcttgggacacttatcagcataatgtcctggatcaccacaattgaagcacacccctggcttgcttccctgttccttcctgacaggatgattctgagttggagctgctacaggacgagtgaccatattacgattatcgttgctgcgattaccagtgttgttgttgtagaactggcgttgagggcgagcaactgaagaggatcctccctgtgggtatggtgcagcttgaggtcccaaagcaatgtgcggcctctggctactaccctgttgtgccttgaaatgagcagccctacgctttttctgttccatcctattatacttgtcttcttggcgaatcgccttgtccatcaactgctggaaatcccagtaatccatagccatcaatgcataagacaactcatcattcaatccctctaaaaacttctcctgatgttcttcatcagtgcgacatcttctggggcataacgagctaagcaattaaagtcatggaggtactctgtgacagaacgggatccctggttgagtgctctgaactctctcttcttaagggccacaacacctgatggtatgtgtgtcttcttgaaagcagcagcaaactcccgccaagtgataggctgtccctcggctctgtttagacgaaactggtcccaccacttagcagcaggaccatgcaactgatgtgaagcaaaggaaaccttctcctgctcagtgcactgaatcaaatctaacttcttttccacagcatgcagccaatcacctgcctctactaggttagtggtgcttgagaaggtaggtggtctcacacgtagaaaatctgccaacttgttctacggaggtggtggttgattgttgttatttgcctgttggttctgcgcttgctgcactaacagattaatcaactcggtttgctgggccaaaacttgggcaagtgtgggatctccttcattgtgaccatttccacttccacttccacttccagtgcgggtgttcaccatctgaagaaaagcatgggcaaaaggaaagaacgacagagagatacccttagaacggagaactttaattaatttaaattctatattgctcttaactgtgtatgattacatttaaattgaattaacactatctcaccagctaacttactctctgacaagcaaaagaactaaactcatgtagttacatcccaccattgatgtaagcaacatgctaaacccacacacggacaagcaatcttaagctagcaaagtaacacagcgaactacagcaacggtctaactagacaactactctcgccttgcgtcagaatgaagagatggatcttcctcctctggagtagctggctctctttcttctaggtcttcctcttcttcctcatcacttaagacatggatgacaggtttagcatgatcaggcacagcgtctcccaccacaccagtcttcgaagctaactggagacgaggtggtggacgggttctcttccttgcggtgaggcgtagcttgggtgctggcggtggtgcttctcccttaagctcagctagttccttctgcagacggtacaccttgctctccaacttacaaatcctgccacggttccagttttccctatcatgagctgctttctcccgctccacgcctactgcatccatggcgctaagcatatacacggcgtgcatcacagtggcactaccttcaccttcgggacagttgtaagttccatagtcttgaccatgaggcttgtgtgggtgatactggaaagctgatgactctaactcctcatcaaagcgatgacgtagctctccaatggccaccaaggctgcttcctgacaagcatggctgtactttcttcccccagcttcaaactttatcgacggaaggtcttcacgatcactagtcaacgtcacgcgaacacgacacttctcctcattggggtcatagggaatctggcaatactcgggggcaacctcgtaacctacttcaaatgccatcattctcagctccctgacgaatcctagcacctcgatcaagtttttcggcggatggggcggcatataaaggaacattgaaaggaaggaattaatgcatatttttaagttagctgcacaaactagacttaattaaattggacccaaagaaaaagaaaataaaagaaaaggagcaaacatgactcaatttttttttctttttggaacataaatcatccttgaacagagacaaataacttttgacaaatgaataaattaaaactcaaatatttaggatctgccagcagcccggcacagagtcaccgttaacagggatgagtagaattgatgcctcttgagttgaatcgatgcgataatagatgttcagcgccgactaaccaataaaattttatntgtncgtgcattcgatggcattcatggcccgcg

SEQ ID NO: 6397 - DNA, 3250 bp, Oryza sativa
  unsure (1)..(3250): unsure at all n locations
aagacaggtacttcccatttttataccagcatcattgtannnnnnnaaannnnnnnnnnnnggnnnnccccatnggtgaganactctttgaaatataaccataagtgcgttttttttttttttccccccccccctttttttttttttaaaaaaaaaaaaatttttttggaaaattttttttttaaaaaaaaaccccccccccccccccccaaatttttttttaaaaatttttttgaaaaggggccctttaaaattgtgggggtttttttttctttaaaaggccattgggcctaattcaattttatcccttatatagctacctagctaacctaactctatatataaggtccaggctattcgctttattacccatagacagttaaagtcattgtcggccattaattaactgggaaaggctcaccacccgacgacattcgaaaataatgcataagttgaaataaaacattagctttaaacaggttcaacatgctcaaagggttgtttcagatctgtgtgacttgccttgaacttattcaaacacttctgaaccttcctcaacgtaaacgctctcctccggaatatcggaaactaaagcaaataaacaaaatcaacaaaacagtaaaaaaacaagcataaatagtacatgtggatatttttaacaaagtagatcttgattttagatgaattaaccaacttgaaccactcgaatccgagttcctatgatttagtaatgaatttcccaagtttaatcgattttcaccgaatagaaaaaactaataaaaaggatttatgacgtcatcgatgacatcatcgccggccatggtacggttccacgcgaccaccggcgatagagagctcggttgggctatccggggacacctacgagaagaggacgacgacgcgaactcatcggtgcaagaaactacgacggacgacgatgtacggcgaccggcgatgaggacgaacggcagcgcggctcgggtcgacgacggcggcggcattccagcggcttgcgacgacggcgaaggggtggccgaggtactcctccaccgtgcgaacccggcggcggcgacgctagcggcggtgtggcgcgactggatagtcgccggcgacggcggtggcttgagctacgcggcggcagcgctacgagcaacggcgggactcgggacttggggcaaatggaagaggacgactaggggatgctttatataggcttggattagagagatcggactccaaccgagaggaatcgagctgggaaaaactagggttagttttttttaccaggaaaactgccagggctttgcccaacagtgtaattttataaataaagaaaatatttacaaggttacaaatattacatgcggttcacacagagatactataaggtttgtacccaattaaaaacagtttgctttaaaggttcattcattatgcacatatgcagaagaacttctttgacgaaaagagatctccatgcctgaaaagagggttggatgttctgaaatatgaagccatttctttgtttccagatgtgccaagctgccaaaaagaaaatttccaggaaacccttgtgagcaaatttgattcttgctagagagatcatttggaaaaactccaaattgttattccactcaattcctaggtattgccaacacctgatgctgaaagggcataaaaagaagaggtgcagtcttgtctctctgcagttcgcattgcacaaaacacatgtgagatcatcttctttggtacaatgtcttctatccagcatatctcttgtattaagtctatcacagaacattagccaggcaaagaccttgatcttcatgacacattttgttttccatagccaaatcatgtgtctggggggttgcaatgcagaataatttcttagcagtgtacttatctgagccccagataaaattccaagcatcccccatccctgattgtaagttcaaggtgtccagaaccccctgaagttgcaagaattctgaataagcctcatccgagagggatagagcaaaagaatcttctaggggtagctggtagacatggccttgactgaatcagacttatacaaagtcacagcaaagagattggggtagctggtgcacttaaaatcatcattccatagatcattccagaaaagggcagttcttcctgtcctgatttcacattttgctatccccctgaatatgtctgcaagagttgtgatgtccctccaccaaaaagaacccttattcatcgtcaggtgtggaactttagaaacatagtatgattgtgagattaatttcacccatggtaaatcagcaccattatagaacttgatcatatgctttaggaaaagggctgtgttttgaactctcagattgatcactcgtaagcctcctttctctttaggcatgcacaccctatcccagcacgctagagatttccttgtcgaagaagggttattacctctccacaggcaattcttacgagctgtgtcaatgaccttgatgactgtaactggtagctgtagtgaggacatgtaataggttgggatagaggacaggactgagttgatcaaagttaatcttcctccttgcggtaaaaaaattgagcttgccgtcagcctcctttcaaccctgtctaccaatgtagcaaatcaaccactctaggcctggtggttcctaaaggtagccccaaataagtgaatggaagagaaccgatcttatatcccaagacgccagataataagatagctttgtcttgagacatattaagtggatacaggcttgatttattatagtttaccttgaggcctgtggattgagcaaacatatttaaaatagccttgaaacagaagacttctttctgagatacttttaacaagatcaaagtgtcatcagcatactgaatgattgggaaaccatcttcactgctttcattaattggttttgacaaaagtccttgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6398 - DNA, 977 bp, Oryza sativa
  unsure (1)..(977): unsure at all n locations
cgtgactggatgtacnctgctggaaacancncatnnagaagatggagncagtttacttcgaagttttggcagaacttacaagaagggatgggtactcttttgaatttcttttctgcctatcaccctcaaactgacggtctggcagaaagagtaaattaaattctaggagacatgttgagagcctgtgttctagatatcggtggaagttgggataagaatctgtcgtatgctgaattctcgtataacaacagttatcaagctagtcttcaaatggctccatacaaagcattgtatggtcgtaagtgtcgtacaccgctcctttgggatcaaattggtgagcgtcaagtttttgggatagatgtattgcgagaggcagaagaaaaagtgaagattatccaagaaaggttgcgagttgctcagtcacgtcagaagagctatgcagacaatcgttgtagggatttgactttcgaagaaggggattatgtatacctacgggttacgccgctgcggggagttcatcgttttcagaccaaagagaaattggcaccgcgttttgtgggaccttttaagattgtgagtcgaagaagtgaagtagcttatcaactagagttgcctttgtcaatggagggaatacatgatcgttttccatgtgtcgcagttaaagaaatgtttgagtgtacctaccgaggaagcagattctgagcgtttagaaagtcaaggagatttaacttatgttgagaagccagtcattttttttgaggtgagtaagggggaaaaattttttttttccaaaaaaaaagggggaaaaaaaaagggggaaaaatttttttttttaaaaaaaaaaaccccctttttttttaaaaaaaaatttgggggggcggaaaagcaagcagaaattttggagtgagtgagagaaacaacccnnnannnnnnnntncnnnnnnnnaattttnanaagctagacactatctgtatta

SEQ ID NO: 6399 - DNA, 1240 bp, Oryza sativa
  unsure (1)..(1240): unsure at all n locations
atctggcggtcttcatcggtgcgcacatccttctaagcataccgagcagatgatttaaactcgtgcagatactccgtgactgtgcgagaaccctgttgaaaaaaaaaaggggccccccccggggaaaaaaacccccccccttttttggggaaaaaaaaaccctttttcccccccctttttttttccccttttttttccccctttttttggaaaaagggggggggaaacccaaacccccaaaccttttnccccccggaattgggtaaattatgcgttctttgcgcaaagcagcggtgaactcaagccaagagataggttcagcagtagtcctgttaaggcaggagtgatcccaccattccgaagcagggccatgcagctggtgtgacgcaaaagagaccttctcctggtctctgcactggagcagatccaacttcttctctatggcgtgcaaccaatcactagcttcgacaggattagtggtgctagagaaaacaggtggcctcacgcgaagaaactctgcaagcttgttctgaggaggcgcatgattgttcccttggttctgctggttttgaagttgctgcatcatcagattcatcaactgtgtctgttgggccaggacttgagcgagcgtgggattctccgcattgttgttattgttgttgttgttggggccattcccgttgctgcgagtgagcaccatctgacatagacaggagcacaagaagagaaacaggggaaaactacttaggatagggaattaaattaattaacttaacttttattgatcttaactgagtttcattattacaaagctgaagactctcacaccacctaactcaccaacttcctaacactcgaaagcaaacaaagacatgcatttacatcccaccaatgatgtaaacacatgcaggacccacacacacaaccaaacttaagcaagcaaactaacacaacgatctaagggcaatgaactttaagccaacaaaaaccgggggtttcctttaaaggggggtttcttttttttcccccccggggggggggcccccaaatttttctcggggggggaaaaagggttttttttttgggaaaattttttgtgggggaaaaaaaaaaagggggggggggccccctttttttttttcgtcggcacgttcccatcatcttgagttggtccccactcgatcttggaatgggtgcgctttggattcttgtcatcatcatcacttacattgacgaaggg

SEQ ID NO: 6400 - DNA, 1596 bp, Oryza sativa
  unsure (1)..(1596): unsure at all n locations
acggcatttgattgacatctctgcaagcagctcatcaaatagctattctataccccgggtgtagaatagtttttctaatatatatatatatatatagcctatttcctactaccgagagtagttactccctcctattatggatcggattcagttaatggagtgacgaggatccaataacgatgaatacctgtgttgtttaattaaatagtttgttagttcagatagttgctaaatcatcggctgcatgcaaaccaacttctcggatgcagtttcttcctcgcacccgctcgtcctggcatattatcttctgctcgtgccggtggaacatatatattagccggccaacagaaaaaatggcagagcatgaattaaaaaagaatgacnagaacattcaactttaaaaaaaaaaattttagggccaaaggaaaaaaacacaaaggccccccccaaacccccccctcttaaaaaaaattttttgttgtggttttttttttttttttttttttccctttttttcccccccccgggggggaaaaaaatttttcccttttgggggggggttttttttttttttttttttttttttttttaaaaaaaaaaaaaaaaaaatttttggggggttttttttttgtggggggccccaaaccccccccccaattttggaaaaattgggccttttaaaggaaaaaaaaaaaaaaaaaaaaattggcttttatcaaaaagatagatcccatcatgactatattttaactatatttgagcgttgttactgcatgtaaaacacagtgttactacacggtgaccgtcgcgttactgcacagtttcgcgaaacgagagcttctttttccacatcgccgcgtgaccatcttcgctatcaataggctggctgccaggcccctttccaaacactactttaagatctttcaccatagcaaacactgttttcccactgcgatgtttaggcttcgtacggtggtccgccttatgttcaaagtgattgcctttcttccgtacagggtggtttgcagcaaggaatcgacgatgacccatgtacgcaaccttcctacagtgcttaagatacgtactttctgtttcatctatacagtgagtgcaagtcttggaccacttattagactgccccgataggttgctaggtgtaggccaatcgttgattgttacgaacagcagcgctcgtaggttaaactcctcatgtttgtcctcgtcccacacggngacactttctttcttccacaacagtttcagatcttcgaccagtggtgttaggtacacatcgatgtcgttaccaggttgcttggggcgctctgaaataaaataaaatttcggggggccaaatttccaaaatttttaaatttgtggttgaaaccccttttttttcccccccctttttttcctttttttttttcaaaaaattggggggcccccaattttttaaggggggcccccccccccaaaggggaatttgggggggcgggggggggggcaagttttagatacacatcataacgggccaagtgctatggccgntgntaatntntncnanngnnnnaatccataagaacgttaagacaatcgtac

SEQ ID NO: 6401 - DNA, 5711 bp, Oryza sativa
  unsure (1)..(5711): unsure at all n locations
ggcgtactaaaggnnngccctaangctcgcttnnngcnnngnngtnnnncaagggcntcgagcggtagttcgataccaataagattcattagccccgccccccacaaaaattttttaaaaaaaaacccccccccnccccccccccaaaattttcccccccccaaatttttttttccccccccccaaaaaaatttttaaaaaaaaaaatttaaaattggggggggccaaaccgggcccaaattgggttaattttttntaaaggatnnttattctttgaccaagaattagttttaatttacaaagatatttgatagaaaattagcatcatttcaacctgtttttcaatacgaatacaacaattctatgtatatattactagtcatcaacctgtgcacttgcatgggctagaaaaattacgtgacatcaattaactagcgtggaagctttattggtgcctccaattactagatataagattttttctttgtttctcaattctttcggtcaataacgagcatgtgtgttattcatagaaacggaggtaggtagtatttgtaagaagtacggtatcgaatttcaaaaaagttccgaccttgtgcgataatatacacacatattaacctacataggcaagctagccagacctagaaatataccatttctaaacctattcggtcacttactcacgttggggagcctaactaaactaacatggactcacatggcatgcaagccagccatggtactaactcggctactacgccatagtacgctacaaacacaactaagttatcgtatgaaggactactcaatagtacacttaaaacaatgttactcgttgccttttaccttcatttgacgggtacgacctaagtgtatctgaaaatcttctcttctgtccatcggcgaaagcgtgcaaatgtaaaattgcctggtacgcaggactagatatgaagagtttgttcagagattgtgcaataaacatgtacatccatcaactgtatacatgcataggatatatacatacaatggaggtagccatttgcaccatatccacaatatacaagtaggcagccattcacaccttatccataccaggacgatccatttgcaccttatccacatcatcacataatgcttctgcctataaatagcagcagcaccttacattcaagaatcacctctcaacacaaaactaagaaacatagcaagataaccagggaaggtagcatcagcaacaggaggcaatggagggaaagaggactaccacttcgatggtgatcatgtgcctggtcatcttgagcctcactgtcgactccgccaccgcggcacagtgcggctgctgcatatcctctcgggcaaaagcatgttgttttggttgtattgctgctggtggctccgactcagtctgcaagaacacttgttgtttcccatgtattctggccgattctggtaaattcactaatgtcactctatttaatgcatttcttatatgtagatacagactttgtagcatatcgtggactaatacatatgtacattgtcctcaatgtacattgttgatttcatttccaatctcacgacttcaggcatatatcttgcaacacgaagacatcttatgctctacttccactacaaaattgactaatgcgctaatgggattttcatattttaatttcacagttgttgctaagatggacgaaatgggagttcttgctaagatggacgaaatgggagttcttgctaagatggaaggacaagcctaaaacaacatgcttgcattgctaccagtcttaatgcctatcataagaatatgttgttttgcttcaagttatggccaagttatgttaatgttatcttcaataaattattgaccatatgggacgatctatagtggatccatctgttggtctcaactctatgtatgtcgtgcatgtgtgctctcacaagcatatttaatttctcttgctgcttttaataaggccatagcactgtccattgtgtcatccgatggtctctgaccttagcaatttattacgacatgattaatattatttgtgtatgcatgttctttacttaatttattcttagcggatttctgatgtttttgtgagttttagactatgggacataattaagattgtcatgccaaaaattattgcaaaacctagtaggaaagcaaaagaggcggggggggggaggaaacatggtcaatttctcggctgctatcacattcctcgttttcaaaggtttgggagacatatagccacactaaaggcagtaaacctgaggaatgacaaccttactcacaaggacaaatagtcgttaaaaaactatgacatcactaaccatatcttatttcagttcaccaaacatacatttaaatttaggcagtattacggagaactaaatgaacaaacaacaaaccatacttcattgtcaaaacaaattgccttctatgtacttcacaaattctcacaagatcatatttgcaatttttcctaaactaattaaccaagagcaaatatgcagtggagcattccacatataatttcacattataagtacataatacagtatggtataatacacatatgcatactagggcctacggcaaaagaggcaaagatcaatgtgcatgctaacttgtgtataatacacatatgcacagtactttgaaatacgcataccaggatatatgcattagttcacaccattcattcttgcattcttgcactttcaacaacaaccagatctaccaagcattcttgcacattaaaccacaagtagatctaccaatgaatcaccaacttaggtagcaatgggggtaatcggaggggaaaaccttacctcgtcagacgacggaaggacaggagacggcggaagattcaccggctgctcaccatggcgcgcggatccctgaggtgtgggcatcacatctatcagcaccaatgacatcggcgggggggggggggagggggaggactagggctctttcatagaccgatgtaaactagacttattggcttcgatttagggagaggaaggaaaagagatagactttacctggcatggctttgggcctgcacggagaggtatagtagttggcttggtttcagccaaaagatatgaagagaattttaaattattttttcaatttaaataatgaccgaaattatgttagtattattaaaattacttctttagctcggaaaatttcaagaaaatttaagagagcataattaattattgagaagttaataaaactattccaagtcatattttacaaggtaaaattttatttcacatatcaacttgtaacatacaaggaatttcaccatggaaaaattttgtggaaaatttaaaactttttgaattcaaaagtttttggtgaacatagaagcatactagagcatataactccctaaaataaaataaaacacatagtttttttggccaaatcaaaactaagtccaaaagaaaaagtttacaaatcttgtggtaaaaaattttaaaacaaaaattttgctttgaccataaactagaaacctaatcttctcggttttgcattttcaacctaactaaaaaaatatatttaagttaaatataaaacaaattgaaaggtcagtatcaaaatacgcaaacctaaattgagataaaaagaacttgcttgtatgtgcatattattcttttaagattgtttttggatattcttggtacatctcataataggttgcatatgcatgctttgtctaaagaaaattcctaaaaataaatgaggcaacaataaatcccaccaaaattctcataaatactaaacaataccctaagctcccagaaattttagttataataatttatcacatcaattggtaacccaaataaatccttgaactcagctaaaaaatctggaaacagcataccaattagcctactttgcaccttcaccaaaattaaaccataactcatcttgcaaaatctctaggtcagaatgttaaacatactttactctatcatctggtgcaatggcttagtctaattcgaaatgtaacctcataaaatgagagccataagttaggtaaacagtattctggactgtggtcaatagattaactagtcaactttactaaattaccatggcaaaagcaaaagtaattaaactttggaactaggcaccttgaacaatcaaatccttgtctaccttgctgtctccctgtcaccccccccccggccttaattctaaattaaatggatgagagaaagagagtaatatagtttagtgtgatagtgccaacacatggaaaatttagagcttctagttctctccttctacatctctcttaaatgtgggaccaagtccttatggggcccactcatcatacaaccatagccaacacatcatctgctcttctctcatttaaatcttcttttatttctcaaaaggtgagagaagggtttaaattgaatttccacccaaaatgccactctaccactccaagccttctaggaaacatctatatatgggcctatttgtcgtccaaatacctacaaacaaccttggtgaatcatctctttgatcctaaattatattttcaaagagagaaagaaagagagagagggaattaaagtccaatttacacccaaatttcaccatacctctcatcttctcataggaaacatctacatggggccactagacagccactcatgctaggttgagtgaagtacaagtgggatcatagcctcaattcactgccaactcctttaaatcgtttctacccctcatgttgacacctagctctcactttccaccttcactttcaccattcactactacaaccaagatttttgtgtgagggctaaaatgatttttgcgtgcgggtaaacggcccgcatgcacttaggggtctgggaaaatgacgatttttgcgtgcaggtgaagcaccaccacaggaaaacaaaaacccgaaaaaacataaattttctttaaaaatgaaatcctagaatctggtggtggcgccgccgctcttgcttgccgctgccgcctcctcgtcgtcatcatcatcgtcagtggcggcctccgcgccgctcgcctcggatccgtgctcccctccggccgcaccgccgccgacgcccctcccctccgccggatctagggagggaaggaagaggaggggaggggagatggatgccatgcggggggagggcggccggccgctggatccgtgcgtggacgaccgccaccgctggatttttgcgttgatggccgctgccgctggatccgtgcagggacggccgccgcccgccggatcccacgccctccaccgccacaacgtggaggaggccggcgcgtgcctatgcccaccgcggctgtcaccgcgcgccgccgccgctgccgccatcgggaggagaggagaggacagtggagagaggagaggacattggagagaggagaggagaagcgtgagagagagaggactgagagaagaagctctgcgtggaaattttaaagttgaaaatgggattgaggggaggggagaggagagaaagaggtgaaattttaaagtgtgtgagtgggaaaagagggagttagtatttttgcatgcggccctcttaataggtccgcacgggaaaatcggctcattttcacgtacggtccatctaagatgatgtnctacttgcngtaggagacggtccttatctggcgcgcg

SEQ ID NO: 6402 - DNA, 777 bp, Oryza sativa
  unsure (1)..(777): unsure at all n locations
ngggccaaatcagctacatcttgggctttgatgaaattcggggcttgaataatatgtccaaagacatcactcccagggcccactagcaatacgtccgtctgcttggcggttgtgcagtatatcactgagtggaaatgatgtcaccaccgttaccgagtgaccttgaaagtagtgagacagcttcctggtagtaattagaataccatataacagcttctgaacctgagggtacctcgttttgaagttggctaggacctcgctgacaaagtaagtcggtcgctggactttctggacatggccttcttcctcgcgctcaacgaccaagactgtgctcacaacctgggaggtggctgatacatacagcatcaacggctcctgcggatgtggtgaagctaagactggtggctcggtgaggagtttcttgaaatcttcgaaggccttctgtgcttcgggtcccggtttggagacaaaggatttatacaggttcaggccttcttattcaagaagtaataccctactcctgtccggggatggatccgccgagtgtattattgattgtatgattgggagaaaatcaacctatgccccaagaggcacccggaccctccttatatatgggaaggagtccgtgttaaaaaagataatctatatccctaacggaatatgcagatacaggtaaaatacagtcgtaaccgactaagtctcaaggtgtttccttgatgtacaagttaagaaacgaacccgagatgattgctactggaactgacntcacccctc

SEQ ID NO: 6403 - DNA, 14754 bp, Oryza sativa
  unsure (1)..(14754): unsure at all n locations
gcgtgcaattgactacactggtacagcagctcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatgcatcgtagtacacttggaaacccttctttggatcaggcaaaatcaaaatgggagctgatattaagtgacttttcaactcttgaaaactctgctcacattcttctaaccgcttgtacttcacatccttctgaagcagtcgtgtcatgggcttggcaatcttggaaaaattctctatgaacctccggtaatatcctgcgagacctaggaaactgcgaatctctgtaactgtcttcggttgtttcgagttggttacagattccatattactaggatcaacggcaactcctcctgctgagatgacgtgaccaaggaactttacttcagacaaccagaattcacatttgctaaacttggcatacaactgatgttctcgcagcttctctaatgcaagacgaagatgttcttcatgctcttctttagtttaagaatatatgagaatgtcatcaataaagacaaccacgaacttatccaggtattccatgaacaccttgttcatcaagttcatgaagaaagcaggggcattggtaagtccaaaagacataactgtacattcaaatagcccataccgagtagtaaaagctgtcttaggtatatcttcctccttaatccttaactggtgataccctgatcgaagatctatcttggagaaaacggtggcacctttaagttgatcaaacaaatcatcaatactaggcagtggatacttattcttgatagtcacatcgttaagtgcacgatagtccacacacatcctctgggtatggtctttcttttctacaaagataacaggagctccccatggagatgaactcggtctgatgtatcctttctgaagcaaatcatctacttgcctcttgacttctgccaattcgttggctgccattctatatggtcgcttatggatcggagttgttcctggcaccagatctattctgaactctatatcccttttaggcggcataccaggtaaatcatcagggaacacatcagggtactcccggtctataggaatctcttccaaagttatttggtttagacttgaccttcgaggttcagagggcaatgcatgaacagttacaacttgaccatcattgctggtgagagttacttttctattggcacaatctatcacacctttatatctggctagccagtccatccctaggatgacatcaagatctttagattctaacagaataaggttggccaggaaaggtacacctcggatctctattctgacagaggggctacgttgtgaggagagtgcttggttactcggagtactaaccatcaaaggacgtctaagctcctctacctccatcccatgattttccgcaaaactcatagataaaaacgaatgtgtagcaccagaatcgaaaagcactgttgcaggaactgagttaacagggaacgtacccaaaatcacatctggagcaccttgagcttctgcagcagcaacatggttgacacgagccttggctgctggtgcggaggagttgttctgggcagggacgaccttcgcgcggcagggcttcggacacttgtcagcataatgtcctgggtctccacagttgaagcacacaccgggcttgctgccttgctccctcttggcaggctattgctgcgacggagttgccaccggacatggagctggcttgcggttgttgttgcccgcgttgttgttaaagaattgtcgctgcggacgaacaacagacgaagaacctccctgtggcatggacaggggtcccgaagcaatacgcggcctctgactatttccctgctgtgccttgaagtgagcaatccggtgtttcttctgctccatgcgattataattgtcctcctgacgaatagccttatccactaacttctggaaatcgtgataatctccagtcatgagtgggtaagaaagctcatcattaagtccttccaagaacttctcctggcgctcctcatcggtgcgcacatcctctggagcataacgagccagatgattaaactcgtgcagatactccgtgactgtgcgagaaccctgtgtgagcgacctgaactccttcttcttgagggacaccactcccgatggtatatgcgtcttgcgcaaagcagcggtgaactcaagccaagagataggttcagcagtagtcctgttaaggcaggagtgatcccaccattccgaagcagggccatgcagctggtgtgacgcaaaagagaccttctcctggtctctgcactggagcagatccaacttcttctctatggcgtgcaaccaatcactagcttcgacaggattagtggtgctagagaaaacaggtggcctcacgcgaagaaactctgcaagcttgttctgaggaggcgcatgattgttcccttggttctgctggttttgaagttgctgcatcatcagattcatcaactgtgtctgttgggccaggacttgagcgagcgtgggattctccgcattgttgttattgttgttgttgttggggccattcccgttgctgcgagtgagcaccatctgacatagacaggagcacaagaagagaaacaggggaaaactacttaggatagggaattaaattaattaacttaacttttattgatcttaactgagtttcattattacaaagctgaagactctcacaccacctaactcaccaacttcctaacactcgaaagcaaacaaagacatgcatttacatcccaccaatgatgtaaacacatgcaggacccacacacacaaccaaacttaagcaagcaaactaacacaacgatctaaggcaatgacttagcacaacggtctaggtcttccgggcatcggagttgattgaaggctcgttcggcacgtccccatcatcttgagttggtccccactcgatcttggaatgggtgcgcttggattcctcttcatcatcatcacttacattgacgaccggaggatccgctggggctagggtagcttctttttccaccacacgaacctttggtgccaactggtagcgagggacgaatagagctctcttccttgcggtaagacgaaccctggccttctgcggtggtgcttctcccttcaatgctgctagctctttctccaaacgatccagcttgtcttctagcttgcagatctttccccgattctggtcttcacgatcttgagcggctatcacgatctcagcgcgggtttcatccatagcccatagcatctcaaccaagtgccttgtggtagcatcattctcgatcccagccggttcaaggtagctgccatgatcacttccctggggttgacgaggatggtagcgatactcggtgtcggccaaccgatcattgtagctttcacggagctctcctatggcgatccttgctacctcctgacaagcatggatgtagcttcctcctccagcctcgaacatcactgatggaatatcttcacgattgctgttcaaggtaactttgacccggcacttctcttcatcacggtcatgagggatctgggcatacaaaggggcaatcccaaatcctatgaggaaggacatcgtacgcaactcttggacaaaaccttcagtaccgaacaaatactcaggcttgtagcgcggcatctaagacaagtgacaggagggagttaagtcaattatccaattaatagcacaagtttttgggttagcttgaataaaatttgaaaagtaaaatggtaaataaagtaaaccaagcttgcatgataagatgaaacagttagaatcatgctcacaaattttgcacttttgaataacaagtttcaaaggaaataaaataaaagagggttataaaatcattatactaagcttagcttattgtagcaaaattaaataaagcagagttataaatcttttgatggtaagtgggccattagcacggtaatagatgtacagtactaacaacataggaataataaataaattttaaatgaaaacagctaaagaagtcataaactgcatgtgctattagtttggtttaattaaaagagaaaaagaggagaatagttctacttttccaatatttttagagggcttctataggtaaccatttggcataacctagggtcaaggaggctctgcaaccaatttgtcacacccggaatttctatccaaaattccaaacgcttacatgtgtataaaccctcgtccaggaatcagccgaggcacacaataacaaattgataatagagtataattattactctaatgaatattcgaataaaatgtcgttatagaggtagatagttcctctcaatcaatatagttctaagcagcggaaaataaaagaaacagcgcaggcgactcctctccataggcagcttgaccagggctacgcctaatcatccacaccatcagcatcgctgtaaaactcctcctctgatgaatgattgcaaggtgagtatatgacatactcagcaagccacgcagcaaatatgcaagtgcacaggataacaaaggatggcatagtataggctcatttgcataaacaacatttaataaatatttcagaatttaatgaaaaagtaaactattaattaaacagtattaatcgaacgctatacaacataccctgttgcataggcccaaccattcccggctgcacagtgctatctccaaactaggaattaaccattccaaaccaggagttaaacaagacattaacatcatcatttaatagagtgagaaatgtgagactaatcacgaaagacattgttagacccgcccataaccgcgggcacggctattcgaataatttaaactctggccagaggtgtaccactgtacccacaagacacaacctcaacatcatgtcaaccatgcgtcgcgatacttgacaagtacccgaattgagattgtgacaataccctctatataatacaattcaaagcagtgcaccgttcccggatcataatgacccccttataaacaaggtatggactccccagcgacccccgtgggcttatcaccgccacttcacagtctggtgctgtacaacgaaccatactatacagaaagtaaagccgttgcccacgctggcttgtggttggcacggtaaatgtttcacaaccaaaacttgtgaaccggtccttaattgtcatgaacacaaccatcaaaaccatatgatcacaacccaccattatcaagttttagttggtaaattaattaattaaccaatcatgggctattattaaaccatcattaaataatagtgaagcataagttatcccagtagtgtgctaatgtttctaagcatggctaagcaattatgcctaacatctagctgaacaatcatataaagctcaactagtcaaattacattaatccaaggtatcaaagaataaagtaatcaagaacaaaagggccataacaaacaataggttaattccacccaatgacattcgaaaataaatgcaatagttgaatagaaacaatagctttaaacgggatcaacatgctcaaagggttgtttgtgatctgtgtgtgacttgccttgctggccttggaaatcctcaaagtcttctcctgcaaaatcggactctcccggaacgtcggaatctaaagagaaaagaacaaaatctccaaaacagcacataaacaagcatgaacagtacatgtggatatttttaacatgtagatctcaattttagaaaaatttagagacttgaaccaactaaatccgagctaagatgaattagttatgtattttcaaagattaaatcgatttaaatcatttatgtagattttaattgaattatgacgcaataattaattatttttgaaaaggaaaagggaattattgcgtcagcgggtcgggtttacggtggaccgggtgcatggcggcggttcacgaaacggacggccgagatcgatccatccaaaatggacggccgagatccatcggtccacggctagaccacgagggacgacgacgatgacgtcagcgacgacgtcaccaccggcggcggctcgggcacgcatgctcgctggcgaacgacggcgcggcggcgcgaacggagggcaccgatacgatgcgggcatcgctgcgaactcaccggtgaccaaagcgacggcggacgagcaacggacgacgtcggcgacgaggaaaaggcggcggcgaccttcggcttgacaatggcgacggcgttccggcggtcaacggcgacggagaaggtgcggacagagacggcaacgagacggcgatcacgacggcggccttcccgagcggtgacgacgaccggagcgacggcggcgatggctgctcaaggtctcacgcggaggcggcgctacagacggcgacgggctaaggcgagagtggcgacgggtagaggggagctggggggtcaatttataggggctagggagcggcggtgaaggcccacggcgaccggcgacgggaaggaaagtttagggttcggaggagagagatcgatccgaatcgaactcaaatccggcgatttccaaagcgatttagacgatgtttccaaaagggaaaaggtagagtggatcacggggatcctttcccctcaatcaatttcaccggaaacggaaaggggcggccggatttggaatggcggcggcggcgcagctcggctagagtttcggcgagaggaagacgacaactaacaagtgggacccacctgtcagcggcggttgcacacgcgcgtgcgggcgggcgctcggcttgccccgacttgggccgagggagagagagagagagcggtttgggccgactttcggcccaaaaccaaaagggaattttaaaaacctttttccatttaaattattcattaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttataatttggagatttttagggtgtgacaactagttaagttataataacccaaggtatcaaggaatagagtaatcaagaacaaaagggctataacaaggcaataggttaattccacccaatgacattcgaaaataaatgcaatagttgaatagaaacaatagctttaaacgggatcaacatgctcaaagggttgtttgggatctgtgtgacttgccttgctagccttggaactcttcaaagtcttctcctgcaaattcggactctccaggaacgtcggactctaaagagaaaagagcaaaatcaccaaaacaacacataaacaagcctgaacagtacatgtggatatttttaacatgtagatctcaattttagaaaaatttagagacttgaaccaactaaatgcgagctaagatgaattagttatgaattttcatagattaaatcggattaaatcatttatatagattttaattgaattatgacgtaataatgaattatttttaaaaaggaaaaagggattattgcgtcagaggactcggctcacggtggaccgggtgcacggcggtggttcacggaaacgaacggccgagatcgatctatccaaaacggaccaagatctaacggtctacgaccggtctacggtggacggcgtcgatgatatcagcagtgacgtcatcaccgacggcggctcggcctcgcgtgctcgccggcgaacgacggcgcgacggcgcgaatgaagggcacctatgggttgcgggcgacacggcgaactcaccggtgaccaaagcagcggcggaaggtcaacggacggcgacggcgacgaggaagaagcggtggtcaccttcggctcgacgacgacggcggggctccggtgatctacagcgacgacggagaggcggacgaggtcgacgacgacttgacgatcacgacggcggctttcccgagcgacgacgacgaccagagcgacggcggcgcacggctggacgaacggcagcgacggcggcgctagactacacgacgctagggctctaccggcgacgagagacgtagccgagggtggtggtgggtagaggagacaccgggggtccttttatagcggctagggggcggcggcgaaggcccacggcgaccggcggcggcgatggaaagtctagggttcggggagagagacgaatccgattcgagttcgaatccacggatttccaaacgattttagccgatgattccaaaagagaaaaggtagaggggatctcggggatcatttcccctctataaatttcaccggatcgggaaagacgcgatcgaatttggaatggcagcggcacggctcggctagggttcggccgggcgacggcgcaaggaagacgacgagtctgacaggtgggtcccacctgtcagcgggcgagggcgcgcgcgcgcggacggcgctcagctgcgggccgacctgggcttggagagagagagaggtttgggccgactttcggcccaaagccaaaagaggatttaaaaaacctttttcactttaaattattcatgaaatgcaattctattgattaaaaatactttcttggctcaaataaatcccagaaaaatctaggaactatagaatcaagcaaagtatttaataaaattttatctggcccaattttatattgaaatttattatttaaaaatagatattctcttctaggcttttaaaatcaattctaataattccaattaaacaacaatttatatatttgggatttttagggtgtgacataggtgacgaatattcgtcacacgaacgttagatttcacaacatgacttaaaattcaattttcatgacgtaaattagcatcacctacactagtggagaaaccctttttcctcccggttcgtaacccccctttagtcccggttatccaaccgggactaccaatccgggactaaagatcgctatctttagtcccgggtgaaataacctggaccaaagatcgatctaccaatttttttcttatttgcatggccctattgctgcaaggtttagagtttatgttacaatacatatatatgctttatatatatatatatatatatatatatatatatatatatatatatatatatatatatatatatatatatatatatatatataggacggctctttcgtacactcaggtgtatgtacacccttttattaatggatgatccaattagcattcaaattagctatgaaaaaaattaataatattaatttccaaatgactgcatgcatgtggcatagctgcacaccggattgggtgcagatttgaacaagattgttggcatgcatttgctttcaaatttgataacttaccttagatatccccaccttttctagtatgcaactgtcgcgtcccaaaacgactctaaaatgcatcctcaaaattgtgcatagaataattaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtctttttcccccttccccctcttgggccggctcggcccagctccctccctctctctcctctcccccgcggcccatccggccttcccccgcgcgcgcgccgctgacgggcgggcacgcccgccaccctcgctgacgggtggggcccacccgtcatcccctacctcgcgccgcacccgccgcctcgcccgtgccctagcgccgccgccgccgcggattccgccgcatcccgccgcccccgcgcgcaataaagagggggaaatcactccccgtgattccctctccctttccccccacttttccctctctctctccctcggattcgtttggaaacactcccgcaaacctcgccggcgccattgatggagcccgagatcgccgcgccggtttccttcccctccggccgttctctccccctcccaacactatataaacgctccccgtgcctccctccaccgtttccgccactcgccgctctctctccccgtcggaatcgagctcgcgccgtcactccctctctccgccgtcgccgccgagctccggtccgccgccgtcgtcgccccggaccctctcccgtttcggcgtcgcttttttcgggttcgccgcaacctcgccgacctcgtccacccctccgtttcgcccgccgaccgccggaacgccgtcgccctcgttgacccgagccgcgccgccgccttcctccgctccggtcgccgtcccgtcgtcaccgtcgacccggggtgagccgtggaccgccgtttcacttcccccttccctcccctttctcgggcgccgctccgccgcgccggtggtcgccggcggcgaccatcggggcgcgggcgcgtcgcctcccgtcggcttttccggcgaggccgccttcgggcgcgccccgcggctgccatgtggggcccggccgtcagccgcccgcgccctcgggtgcggctgacgcgtgggacccacggcgccgggcggcgtaatccgcgtgcacccggtccaccgtggaccgagaggctgccgcgtgggccccactcccgtggacccggtccgcgcgctcctcccctcagctgacttaataaatccgattttaaattaaaatttaaatgaagaaattcgcaaatatccatttaaagagcatataaacttcaaatggccataacttggccatttgaactcggaattggaccgttcaagtctctaatttttccttaagaagccaagaacccatttttgtgctttgtttctgtttgttatatggagtttagtagagtaaaagccgtttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattatcattgttattgttattatttccttgttcaccctagaataaacaaaaccccaactagtggacactctactcatggtatcactagtatgattttaggtagatgcttcgcttttaattaggtaacattaggcggttttacaactctagactttggggatattcatatcacgtggacactatggaatggtttggttatcgtggaattggcttcacaccgctccttccattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctaatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataacattgtatagtactagaatcgtgtttgcaaaatagccctgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctagaggatgaaggcttcggtgtctagctcgtgcctgccgtcaagtgcctgtggtcgtcgcccttgtcttccgctgtttctcgtttgtctttttgtgtgctgggccttcgctgcccgtgtaataaattaactatttacgcttccgcttgttaaactctgaattgtatcaacttttggtgtaccttgcctcctgggacaaggattaatgcacgcacgtaaggaacgcccgttgggttatttccggtcgtgacagcaacagtatatactgttttttaagccgcagtatatatactctttgaagtgatgagcagtactatatactagttttttttattagcagtacgtaataaggagtaccttatatttttgttgtagcagtgaatagttctttttttaattagcagccgtatatacttactccagaactaacgagtatatatatactgattatgtctttttattggtacgcgcagtatatactactgcaacgagcgaatgagtatatactgttctttctcagaatgagtatatactgattttttttggaacgagtatatatactgacttttctcggagtggtatatacttatttcttctccaatcggtatgaacagctactcggagtggtatatacttatttcttctacaatcggtatgaactcattgaaggagtatatactgcttctttggtcagtgtatatatactacattcctcattgaaggagtatatactgcttcttttttttatcagtatatacatttgttattaattgagtatatattgtatgcactacttgtcctgtcagtatactgcatatactaattgtcatgtttggtcggtatactgcatcgtcctcgctaaaggaggttatactgccttttcgtttgatcggtaaatactacgtatactacttttttttcactcagtatataaataagtatgtaccagtatttcttagataagtcgtatatttgctatccatggaagctggatgcatatgcttttcagttgaatagaataattaatatgcttttcacgtgcaaattcagaagtctgcctgaatcactagcaaagtatcggctgttgcattatgaataaacctaaattaatgaaataccctagaagggcactgaattctgaatggacattaccagaccaaagaaaaagatcaacgcagactttcggaaactaagaacaaaacataacgggatcacccctcgatgtggctcatcgaagaatctctgcatccccacagacagatctcggttaacatcgatgggatcacgccgaccgcacgccagagagaggtggacaagaatgtgtcttcctggattaacaccgttagctaggaatcacgggttcgatgccgacgacgatgctgttgccgcacggccacacatgctggactgttctgtcatcagcaccatctacgtccacgatacatgcatctcgcatttgcatgcaccaaacaaattcgatctgcatgcatgcattatcgatttgcaacctagaaaaagcaaatcaagaaaatcgaaagaaggaaggacttgcctgcagcatagtcgatgttccagttccggacgacgctcagcgtcgtcttgatcgtagcatgggcctgcatcgatgccgtcgccgtacggccacactgacttgcccgaagatcaatggcgtcgttgtctggtcacagctcttcggccagccagtcgcctgcggatagtcatactgaaggcattggtaatggaagacgccggcgtagacatcagcagacgccgtgaccttcgaatagccgatgggtcgcgccgtcgtcgccttcgaatcgccgatcgcgataacctgcggatcgatctgtcgattctgtttacaaccacccacgagattttaatacgagctattcaaaagggttctggttagtacggaataattcagattatgaggatttttttcgtaactaaaaatcaaaacgggctcggtatatggatccgcttgctgacttgatcggtggtgttcgctgatggacggtggatggaaccgggagtacctactcctgggagtatagaatcattatatatgtatatatatatatatatatatatatatatatatatatatatatatatatatatatatatatatgtgtcctatatatatatatatgttgatgaactgctgtaccaactgatagtccatttcnccactca

SEQ ID NO: 6404 - DNA, 26304 bp, Oryza sativa
cgtggcaatggtcttacagatggtacagtagctcatcacaaacccgtcggtgactttccccacgaccctctctcttcttagctctcgtctcggaatgacgtagtaacatgttgttcatcatgtagtaacacaatgttttacttacagtaacaaaattaaaatttactcataatatacttatgatggatctacttttggtaagtactttttttttgaacatcatggtgcaaacggtttttaaaaatagtacatggtgtgagagatattacccttcaaagatttgtttttaagatttaactctccacaagtagtaatactaaattaaaagttttactactgcctgttttgcgttactgcaatcacatcatgtcattactacaagatgtagtaacgattataattttcacgtaatatagtgtcttactgcaattacttgataacgttactgcaagactataagttttgcagtaataaagcgtctaactacatattttgagtagtgttactgcataaacacgtggtaacgtgtaattgtcgtgcagtaacactgttacttttgtgcaaactttttgtgcagtaacaagtgtatgattagcatctgagacttttaacccatatatttttgtttcaattgctgaattactgcaattcaccacaatattacggtcaaaagtgcaataacgtcatatacatgcagtaacgctatattggagggaggaaaccaattttcttgagaagagggaggaatgtaacatacccgaattctaggattaaggaatttccatcaagactagctgaaagggaagttcttcaattttgtaaaccaaaaatttccattttaaacaaaggtgaagttgatccaactcttgcataaataaaatttgagaacaaattaaaactttttcatctttaacataggacttggatgcaacccaagtgaaagcatgcatactctcatagacatgtttgacttgagtccttcatatgcatttggatttggattgcatttggattttcgatttgcatttcataataggtttcatgaatattaactaagatctagataaacaactaaaccattagggcctagtgctagctagaggaagttaaaatagaaaccatacaccttaaaatatatcaacaaggccaatgtcaagccccacaaaactattttggtcatccatctgaagactagtcatgaacatggaagtgaccaaatagattatatcatatagggtatattctatcttaatcatctctataagcattctcttaatttaatactaaagtaaacttatgcataataggtaaggagcttatgacctgtgtaatgtaaattgtaattctaacatatcaacatcacctaggttaatgagagtccaaatataacttttataaacatttacatgcatttaggaaagggaagcatatataagacataagtcttgcgaattatctaaaataattcgtgcaagataaaatcatgggaaaattcatgtaggctctaatcaacacatgcaactcactgtaattttggtatgatttaataactaaatttggtacctcaaataaatcagtcaaactaataaaaactagattaactgtagttcttaatcggctaaaaccatactttgtctaaaagtgcattttactgcataaaagtgtataagtaaaataatttattcaaatactaggtcatttataatgaataaaaataatttttccagaatttatcttctctgtttaggtctcctaaaaattcgaactagtttccaaagaacccatattcctctaatttctgtgagtaatctatccataatttttgagtgcaaccaaagaaaatggaaactaggtacatacacctacctccagtaaaatcaacactagttaatcttatcaacacattaagtattgaagctacaaatttagaggacaaaataattccggaaattcgtccaaaaaccaagctcacccatgtttctgcctacacatctctcttccacctagtttacttcgacctgggcccccttgtcagtccctccggcttgctcttcctctgtgcaacttctctagccgaccgataaacactgagagggagagatcgagggccgaccggctctggacgccgcgcgacgcgtggccacgacgtgtcgacgccctaaaaacgccgagctccatctctgcctctcccagacgcgtcgccactcttcacccaccatcccagtgccgatccaaccgagggaggaagctccagctctccctctccacctctctttcgtcgccggccgccaagaagagggacatcgccaaccgtcgtcgagccctcttcatctctaactcatactcgttccattctcatatcaccatgccgaacaactttggttttgatcccattccatttcatcttctacagcagcgggaacgccgccatgtcatggtcgctctagggcgcgctctgtgcaccgccgcagcgacatcatcgcagttcccgcttatctggaccatgccgggccaagctgtcgcgccagcgtcttcgccttgacctcctctccatttccccttaagaatcttgaaggatggtgctatgagtgtggagatcgtccaccgtcttcttcacctccggtcgccgtcgccattgtcgattccgcatcgtccggtgagccattgtccgattcttcgcgtatacaccatccctggggcctcactaacctcatggacacacatgcatgatagttcttggagctgattgagccatcgccgttcacccggaggttcttgccgccgtcatcagcctagctaccccagccatgtctagcatctcggtgagcacccttcagcctatagaacatacatgcacgcacccaattaaccaatacatgattgtagaagcacatgcatcaccacccgaaaacatcctcctttcgaactcgccgccggcgttactccgatgtccactgaccaagaaaagtacaggaatggaatcgcaatagcatgatcttcattttgtcttttggtcgcaccctcaaacgagccatcgtttgtcgccggtgagctcgagatcgagctcagccatggctgttctgcctctctgcgtgagaaaagaagtcagggaccttgtttcgagaatttaaacaactatggaggttatcgaaaatgtttgcaaatcctgcatgtcgattgtacattaacaaattaaaattgtgttaaacttgttagacaaactcctattatttgcattatcaccttaaccccacatatatccatatccctcattcctaaccttaggaacaatatgactacaccactttatatatgaattttggagtcactaggttactataatgcttagccatgcttagaatggtcttccttgtcattatgggctcattacaaatataaaaaattgatttagaaataatctggacagaactttaatacttgtgattttgataaataaaatgatggaaaacatggattttaggtttgggcctcaagtggtgcacatatggtgattagttgtgtaccgatagggggagagtgtgcccaaaccgacctaaggacttcactcaatgtcagttcatttcgtatacagtgcaaccaaatgtgctagtatgggatagcccaagcttagtaaattatttatggtttagccttacattctggtaggccggtgtgtatgagttcggataactcagaggaacttcctatttaccccgacatggtagtttaggtgactaagtctgtccaatacaacggtattgtgccacgtgggtgggttcccgttgtgtccgccaccacggcgttaagtttaaggcgtgggcccgccacttaacggttctaggtcatataacgtgtatggcttaggatggagtaacacgtatcgtgctggtgtaaggctaaatcatgaattttggaaaagctttgttgcgggtaataaatcgggtacttatgtatcgcgtgccatgctcttgcatgattattatttcgcatcatgtgggtaaagtgtacaaactctgcagagttaaaactaatcgattagctgtgctcgcggtcatgagcggcgtgtggatatatattgagtatagacttgtgttaattcttctaaatgctgaaatttaccttcaaattgtgatgagatttgagaatgatctccttgctgccatggaaggcaatgaggtgcatatttatacatgattaatgcctactttgatgcccaatatgtcaagtactagcttgctgaaatttatttgaaagtaaacctgatttagaaatgttttatgcaaataaaacttgctttatgctaaaaagaaccatattatgccttccttgattatatgccttgcaagtagggtgttaggcttgtcttggtgcttgccagtacattatttctaataatgtactgactcttgctattgaattaaccttttgcttgcaggttttagatttagtctttgagtgatgcgggtaatcgactgcttcttctaggacttgaacttaatggggtaaacccctagtcggtgtgcttgtggattgggtagacaagcttccgctgttctatatatttatttggccggtcggccaatgtaactaaagtagatgtagtttataatcgctttcatcttatttgtgtttgctatgtataatcatgcttgagatgaaagtgtgaatctagtgcacatcctgggaactagattcacatgagtatgagttgagaatatttgagatgttgtagatctttagctatttttgtcaagtctcctgaatgtgtaacacatctggtcgccgcctacgagtggtttgacgggcacatctcaggttgaagttgactggcaagctaaaggcctagcaatgtctccaatattcttctctcgaggcgtcggatgtttcattatgtttgtttgatgacttgaattattcacttcatccctcaaatataatgaaagttccggaaagcctacgacaaggaaaaacggttcttgaggaggggagtacgtagatgcattttgaagtttaatcctccacatgcagtaacacgataacatcatggtggaaacggttttaaaaaataatacatatcttatgactattgcttttcaaagattgacattttgaactttagccctccacatgcagtaatagaatgtgtaatttacagtaacaggggtttatacatgcagtaacatggttttaccaaatgtataaaattattcaaaacactcctacatcaatcagaccttgctcaaagccacctacaaacttacctatggcccacctattcgaacttcttctcgtaaaaatgacatagtaacactgcatttatcatacagtaacatatctacttggaagtggtaacatgcacctattatgtagtaacgcttctacttttgtgtagtaacaagtatacgggtagcatgtgaggctttaaccccatatattttagtttcaattcctagtttaagtagtaatactattcaagaaatgcaagacactttgttactgcaaagcttattgtgtttactagactcttatggtaaccttgtgatagaactgtagtaacgtacagtaataacaagtcatgctattgtattactacttgtgaagagtcaaatcccaaaaagaaaagcttttaagaacaatatctctgatgtcatgtatggttttttaaaattgtttgcaccatgatgctagaaaaaaaaatgcttatcaaaagtagatccatcatgactatattttaactatatttgagcgttgttactgcatgtaaaacacagtgttactacacggtgaccgtcgcgttactgcacagtttcgcgaaacgagagcttctttttccacatcgccgcgtgaccatcttcgctatcaataggctggctgccaggcccctttccaaacactactttaagatctttcaccatagcaaacactgttttcccactgcgatgtttaggcttcgtacggtggtccgccttatgttcaaagtgattgcctttcttccgtacagggtggtttgcagcaaggaatcgacgatgacccatgtacgcaaccttcctacagtgcttaagatacgtactttctgtttcatccatacagtgagtgcaagtcttgtaccccttattagactgcccggatacgttgctaagtataggccaatcgttgatggttacgaacagcagcgctcgtaggttaaactcctcatgtttgtcctcgtcccacacggggacactttctttcttccacaacagtttcagatcttcgaccagtggtgttaggtacacatcgatgtcgttaccaggttgcttggggccttgaataataatcggcatcattatgtacttcctcttcatgcatagccaggggggaggttgtagatacacatcataacgggccaagtgctatggccgctgctcatctctccaaaaggattaatgccatccgtacttaaaccaaaccgtatgtttcgtgcgtccttaccaaagtctttgaatgttctgtcgatgtttcgccactgcgaaccatcggcggggtgtgacacagtatcccgtcctgttgatgttcttcagcgtgccaatgcatcattctagcatttccccttgctcctgaactaacgccttagccgtggtattatagggaaataccacatcaccttagcaggaattctcttcttcgttggctgcccataaacttcacatggatcatctcgtctaatcttgtatcgtagtgctttacaaacagggcatgcttttagattttcgtactcctcaccgtgatataggatacaatcattcggacatgcgtgaatcttctgaacttctagtcctagagggcagactatcttcttagcctcatacgttgtctcgggtaatttgtttccctccggaagaatgttcttgacgagtttcaataaatcgccaaatgtcttgtcactaacatcattttttgccttccattgcatgaactccagagtggtatccaactttttgtgcccctgctcggaacctgggtacaacgacgttctgtggtcctctaacatacgcttcaatttatgggcctccttttcactttcacagtcctccttggcgtcctacaacatctgaccaagatcatcgcagcgtcgttattgtcagcatccctgtccacctcgcccgtttgatttccttcaaatccagcgtactgagcccagtccggaatgttctcgtcttccacttcatcttcttccatctcaaccccttgctcaccgtgggatgtccaacaattatagcttggcatgaaccccgactaaaacaagtggaaatgagtagtcctgcatacagaatactccttctagttcttacacttattgcatggacaaccaataaaacccttatgcttgttagcttcggccactctcaaaaaataatgcaccccgtcgataaactatttggaccaccggtcagcgtacatccattgccgatccacctacatgtaatgaaaaaaagtcatacataaataaatattcataaaataatgacagtcatacaataatgatcaaataattaaaaactctttcaatagtcatacaataatgacatatcattattcatacaataattataaaataatccaccaaacaattcttatttattatttttgaatttttaaactaatattaatgttgtacttcttttaattttcaatttagtttgttttctattttccatgattaattttcattatattttaaactatgagaataaaacttttttaaataaacaaacaaaattcctatatattattcttccccacacaatttgtttctctcatcaacttacaacaaagttttggagacaaaaaatgtgtgaaacatagctccaaaagtaatataacaccaaaaaacattggaggatgaagttactaaccttttagacacctccgatttgtatataatcaccaaaaaaaaattcacaagaaattttggcatgacctcccctcttttttggagaaaatttgaagcttgctcgggctggaggaggaagaagacatatataaagagggagataattagtcccggttgatgttatcaaccaggctaaagatcgccgagatctttagtccctgggggtctgacaaggcctaacatctttagaaccgagactaaagatgatcttaccaaccgggactaaagatcatatatgcccgctgtagccaccaaccgggtttttagtggaaccgggactattgtggatttcggaactatgataagatctcttgtagtgacggcttgtttggctattagagaggcagtttgagacatacggcacacagtttcataccgtgtgcgtgccaagttggcaattggatcctagtagcagcaaattttgaaacactcaacccaacccaatccttcttctcttaatcttctcttcctactcttgtgtttgtgtgtgtgtaagaggctagtagagttagctagcctaattttttttgcacgttgcagctactagctgtgctgctggcttgtcgtcctctgcttcaactttaaagagagagctaatagatcggtgatccgcttgggtttctggtgatcatatgcaacatggactagctacttggatttgttcaaaggatctgcttcttggatgctgtccggccacgtcgccatgcatgcgaattttgtggatggagtcaaaagctgcatgcacggagctgatttaattaagggcatgttcacattgtagtcaaaataaaccttaccaagtttttagcaatgccaaaattttggcaggatttcttatgtattaaccagatttgccaacaactaaacgtagatattttttggtaactttggcaaaaaatgatatggttgaaaatggcatcaaagtgaacatgccctaattaacttgttgacagctactccctccattccaaaatataaagtataactacccttaactcaaagaccaagaaaaaaatattatcatcttgtagtttgaatcatcctaataaatataatgcatgcatccaataggattagataacatgagagtaaaggatttaaaaaagtaataacttaatgaagaagatgtcatagttaattgcatgcttgcatgcatgccttatattatggaacatctaagaaaagtggttgtgccttatattatggaatagagggagtagtacctaattaagcacgtgtgttaatttattattaactagtaatctgcccgtgctaatgctacggcgacattcagaaatacaaattaagatcgatggatatagttattatgttgttaattaaattgccacatgcataaaataacatagttattatcctggttcaaatggagtcattagtgacaacataccatggtaaaagcaaaagtaattaaactttggaacttggcaccttgaaccatcaaatccttgtctaccatgctgtctccctgtcaccccccccccccttaattctaaattaaatggatgagagaaagagattaatatagtttagtgtgatagtgccaacacatggaaaatttagagcttctagttctctccttctacatctctcttaaatgtcggaccaagttcttatggggcccactcatcatacaaccatagccaacacatcatctgctcttctctcatttaaatcttcttttatttctcaaaaggtgagagaaaggtttaaattgaatttccacccaaaatgccactctaccactccaagccttctaggaaacatctatatatgggcctatttgtcgtccaaatacctgcaaacaaccttggtgaatcatctctttatcctaaattatattttcaaagagagaaagaaagagagagagggagttaaagtccaatttacacccaaatttcaccatacctctcatcttctcataggaaacatctacataaggccactagacagccactcatacttggttgagtgaagtacaagtaggatcacagcctcaaaccactgccaactcctttaaatcgtttctacccctcatgttgacaactagctctcactttgcaccttcacttttaccattcactactacaaccaagatttttgtgtgagggctaaaatgatttttgcgcgcgggtaggcggtccgcacgcacctaggggtctgggaaaatgatgatttttgtgtgcgggtggcgcatccccacgggaaaacaaaaatccgaaagaacataattttttaaaaaaaacgaaacccaagaatccggcggtgggcttccgcccgacggccatagtgccgcctgcctcccgccggcctccgcgccacccgccggcagatccgcgcttccctcccgccacaatgccgccgacgcccctcccctccgccggatctagggagggaaggaaggggagaggaggggagctggatcccgcgtggggagaaggcggccggctgccggatccgtgcagggacggccgccaccgctggattcttgcattgacggccaccgccgtttgatccgtgtagggactgccgccgcccgccggatccaacgcccttcaccaccgccacgtggaggaggccggcgcgctcctactcccaccaccgccgcgccgctgctgtcgccgcacgccgccgctgctgccgccatcgggaggagaggagaggagagtggagagaggagaggagaggcgtgagagagagagtactgagaagagaagctctgcgtggaaattttaaagtggaaaaagggatagaggggaggggagaggagagaaagaggggaaattttaaagtgggtgagagaggaaagagggagctagtatttttgcatgcggctctcttaataggtccgcacgggaaaatcggctcattttcacgtgctgtccatttaagaggaccgcacggaaaaatcgatttttcccggaagcaacgagttaccgcacggaaaatttgatttttccgtgccgtcctctttaatgaaccggacgcgaaaatgagccgattttcctagaagcaacgagataccgcccacacggaatctaaaaggtccctatctaggaaaatcatttctgtagtagtgattcatgaagttccttctctacttgatcgatccattttctttgtttcttttttggcatagatcgaacacttggtggtgcgctcgtcggtgttcccggtgtctagagcgccaccatcgccccactttgtcattcccgtcgactcgaatcatctccggctgtaccattgcgccactgacgtacgccgccacgaatgccgtcgttcgccgttgctctcctgctgcctctgcttctcttgccgccgagtcaccgacatgtgggcctggctgtttagccacttcattaggtgctaaggactttaattagtagaaattgaaatgttgtaaggttctttttgtaaaattgctttgtttgccatgtgggcttatggacctaaatgcaattcacctaatgcccagggaccttgttgtatagggtttagggcttaccctaaaacatgaaattactatttcatgcattcattccttgatataatagcttgatgagtatattgttatcacccttgctttaaccccctcttttagaatcaatttggagtttttgcagaagtcaggagtttaatcatataaattagtttcattccaacttagttcccaagtatagattagatagatggtttaattctatagcaaaacattagagttggctcatcctgtagcttctacagtaatagttagccacaatcttgtaaataccctattattttatgtaaagaaatctccattggagccttaatcaaatgtatgcgatgaagattcagattgttgaacctttattaatctactgatccagggttgatacagtttaaatatgtcggttaccgaatctttaattttgagacccgacaaggtgtgtgggtgggggcccctacgatttgggagcctagagcggccgtaccgctcgcaccccctcccgcctgagccggccctgactacatgggcgttaaaaggccaaatggcatcttatgacgttttctgggcttgatggcgacgaaaatggacgccatagactctatgacgacagaaagattgtcactagattaatgacaaaaagataaactttctttataaaacgccattagagacgcatgataggtgacgaatatgattcgtcacacgaatgtcacagatttcatagcatgacttaaaattcaatttttatgacgtaaatgagcatcacctataatcagattcttgtagtgatggcttgtttggctattagagaggcagtttgagacatacagcacacagtttcatagcgtgtgcgtgcctagttggcaactggatcctagtagatgcaaattttgaaacattcaacccaacccaatccttcttctcttaatcttctcttcctacacttgtgtttgtgtgtgtgtgtgtctaagaggctagtagagttagctagcctaaaattttttgcacgttgcagctactaactgtgctgctggcttgtcgtcctctgcttcaacattaaagagggagctaatagatcggtgattcactttggtttcttggatgctatccagccacgtcaccatgcatgcgaattttgtggatggagtcagagggtctgcatgcacggagctgatttaattaattaacttgttgccagctagtacctaattaagcatgtgtgttaatttattattaattactttgctagtgttaatttatccttagtttttttattcgaaactactagcatgcatgcctttgtctttgtcagagagagaaaccgatggaatatcctcgtttcaaaagtccatgcataatgtgcatgctgtgtggattcgtgctgtattttcctgggtagataagaccaaaaaatcccacttaccaactaggttttttaaaagtctggtacatcgtgaaccatgctgcttcacgtggtcggaactatatacgttaagatcaaatgtgctcaacgtggtctggcacatcatggatcatgctgcttcatgtggtcggatctagatgcattaggaataatccttttcgtagtagtgaaactaaagaacttcacttgccaactacttcctccgtttcacaatgtaagtcattctagcatttctcacatttataatgttcctaatgaatctagatagatatatatgtttaaattcattagcattaatatgaatatgggaaatgctagaatgacttacattgtgaaacggagggagtagtttttttagagtctgaacaaagatgaaactttttggaaaggtgctcctgatgaccaagttcaattcaccaactgaaatcgcacactggatttacatgaaaaatgcgagatagacaaaaatgatttctttcggttctaaattaatactcccggccatttgggaggagcaatatgtacatatgcattcatcacacttcagcttttttgtcttttttttccttggagttttaagaatgctcataattagggcatgcaagttgatccattgatatattcgcaatatttgacgatttttttttcattttaaaaattgttgacgatattagcttaattttggtatggaaaatatcggttaatttatccccaatttttatcaagagagaaaatgaaccatgagagttgaggtgctaattaaccacaagcagaaattcattttaatttgtggtatatatatatacacgagcatgcatgtaaagatggaaatatgtgaaaaatataatggtgctagtagatttgtctaaaacacttccataatactatgatcaggacactcgataaggacaaagttaaattttagggattgtgtcattatcaaaattatcaatgaataattggccagagggccgggattagcaagggtctactactgtcctgccatttcattaattaattagattaagtccccgattccttgcatctctaattggcctacgagaaccgacaaaaatcgcaagatgggaggattgtggtaggttatcttctccaactgtgcctctcaagtggccataacatattagccagaaggataaataatcatcaatctgccttcacagttttgatcatctcatgagacatatatataaaccacccattagcaagagtctcctaggtgaattaattaactatgctgatacacatatacttaattggtataagaaaattagtagtgatagttaattagtataaaagcatcaatcaaatggagactattagctagctaggagaccgggcaagcaaagcaaagcattgatcttgatgaatcctccagagagattaattgcatattgccagttcctcctgacctattatatgcatgcaagtgctctctgtacttgtgcggtgcaacgacgagtagaactgagggtgcgccttatatacgccggacgagtaaagagtgagtacgtttgtagtgacgtctccaattttagtttctatggtagtgaaatatgcgacgtttgacacctcaaactggagaaaaattggagctgtgaaatgttttctttttttatatacgtggagctctgaaatattgacagttttgtttttttctataaaaaaagccaagaagagttgacggcttatcggtaggcgctcctcgatggagggagatgagcttaaaaagtttcagtaaatggacccatggagtggaaatgcggagtggagtggagcagtaataaaatttaaaatgccacgcgcagggcatctcgaccacgacaggactctccttgagatcttagaacagtgtgtgcttgctagctgaactgcagcagtggaacagtaataaaatttaaaacagatgtgcagtgttcacagaggacgagtgtgctctgtgttctctgcttgtgaatagatatggcgatatctgcttgtgaatagatatggcgagtactattactgggtatacatggttaggacagatgttagtttgttctgcttgtttggagatggatttgggagcaaatgtacatggttagggcgcaaatgttagtttattttgctgtggaggggagtgggtttttgtcacctccggaatttccatctaaaattccaaacgcttacatgtgtgttaaaccctcgtccaggaatcagccgaggcacacaataacaaattgataatagagtatgaataaacagcgaattaatattcacaaataataaatcattacagaggtagatagttcctctcaaagaataaaattctacgcagcggaaaataaaacaaactacggaacagctatggtgtctccactccacaagcaacttaacccagatcaagcctagtcctccagatcatcaccttcactgaagtactcctcctctgatgaatgaatattgcaagaatgagcatatgccatacttaacaagccacacagcaaatatgcaagtgcacaggataacaaaggacggcataataaagttcatttgcataaacaacatttaataaatatttaggagaatagtaaaacagttgaataattaatcagtattaaataaacactacacaacacacccgtgttgcataggccccacctcatctgaacaaccaccccggttgtacaaatcaaacctcgataccaggaatatgccactccaaaccaggagtcaaattaattaacacaattaccaataatgagtagtgtgagactaatcatgaaaaacattgttcaactcacccataaccgcgggcacggctattcgaatagttttactctgattagaggtgtaccactgtacccacaagacacaatcccacaacatgtcaccatgcgactcagtaccaccacggtaccttggaaaggaactgtgacaatactccaaaggaatgtttaggcttaaactaaaatgatgaacaatgttgatcttttatgtttaggcaatgatgaacacttattatgcaactgtgatgatgtaactgtgatgtttatatttatgtatatgtttcatatgtttatactaagacttgctaaataaatatttgttccaattaactcggttttgtaggtgaaacatgataaatattcaatgtgaaatatgtgaatggatgtgaaatatgagatggctgtgaatgtgtggttgtgtgaaatatgttcatgtctgtgtatgtgaatgcatatgtatatgaatggttgaggctggggagctggggatattggatatctgtgtttgtttctgtcatttttgcagcgggcatggctagcaaaggcctgaggctagccaaaaaacaaaatttattttttttgtgtattatagtcatctgtgacgggccataactaaatgcccgattgagatgagatcatatgtgacgggctctagtttaggcccgattgaggtcagtaggcatctgtgacgggctatagtttaggcccgattgagatgagtatcatctgtgacgggctctagtttaggcccgataaaggttagtagtcatctgtgacgggctctagttgtggtccgatagagataggtcatctgtgacgggctatagtttgactggtcgtctgggtcaaagctatctgtgacgggctttacttagggcccgattgagatatattcattcgtgacggccgtttgcccgattgagataactcttcacatcagtgacttctagcctgtgacggacgctgtgcccgattgagatggggcttaccgcccgattgagatgagggtatccgttctagtggcatcatttcaacgtgtttttcaatacgaatacaacaattctatttatgtattactagtcatcaacctgtgcacttgcatgcgctagaaaaattatgacatcaattaactgacgtggaagctttattggtgcatccaattactaaatataagatttattctttgtttctcaattctttcggtcaaaaacgtgcatgtgtgttattcatagaaacgtatgtagtatttgtaagaagtacagtatcgaatttccaaaaagttctgaccttgtgcgataatatacacacacattaacctacataggcaagctagctagacctagaaatataccatttctaaacctattcggtcacttactcacattgggcagcctaactaaactaacatggactcacatggcatgcaagccagccatggtactaactcgtctaccacgccatagtacgctacaaacacaactaagttatcttatgaaggactactcaatagtacacttaaaacattattactcgtttccttttaccttcatctgacgggtacgagctaagtgtatctgaaaatcatctccttctgtccatcggcgaaaacgtgcaaatttaaaattccctggtacgcaggactagatatgaagagtttgttcagagattgtgaaacaaacatatacatccatcaactatatacatgcataggatacatacatacaatgcaggtagccatttgcaccatattcataatatacaagtaggcagccatccgcaccttatccataccaagacgatccatttgcgcattatccacatcatcacataaagcttctgcctataaatagcagcagcaccttacattcaagaatcacctctcaacacacaactaagaaacatagctaggtaaccagggaaggtagcatcagcagcaggaggcaatggagggaaagaggactaccacttcgatggtgatcatgtgcctggtcatcttgagcctcactgtcgactccgccaccgcggcacagtgcggctgctgcatatcctctcgggcaaaagcatgttgttttggttgtattgctgctggtggctccgactcaatctgcaagaacacttgttgtttcccatgtattctggccgattctggtaaattcactgaagtcactcttttaaatgcacttcttatatgtagatacagactttgtagcatatcgtggactaatacatatgtgtggccttccatgcattttcatcaatatagtttgttgacttcacttcccatctgacaacttcaggcatatatcttgcaacatgaagacaatttatgctctacttccactacaaaattaattaactaatgcgctaatgtgatttccatattttaatttcacagttgttgctaagatggacgaaatgggagttcttgctaagatggaaggacaagcctaaaacaacctactcgcattgctaccagtcttaatgcctttcataagaatatgttgttttgcttcaagttatggccaagttatgttaatgtttatctccaataaattgttgaccatatggagcgatctatagtcgatccatctgttggtcccaactatttgtatgtcgtgcatatgtgcgctcacaagcatatttaatttctcttgctacttttaataaggccatagcactatccaatgtgtcatctgttggtctctgaccttagcaatttaatgcaacatgattattattatttgtgtgtgcatgttctttacttaatttattcttagcgtatttctgatgtttttgtgagttttagactatgggagataattaagattgtcatgccaaagagtattccgaatcctactaggaaagcaaagggaggggggaggaaacatggtcaatttctcggctgctatcacattccttgtattcttagtgtaacatacccgaaattttaggacttaaaatttcttgtcaaaatagttagaggttaacttctccaattttgagagagccaaaaatttccgttttaatttaggtgaagatcaacttaaaccattgcatgattataatttgagaacaaaataaaatcttttcattcccaacattagactagaaatgtcaccaagcatacatgtacataatgcatgcctaggctcgagttctttgtgcatttggagttttggtcttgcattccataataggtcccatgagcataatctaaaagaattatttcaccaaacaaacctatagttaatcttgggtgataacatgtggacttaatattaaactcaaatatcatcttctcagtctaaaagaaaatttaatgtaatccctataataatattaaatgcaattatgaagtgggaatacatatacaaacaaaggtcatcctaattctctaaaatattttgtgcaagataaaatcatggaaaaatttatgtggatagtgattagcacaaacttatcctccgtaatttggtaacgtgttaacactcaagttgatacctcaaattaaacggtcaaagcagacaactaaaagaaatcaaattaaattttaatcggctaaaaccatgtttcatccaaaagtacatttaactgcacataagtgaacatgggaaataatgtattcaaatactagactagttatcatgcctaaatataatttttctagaattttcctcctctctttaagcctcctaaaaattcaatctagctttctaatagcccatctttgtttaatttctgtgagcagtccacccattatttttttagtgcaaccaaagaaaatggaatctaggtgtaatcatctaccaccagtaaaatctacactaattcttctggtctacacattgaattatgtagttacaaagttagaggagaaaataattccgaaaaaaatgatctaaaaatcaagtttacccagaatcttacccaaccctctcaccctagcctagtttgccatgacctggacccacctggcagcctctccagctcgcccttcctctgtccctcatcctcagccgaccaagaaacacatagagggagagattgagagccgaccgagtcctggacgcgtcgacgcgtggtgacgacgtgtcgacgccttcaagtcactgagtcatgcctccatctcctccagaccgagtcgcccaactccacacatcactctggagctgaagaagccgagggagaggtcctcagcctctccgtcatcctcaacctcgccactggtcgtagtgacgacgaccttcgccatctccgtttgagtcaaggtcacctccatctctttcgcgttcccatctctccacacaatgccgagcatttcctcttttgacctaaacccctctcgtgcagtgcatcgccaggaacgcaagccacgccgacaacgccctggagcacgcaccggagcgccgccgcttcaaccatcgtcgccgtccggccattctcatccacctcagagaaagccgctgcgccattgtcatcgcctcgacctcctcttcaaaacgcctcaagaaccccagccggaaacatcaagaacacggagaacacatccttttcttcaccggcgccaatctaggatcgcctccgccgtcatcgtcgtttaccgctgcctcggtgagccattgttcgattccttgcgcatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagactacatgcatgcatccttttcgttcgtaatcgacttccatgcacacatgcactttcaccccaaaaccaccgccgctcacactcgccatcggcgctactccgatgtcctctaaccaagaaaactagaggaatggaatcgcgagagctttctcttcattttatcttttgacctcaacctcaaacgagccaccgtttgccgccggcgagctccagatcgagctcagccatggctagctctgctctgcctagagcagagggatgacttccgtgaattagattaagtgcagggatctgtttacaattgtagaaacacactgacatatgggcctaggactgcgggttgattcctagaaacctcaagggcctttgtgcatattggtccctcacagccatgtggacccatcctttaaaatctgaagaataattaggaaaatgcccaaacaaatatgtttagcagaaaaatgcacaaagttgtaaaatctatataaaatcaaatatagctcattttgaagtgattctagttgctgtagattcttgaagttatgaactttattccaggaatataaaacttgacactcactgtacaaataatgtctctaaaatttatctaagataggtcatacataaaacatgtacaaacttataaaatacatagaaaattcatcacaactcattttgaaacaaaatcaaattctacagattcatcatcatacagtctctgattaggtgaaataaaagtaattacttactttgcatcaaatgcctctaaaactattatctctataatgattagttttagataagctaaactttagaaattcatgtagaacccaatttagcttcaatttgagtaaacttaagttctgtaggatcactaaacatgtatttctaagttatgaaataagattatatacttactgtgtagtaaaagtctctaaatattcatataaggatttactaacatagagcagcctttaatttgtaaaacttgtagaaaatttatttttagtccaaatgaaatgaacaaagtttctatagaaccagcaaatagttatcttcaacatggtaaaataaaatttggaaccttttgtagagaacatagatcgaaaccttaacttagtgaaataagaatttaaacacatagttgtttaagtaatacataaacatgtataagtatatatatacactttaggtctaattaaacctaaataaaaacttgattgaccagtgaagccatagttccatcctcatccactaaaacttagaagaacttggctcatataacaatttctaggttaatataatatattgctagtttagattagagcatctctagtttataaaatatgaaccatactagtaaagaccataaacatgtgaactaaaaatgttttagataaccaaattattccttttattcaacttaaacaggaagtagcatgttctgaacctataactcaaaagtcatgaacatataaaacactatacaccaataacacgttataacttgtaaaatgcataaagaattcattataaatccaaaaattgtgaaaccaaatgtgttagtattagaaaacacatctccacacccctgtgaagtctaatctagtaaaaatcactttacaaaagtatttcataacactacctaagactatactactataaaccgataaaacttctaaaaagttcataactccctaatggaataagttaaaataaaaattctttcacctaaattcattttagatcagtaccaacccactgtgcataaatcatgcattttagagcattttggattttcagctctttcggtgtttaattgcatatcgtgtccttttatctagataattgcataatcggtgaaggagtggattaggtgctaacaattctctgatcaaggcaagttttctcctcccatcctttgaacacattgaatcccatgatttgaggaatgaaaatatttgtttgcaaagttgcatgtgaacttagattatatcggtatttgaaattgggttaaggtagttatgacctatttgctgcataccccaccttgaataattgatcctcttgctgtttgaacccctagaaatggttagagtacactctttgtgctcaaatgggtttatatatgctctatgtgcaactactttgcttagccatgcttagaaatatgcaaatgctcattccatttataattaaaatgtggttttgatacttgaaccttcgctagaataaaatgaatatgatgggtatttgcgaactaaaatgtgtaaaatgtgattttacacttgggcagcaagtggtgtgcatacagtgttagttgcataccgatagggggagtgtttgcccaagtccataaggaccgaacttgtgtcacccatttaaagttattcgtacatccatatgtgctagtatgggatggcctaagctgattaatctatttaggactagccttgcattctggtaggccggtgtgtatgagttcgtataattcagaggagcttcctatttaccccgacgtggtagtttaggtgactaagcgtgtccaatacaacggtattgtgccacgtggtgggttcccgtcgtgtccgccaccacggtgttaagtttaaggcgtgggcccgccacttaacggttctaggtatattccaagtatgcctaggatggaggaacacgtatcgtgctggtgcaaggctaggctctaagtagtgtaaaggcttcgttatgacctctagatcacattcaacatgaagagtgtggtggagtcttgcaaactcaaaacaaactagagagttcatatcatgtgggtaaagctgtacaaactctgcagagttctttaaactaatcgattagccgtgctcacggtcatgagcgctttggtgatgtgtcatgagtatagactatgttttaaaaatgtgatcatgtgacactggtttgaaattgataaatgtgttgagttgtgtatgtggtgatacattatgacttattgttaagtatggcaataagagattgtttatgatggaattatgaagaagttaataatgaaactcaaaacttgtctttgttaattgaagcatcaactcttttacaaaagaattgcgaaacaaaacttgctttatgctgaaaatgaactacatattgtcttcctttgaatatatgccttacatgtagtatagtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatggggtaaacccctagtcggtgtgcttgtgattgggtagtcaagcttccgctgttctctaataagtctatttggccggttggcctatgtaattattaagttgttgtaagtcttaagtttctttcatcttagttgtgtttgctatgtgtaatcatgcttaagatgaaagtgtgaatctagtgcacatcctgggaactagattcacatgagtatgagttaggaatatttgagaggttgtagatctttagctatttttatcaagtctcctgaatgtgtaacacatctggtcgccgccttcgagtggtttgacgggcacatctcaggctgaagttgactggcaggctaagggctcagcaatgtctccaatattcctctctcgaggcgtcggatgtttcattatgcttgtttgatgacttgaattattcacttcatctcaaatataatggaaggtccggagagcctacgacacttagtcttgggagacaaatagccacactaaaggcaatacagccgaggaatggcaaccttactcacaaggacaaatagtcattaaaaaattatgacagcactaaccatatctaatttcagttcaccaaacttacatttaaatttaggcagtattacggagatctaaatcaacaaacaacaaaccatacttcattgtcaaaacaaatggccttctatgtactttacaaattctcacaagatcatatttgcaatttttcctaaactaattaaccaagagaaaatatgtagtggaggattccacatataatttcacagcataagtacataatacaatatggtataatacacatatgcacagtactttgaaatatgcataccagaacatatgctttagttcactccattcattcttgcattcttgcacattcaacatcaatcagatctaccaagcattcttgtacattcaaccacaagcagatctaccaatgaatcactaacttatgtagcaatgggggaaatcggaggagaattaaaaccattcctcgtcagacgacggaaggacaggaggcggcggaagattcaccggctgcacaccacggcacgcgaatccctgaggtgtgggcatcgcatctatcagcaccaacgacatcggcagaggcaggggtggactggggctctttcgtagaccgatgtaaactagacttgttggcttcgttttagggaggggacggaaaagagataaactttacccggctggcctttgggcctgcgtggagagggataggagtttgcttggtttcagccaaaagataggaagaggattttaaataggttgcatatgcatgctttgtctaaagaaaattcctaaaaataaatgaagcaacaataaatcccaccaaaattctcataaatactaaacaacaccctaagcttccagcaattttagtttgaatttatcacatcaattgataacccaaataaatctttcaacacagctaaaaatctggaaacagcataccaattagcctagtttgcaccttcaccaaaattaaaccataactcctctagcaaaatctcaaggtcagaatgttaaacatactttatcatctggtgcaatggcttagtctaattcgaaatgtaaccacatgaaatgagagccataaattacgtaaactttggaacttggcaccttgaaccatcaaatccttgtctaccttgccgtctcccccctaattctaaattaaatgtatgagagaaagagagtaatatagtttagtgtgatagtgccaacacatggaaaatttagagcttctagttctctccttctacatctctcttaaatgtgggaccaagtccttgtggggcccactcatcatacaaccatagccaacacatcatctgctcttctctcatttaaatcttcttttatttctcaaaaggtgagagaagggtttaaattgaatttccacccaaaatgccactctaccactccaagccttctaggaaacatctatatatgggcctatttgtcgtccaaatacctacaaacaaccttggtgaatcatctctttgatcctaaattatattttcaaagagagaaagaaagagagagagggaattaaagtccaatttacacccaaacttcaccatacctctcatcttctcataggaaacatctacatggggccactagacagccactcatgctaggttgagtgaagtacaagtgggatcacagcctcaatccactgccaactcctttaaatcgtttctacccccgtcattgttttgaaaccaaaacccttaaagggcccttttccttttccaaaacccttttttttttttgccccccaaaaaacccccccttttttttttccacaaaccccctttattttttttttttaaacccccccccaaaatttttttttttttccaaaaaaacccctttttttcctacaaccaagatttttgtgtgagggctaacacgatttttgcgagcgggtaggcggtctgcaccacctaggggtctaggaaaatgagattttgc

SEQ ID NO: 6405 - DNA, 26955 bp, Oryza sativa
  unsure (1)..(26955): unsure at all n locations
ggggcgtgacggtaagccacgcggcccaaataaaaccaagcggtctctcttctcctgtaaccgaaanaatgtggggccaacatgtgggggtcatcccctacctcgggctggcagagccaagccaaacaaccgccgcttttcatctaattcctcatcaccgggtcgccccagagtccatttgcttaagggaaatcattctcctccttatcctctccctttcccatagagtttgggagatcaattttgcccgaataaacaaatcgaattcgttttgagtttatctctcctaactaaccctagtttttcccggctccattcctctcggttggagtccaatccgattttcccagaagcgacgagttgccgcctgcacggaatctaaaagggtccctgtactagtgattaatctaggcaactcgccactgtgaacctcatctatttctcacagtgttccactatgcaaaccaccaaaaactacctcggaatctccaagaacttccacttactcttttcacctgaaggagtttcatccatcgcacgtattctctggtgagcttcaccgcactccaaccatgggaacgtgaagttccttctctacctaatcaatccattttctttgttcctattttggcatagatcgaacagttggtgatatgctcgtcggcgttcccggtccattgcgccaccatcgcccgacttcgtcattcccgtcgactcgaaccatctccggccgagccattgcgccaccgacgtcgcctacgtcccaggagaaagacgcccaaaaatgatcaagccaatatgccgccgcgaacgccatcagtcgccgttgccctcctattgcctctgcttccctagccgccaagtcaccgacatgtgggccccggctatttagccacttcattaggcgtaaggactttcattagtagaaatttaaatcttgtaaggttctttttgtaaaattgctttgtatgccatgtgggcctatggacctaaacgcagttcacctaatgcccatggacctttttgtatagggtttagggtaagtcctaaaccctacttagagattactatttcatgcattcattacttgatataatagcttgatgagtatgttgtactcaccattgctttaaccctctctttgagaatcaatttggagtttttgctgaagccgtgagtttaaacatataaattagtttcattccaacttagttcccatgtatagattagatagatggtttaattctatagcaaaacattagagttggctcatcctatagcttctacagtaatagatagccacaatcttgtaaataccctattattttatgtaaagaaatcacctttggagccttgatcaaatgtatgcgatgaagattcagattgttgaacctgtatcaatctactgatccagggcttgatacagtttaaacatgtcggttactgaatctttaattttgggacctgacaaggtgtgtgggtgggggcctagagcggccatcccgctcccccctccccccctcgtcggccctgactacatgggccttaacaggccacatggcatcttatcatgatttctgggcttgatagtgacgaagatggacgtcatagactgtatgacgacagaaggatcatcacaatattaatgacgaaaagataagcattctttatagaacgccattagagacgcatgataggttgtcacgcccggaatttctatccaaaattccaaatgcttacatgtgtgtaaaccctcgtcctggaatcagccgaggcacacaataacaaattgataatagagcacaattattactctaattaataagcgaataaaatgtcattacagaggtagatagttcctctcaatcaataaagatctaagcagcggaaaataaaagaaacagcgcaggcgactcctctccacaggcaacttgaccaaggctacgcctaatcatccacactatcagcatcactgtagaactcctcctctgatgaatgattgcaaggtgagtatatgatatactcagcaagccacgcaacaattaagcaagtgcacaggataacaaaggatggcatagtatagtctcaattgcttaaatagcatgtaacaattatttcagaatttaataaaatagttaaataataattaaacaatattgatccaacgctatacaacataccctgttgcataggcccaaccattctgaacaaccagtcccgactgcacagttctatctccaaaccaggaattaaccattccaaaccaggagctatcaagttattaacagcatcatttagtatggtgagaggtgtgagactaatcacgaaagacattgttagacccgcccataaccgtgggcacggctattctaatagtttaaactctggccagaggtgtaccactgtacccacaaagacacaacctcaacatcatgtcaaccatgcgtcgcgatacttgacaagtacccgaatagagattgtgacaataccctctatataatacaattcaaagcagtgcaccgttcccggatcataatcacccccttataaacaaggtatggactccccagcgacccccgtgggcttatctccgccacttcatactctggtgctctactatgaaccatactatatagaaagtaaagccgttgcccacgctggcttgtggttgacacggtaaatgtttcacaaccgaaaatcgtgtgctcacaacccatcaaaaccatatgctcacaacccaccattatcaggttttagttggcaaattaattacttaaccaatcatgattaaccatcatgagctatcattaagccatcattaaataatagtgaagcataagttatcccaatagtgtgttaatgtttctaagcatggctaagcaattatgtctaatatctagctgaaccaatatataaagctcaactagttaagttataataacccaaggtatcaaggaatagagtaatcaagaacaaaagggctataacaaggcaataggttaattccacccaatgacattcgaaaataaatgcaatagttgaatagaaacaatagctttaaacgggatcaacatgctcaaagggttgtttgggatctgtgtgacttgccttgctagccttggaactcttcaaagtcttctcctgcaaattcggactctccaggaacgtcggactctaaagagaaaagagcaaaatcaccaaaacaacacataaacaagcctgaacagtacatgtggatatttttaacatgtagatctcaattttagaaaaatttagagacttgaaccaactaaatccgagctaagatgaattagttatgaattttcatagattaaatcggattaaatcatttatatagattttaattgaattatgacgcaataatgaattatttttgaaaaggaaaaagggattattgcgtcagcggactcggctcacggtggaccgggtgcacggcggtggttcacggaaacgaacggccgagatcgatctatccaaaacggaccaagatctaacggtctacgaccggtctacggtggacggcgtcgatgatatcagcagtgacgtcatcaccgacggcggctcggcctcgcgtgctcgccggcgaacgacggcgcgacggcgcgaatgaaggacacctacgggttgcgggcgacacggcgaactcaccggtgaccaaagcagcggcggaaggtcaacggacggcgacggcgacgaggaagaagcggtggtcaccttcagctcgacgacgacggcggggctccggcgatctacagcgacggcggagaggcggacgaggtcggcgacgatttgacgatcacaacggcggctttcccgagcgacgacgacgaccggaaggacggcggcgcacggctggacgaacggcggcgacggcggcgctagactacacgacgctagggctctaccggcgacaagagacttaggcgagggtggcggcgggtagaggagacaccgggggtccttttatagcggctagggggtggcggcgaaggttcacagcgaccggcggcagcgatggaaagtctagggttcggggagagagacgaatccgatttgagttcgaatccatggatttccgaacgattttagccgatgattccaaaagagaaaaggtagaggggatctcggggatcatttcccctctatcaatttcaccggatcgggaaagacacgatcgaatttggaagggcagcggcgcggctcggctagggttcggccgggcgacggcgcgaggaagacgacgagtctgacaggtgggtcccacctatcagcgggcgagggcgcgcgcgcagacggtgctcggctgcgggccgacctaggccgggagagagagaggggtttgggccgactttcggcccaaagccaaaagaggatttaaaaaacctttttcaatttaaattattcatgaaatgcaattccattgattaaaaatacttccttgcctcaaataaatcccagaaaaatctaggaactatagaattaagcgaagtatttaataaaattttatctggcccaattttatattgaaatttattatttaaaaatagatcttctcttctaggcttttaatatcaattctaataattccaattaaacaacaatttatatatttcggatttttagggtgtgacataggtgacgaatgatatttgtcacacgaacgttagatttcacaacatgacttaaaattcaattttcatgacgtaaattagcatcagctacactggtggagaaaccctttttcctcccggttcgtaacccccctttagtcccggttatccaaccgggactacgaatccgggactaaagatcgctatccttagtcctgggtgaaataacctggactaaagatcgatctaccaatttttttcttatttgcatggccctattgctgcatggtttagggtttatgttacaatacatatatatgcattatatatatctatatatatatatatatatatatatctatatatatatatatatatatatgatggctctttcatacgcccaggtgtatgtacacccttttattaatggatgatccattagcattcaaattagctatgaaaaaaattaataatattaatttccaaatgactgcatgcatgtggcatagctgcacaccggattgggtgcagatttgaacaagattgttggcatgcatttgctttcaaatttgataacgtaccttagatatccccaccttttctagtatgcaacagtatatactgttttttaagccgcagtatatatactctttgaagtgatgagcagtactatatagtagttttttgtgtattagcagtacctaataaggagtaccttatatttttgttgtagcagtgaatacttctttttttaattagcagccgaatatacttactccagaactaatgagtatatatatactgattatgtctttttattggtacgtgcagtatatactactgcaacgagcgaatgagtacatactgttctttctcggaatgagtatatactgattttttttttggaacgagtatatatactgacttttctcggagtggtatatacttatttcttctccaatcggtatgaacagctactcggagtggtatatacttatttcttctacaatcggtatgaactgctctttggtcagtgtatatatactacattcctcattgaaggagtatatactgcttctttttttatcagtatatacatttgttattaattgagtatatactgtatgcactacttgttctgtcagtatactgcatatactaattgtcatgtttggtcggtatactgcatcgtcctcgctaaaggaggttatactgcctttttgtttgatcggtaaatactacgtatactactttttttcactcagtatataaataagtatgtaccagtatttcttagataagtcgtatatttgctatccatggaagctggatgcatatgcttttcagttgaatagaataattaatatgcttttcacgtgcaaattcagaagtatgcctgaatcactggcaaagtatcggctgttgcattatgaataaacctaaattaatgaaataccctagaagggcactgaattctgaatggacattaccagaccaaagaaaaagatcaacgcagactatcggaaactaagaacaaaacataacgggatcacccctcgatgtggctcatcgaagaatctctgcatccccgcagacatatctcggttaacatcgatgggatcacgccgaccgcacgccggagagaggtggacaagaatgtgtcttcctggattaacaccgttagctaggaatcacgggttcgatgccgacgacgatgctgttgccgcacggccacacatgctggactgttctgtcatcagcaccatctacgtccacgatacatgcatctcgcatttgcatgcaccaaacaaattcgatctgcatgcatgcattatcgatttgcaacctagaaaaagcaaatcaagaaaatcggaagaaggaaggacttgcctgcagcatagtcgatgttccagttccggacgacgctcagcgtcgtcttgatcgtagcatgggcctgcatcgatgccgtcgccgtacggccacactgacttgcccgaagatcaatggcgtcgttgtctggtcacagctcttcggccagccagtcgcctgcggatagtcatactgaaggcattggtaatggaagacgccggcgtagacatcagcagacgccgtgaccttcgaatagccgatgggtcgcgccgtcgtcgccttcgaatcgccgatcgcgataacctgcagatcgatctatcgattctgtttacaaccacccacgagattttaatacgagctattcaaaagggttctggttagtacggaataattcagattatgaggatttttttcgtaactagaaatcaaaacgggctcggtatatggatccgcttgctgatttgatcggtggtgttcgctgatggacggtggatggaaccgggagtacctactcctgggagtatagaatcattatatatatatatatatatattatatcctactaccgggagtagctactcctgcatcatctgctatacgtgctttcaagatttgtgcagctttctgctaattcgaatttgtcattagcgggttaattaacccgttaaaatatgccgatcgctattttcgtgggatacaaacttttgaatgcattatgcacgtcagatgtttgcattatctgcctgacggccgcatatatatatgatctgctcgtccacgcatgtatttcgcatctatagcatatcatcaaccacaactaaaatgaacagatgatgttctgctggcacactgcgtgtggtaattacgtactgtccaactatagccttgtgaacaagataattaaattgagcagaagatgttctgttctttctctctatatatacctattcaaagaataataaaaaaaggcagcacatattctgctacctttcatggatgggaagaagatattctttttgaatgaagcagaacatgcagttttctagtttctgctcccggttcacattctgcccattttctaggttctgcattttgaagttctggaggagcagaacgtatccatgctggtattcaattacacaatcagaacttgatatggggaccagaacaaaaatgttctgctcttgtttctgctggggccttgtcgaaactagatttcggcaatagtaaaagggggtggctatcaagctagaaaagtgtatgggtttggagacaaaggatttatacaggttcaggccttcttattcaagaagtaataccctactcctgtccggggatggatccgccgagtgtattattgattgtatgattgggagaaaatcaacctatgccccaagaggcacccggaccctccttatatatgggaaggagtccgtgttacaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcctcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcgaatagatgcacctaattaggtgtagcccccaactatgtgattagttaacaaactaaacatatagttgagaacaaaataatagcacaatcatgcatcatatgacagaagcatatgcggcgcctaaagaggcattctagccgactgctttttagtcataataaaaagaatccgagtggttaacactctaaaaggttcacgaatgaacacacttgacaggcatccgaataaaaaactctaaagattacccaccaaacattataaaaattatggtaatgaataagtctaatagcctaagctatgactatccatcataatgaaaacaggcatatgtggtgtaaaatccgagtaaataaactcataaaggatttaccaaccgcctaaggaaaaatgactataatatataatcagcctaagccataatattggtcaataaaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcttaaaaagttgagtaactgcggtataaaaggattttaaggtattgagcacttgatcacgcgcactttggcctaagcgaaaagtgcctgagtccctaaaagaacgtgacaggccacacctgaaaattcgcattgtaataattccgaagaattatatgaccgcgtaaaaaaagattttatcagcattgggcaacactattgtgcgcataagttgccaaagcaaaaaatgcctaagtccctaaggagcacaatgggccacgctgttaaaagtattgggctgaggtactgttcaagcctaagcccattcgcacctccgatacccttaacaaaaaatcacgtgatccaagcgccacttcgtcttccccgccagaactctcgccattttccccacttcctgctacagtacagagctgcgccggcaaactagggttcaccattccactcgaatccaccttcgaaaagttcattaaaatccttcctgtgatccaccgcctcaattcctcacctctcccaagccatccctcgaatcaaatcagcgcattcaggtaaaatcgatggcgaaagagaaagaaagcttcgaaggccaatgggcaccatccgacgtgacggaggagaatctgaaggagatggtggcgcacggtgttctccctgccaaggagatcattgggtggcgaccagcgtgcggtgaggtttttccgtcccccgacacacatgaggttgtagttttttcccatttcttctatggcggcttcgctcttccgacctcaaaatttttccgcgggatattaaacttctatggaatcagcttgcatcacctaaacccaaattccatagtccatatcgccaatttcatccatgtttgtgaagccttcttaggaattaaaccccacttcgctctgttccgccgaatcttttttctcaagccccaaccgaacaagaataagccatgtgtagtcggaggggcaggatttcagttgaggggaaccctgagtcagaagtatttctctatgcccttcaagacctcaaacaaaggatggcatgcaaactggttttatattcagaaccctgagcctgctcttcccgagtactcttgtcttcctccggtgtaccaagatacttggaactctcttccgatcggagatgaagctgctcaagccttggagttgatggaccgcatgctaaaactcaaagaacaaggtttacaaggagagcagattactcggcatttcatcaaatgccgattggcaccaattaaagaaagatcccgcacagcattcgagtttgacggcaagcatgatcccaatcgtgaagaaccagactctctggactttaaaatcatgaaggagagaatgtataaaatcttctcaaatgctattgtcgtcagctactcacatcaactgccagttgtgccatataacgcattcaatccgcctccgcaggtatgtatctgaaatcttcaacctatgaccaaaatagtatcttgtcttcatgttgagttaactaaccatggaggcatcttattcaggaatatgtactgataaaatctgatcccccaatcactcagcgccggtctcctcgccagcacaccgttcagggaggtggaggaccaacaatcagaccagattcgcaacctcaaacctccaatccaactggacagacaggttctcgcaagagaaaactggtgccaaatgacgacgaaggcgacgagaaatctggggacaaaggctcgcctaataaactcccgaagcgtaccatgcccaggaaaaaactggctggccgtccaatgccaaagattagaacatcttctaggtataaacctcttggtaccattttatttcggcatgctcctctcatgaaaataatactgaatattgaaagaacattttgcaggaaaccatctgacatagacccaactggaaaagatcctgatccggctgccacagagccaaatttatccaaagatgctgagccgactgccgaaagccggccgattgccgaaagccagccgactgccgaaagccagccgactggtgcccatgcttcggatgacaaggcccatccgagtgaccagccgccgactggaaaccagtcggcagcaactgaaactgtaacaacccaagagcccccgactggaaaccagtcggatgtaagtctaaatcaagagattcctgaagctgaagcgcaggcgacaacttctcaaggaccaaaggctggtaatgactcgatgattgggtctccaaataaagaacaaggatcacctcacgctcagctaggaacatcctcaggtaactcatcttctcaagtgataccgatttaaataactccagtttatttgcctaatgtcttggaaatacatcaggaccaccgggcgatggcgaagaagaaattccccgcataaaggcggctgatgattctcgtcctcctatcttgctcaaatggtgggatgagaactcacaggttgccggcatcgtcataaaccgtcaaaaagaagatgaggaagtgtgccagctgaagaaggcgcttggagaaactactcgcattgtgaatgtaaatatttcaggcgactgcctttgatgactttgttttctttttagctgaactaaaccatgaaccatcatgcagagaatccatcttcgtaatgaagccaagaccgcaactttggagaagctggttcctcatttgggaactcttgaagcagttagggaccagctacacgaggccaaggagctcgccaaaaagacggaaaaagaattaagggagcaaattgctcagctccaggattcaaacttcgagctgagtggttcgtcaaaaggtaatcttctagacctgtcccattaatctatgctgtcataactatatcctcaaccatttggatttcgaacagcgcaagccaccaggatggttcaaatggagaaacaaattgaagccttgaaaaaagacaaagtagaactggctgcgcaaagggattcggccttgaaggaggttgaaggtactgccagctagcaatctggacgtctctcttttaaatgcagcagattcttatcataaatgtgttttgtagatcgtaaaatcaaatctcaagctcagtttgacgtcctggttagtaagatcaagaggcttgaaggagcaagagatgaagtcgccaatgtcgctataccactcgtccaagctatgttcctcaataacagtggtccgagtgcactcgacgcaaccgaaattttcgacaagctgagagttgctccggatgtatatttcaagaacatcaagaaagctggaagtatgggagctggcatggcattagcgatgaccaaatccttgtacccgaggattgaaattgacgccattgatggctttgcagacgggacaagcgaagaggctgctcttgatcttatcaacaatgctcaaaacgcggctgacaggattgcaagtgacgttgtagagcaattccgcaacaacgaccttcagccgagtaacaataactctgatgatgaaaggactgattctgactgagcataaatgtaacaaatggaggctcaatttgtacaatactggtgtatttatgctgtgcttgataactctagccaagtctttgatttcttaaaagcttttatcaagctctgttgagcctaaaacccaaagaagctattaaaaactttcagtcctcgcaaactaagtagaaaaatcgaacaaggcaatgaaaaaccaagtaggcaaattgaattgataaaaaatcacactctattattatgatgatagcccccgactgacaacttcgaggagaaaacttgatgttgacagtcaagacagggaagtacaatgataagcctaagcgtagaaacgacgaagatgttcaatgttccaagagttgtcgacgagagtaccgtcttcgcgcttgagtcgataggaacctggccgggtgacttcagagatgataaatggcccctcccatagaggagataacttgtgccgatcccgtgtagtttgaattttccgcaaaaccagatcgccgactaaaaaggcgcgggatcgaacattgcgattatgataacgtcgcagcccttgtaagtatcgagccgactgaatcaaagccgcttcgcggacttcttccaatcggtgcaagtcatccactcggtcctcttcgtagcgttcttcacggaaatttcgaaagcgcaaagactcgaattcaacttcactcggcaacattgcttctgccccataaacaaggaaaaaaggtgactggcctgtggcccgactgggtgtagttcgcaaagaccaaagtactgatgacagctgtttcacccatttgccggcataaggttttagccggtcaaaaacacgcactttaatcccttgaagtatcatgccattggctcgctccacctgtccattgctcatgggatgcgccactgaagcatagcaaatcttaattccaaagtcttcacaaaagtctttaaaaactccgcccgtgaattgtctgccattatcagtgatgatccgattgggcactccaaatctatgcacaatgttgatgaagaagtctcgagcgttatctgctgtgattgtgacaactggtttagcttcaatccacttggagaatttgtcgatggctacaaagaggtgcgtgtaaccaccgactgcctttttaaacgggccaaccatgtcgagcccccaaaccgcaaacggccaagacagtgggatggtctgcaacccttgagctggtagatgaatttgtctggcaaaaaattggcaaccttcgcacgtgcgcacaattttgtcggcgtcggacacggcagtaggccaaaagaaaccctgcaggtaagccttgccgacaatggtgcgtgcggcagcatggtttccgcatatcccagaatgtatgtcttttagcaattgtctcccttcctctaaagatacgcagcgttgcagaatccctgaagggcttttcttgtacaactcagcttcatgcataacataaagtttgctccgcctcgaaatccgctcggcctcatctttgtcttgggggagttcttgagaagtcaaaaatcgtatgaggggctctcgccagtcggcttcaaccataactacgtcatgaatgcccgcaacttgagtagtatctttgtgaggtaccgtcggcgtataaaggtgttcgacgaaaacatcagagggtgccgcctcgcgtttggatccaaagttggcaagtctgtcggcggcttcattattgtgtcgaagaacatgactgagctagagtccatcgaacttgtcttccaatttgcgtacctctggtcgatatgccatcatgttgtcgtcaaggcaggaccactctttcataacttggttgacgaccagctgtgaatcgcctcgaagtattagacgctttatccctagggaaattgcaattcgcagcacatgaaggagggcctcatactcggcgacgttgtgggacgccgaaaaatgtatccaaagcacatagcttaatctttctccagttggggaaatcaaaaccactcctgctccaatgcccgaaagtcgttttgacccgtcaaaatgcatggtccagtgctccatcttcttcgcgggggtatcctcctggcactcggtccattcggcgacaaaatcagctaacacttgggacttgattgaaattcggggcttgaatgatatgtccaaagacatcaactccaaggcccacttaacaatacgtccgtttgcttcgcggttgtgcagtatatcaccgagtggaaatgatgtgaccaccgttaccgagtgaccttgaaagtagtgagacagcttcctggtagtaattagaataccatataacagcttctgaacctgagggtacctcgttttggagttggctaggacctcgctgacaaagtaagtcggtcgctggactttctggacatggccttcttcctcgcgctcaacgaccaagactgtgctcacaacctgggaggtggctgatacatacagcaacaacggctcctgcggatgtggtgaagctaagactggtggctcggtgaggagtttcttgaaatcttcgaaggccttctgtgcttcgggtccccactggaaatcatctgttttcttcagtagcttaaagaagggcatcccccgctcaccaagtcttgaaacaaatcggctgagcgccgccatgcatccagtcaacttctgaacatctttctgggtgcttggcggtttcatgttgaggatagcagtaactttctccgggttggcttggatgcccctatgagacaccataaaaccaagcagcttccctgacggtactccgaaggtgcacttttcagggtttaatttcatcctgaaagcgcgaatgctcgcgaaggtttcttctagatccgagatcaaatcatcctttttcttggtcttgacaactacatcatccacataggcttcaacgttgcggccgatctgcgttgagaagcatctctggatcatacgttgataagttgctcctgcgttttttagtccgaacggcatggtgacgtagcagtatgctccaaagggcgtgatgaatgaagtcttcaagcagtcggattccttcagtcggatctgatgataccccgagtagcagtccaaaaaactgagaagctcacagccggcggtcgagtcgactacctggtcaatgcgaggcaacccaaaaggatctttagggcaagatttgttgaggtcagtataatcaacacacatgcgccattgccccgttttcttccgtactagaaccgggtttgccagccagtcgggatgaaggacttctttaatgaagcctgccgctaacagcttggttaattcctccttgatcgcgtccttcctgtcttgcgcaaatcggcggagtcgttgtttgataggctgggcatcttctttgacatgtaaggagtgctcaatcacctctctaggaataccgggcatatcagatggtttccatgcaaagatatctttattgttctgaagaaaggtgatgagcgcgctttcctatttacaatctaactcggcgcctattacagcagttttagtagaatcagagggatctaggggaatctttttagtcttagcttcgctttctccgctttttgaagtcttggtagcgggcatttctccttcgctcgtcgtggctgcagccagtcggatatcctctcgggcagacgctatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcgtggtatgctgtctcgaaatcggcaacttcaaagctgatattctctgtgcggaagttttcccgagttccaaaagtgaccgggagggtgatctggccgagtggagttgcggataatcctggaattactccgtgaaaaggtgcattgctgggttttagctcggagcgaggaatctgcatatcatccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaaggtactggggcgtgtcgggctgaacagcattgatctcccgttcggtcaacttttgcttccgtttagactcataagccaaggggccaccgaagatatggttgagctccttgcggtggtcttgaaatcctgccggggcgtcgccgtcgtccttcttcctcgacgtgctttgttcttcgtcggagttcttccgtgtagtcttggtgtattgatccgcgaattgcttgtagacgaaacaatctttggccacgtggttggagttaggatggtgcgggcattgggagttcatgatcttgtcgaacgtgttgacgcgcgagcgctgtcgagaagagtgactggcggttgcaacaagttccgcaggcttacgcttgcggtccttatgattgttacttccacctcctcccgtagccggcgtacccttatttggcttccaactaggacccgactgctttgatgcggtgacggcgtcttcagctttggcgtactcgttggctttttcaaacataagcttgactgtcctaggaggtttacgcccgaacttgccaaccaattcttcgtggcgaatccctttggtgaaagcggcgatgataacgtcgtcggtgatgtcggagatcttattacgttgttcagaaaatcgccggatgtaatctctgagggattctccggacttctgaataacgttgtagaggtcgtattgtgtgccgggacgctcgaaggtgccttggaagttggcgatgaagtggtcgcgtaattcggcccaagatccgattgtaccacggggtaatccatggagccaagatcgggcggaatccgctaaagccactggtagatagttcgccatggccttgctgtctcctcctgctgcgcggattgcaagaccgtagacggtaagccacgattctgggttagtggtaccgtcgtacttctctattccagtcggcttgaagccggctggccaatccactcgacgcagatcgtcggtgaaggctgctactccgtcaaggtcgtcgtcgtggcggtccggcgaatgatgatggcctcgagctgctcggcgctgtatgatcgtgtcgcgaagatcgacggggcggcgacgaggtggtgagcgaggccgttccactcggcgctccccatgatggtcgggaggtgagtgaacggaccgcccgtcgtgacccttgctcctgcgattggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgctgaggggtgcggaaaaccggtgtcccttcaacatcttgttggccgatgagatcacgcgctcggcgccctgcttccaaagctcgctgtcgtcgatcttcagcctccttcgcggtccgctcacgctcctgctgctcacgccgtaaccgttcttgttcttgtgcttgacgctcctcctccagtcggagacgctcagcctcgcgacgtgcttcggtctcccgggcttggcgttgctcctccgtctcgttatcggccatgaagacgccgaagtagagaggggtgtagttgtcatctaggctttcgtcgaagtcgtcgagatccggttcgttgtagcgagagctaaactcgtcgtactccacgatgtctgtggggcgcgagtcgacggtgggagagctgtagtggccgtccaactgatccgtcgaaaccgtgccgagtggttggaggatgacgccgacttccctgaagctaggcgaaatcggcgttgaagccgacttccgcctaggcctacgggatgaagacgctgtcgtgatgggggcggccgccgaatcgtcggggagcttcattaggatcggtgggtaagccccatcatcttgatctggtgtcgttggggaagatgcgatttcgcccgagtggtttgaagccaactcgattgagatggtcttgaagtaactttcggccgcgtttgggagtccaaacgggaccgaaagccggttctctcccgactgggccgacaccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaatagtaaaagggggtggctatcaagctagaaaagtgtatgggtttggagacaaaggatttatacaggttcaggccttcttattcaagaagtaataccctactcctgtccggggatggatccgccgagtgtattattgattgtatgattgggagaaaatcaacctatgccccaagaggcacccggaccctccttatatatgggaaggagtccgtgttaaaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcctcgccgtgtagatatgggatatccataatctccacaggccttttgctctaatagtagattgaattgtttttgaaggaacagaaactattccgttacatattcataattataggaacagggagattagcttctgttgcatgcgtatacatatttatgttatgcagattagcttctaccatatttttagcctgttttttcatttgccggctagtatatatcttctgtcggccaggagcagaaaatcaattccaaaaagaacagaacatcagttagttaggagcagaaaatcaatttgaaaagagcataacatcaacaattgcatgtgctgcccgtttatatacaacatatcaccaaacagtgctcactttcaaacgaaattaataataaaaatattggtttgagagcagaacatattctgcctccttataagtagatcgagtttgttttgaaagaacagaaggtattcttctttcttcttgccaaagcttcctataagtaaacggactttgttttttgagcagaagatatatattctgctttcttgtttctagaaacagagataatttcaggtacaaaattcaaatctctttctgctccctttctaaccgatgttctgctcctttggtagtttctgctgattttcaagttttggatcaaggagcagaacttaccgatgatgagatttaattagacgaggagaagttgaatatgtactacttatctaagtacgtacacagcagaaactatacccagcagaaactcggttatgcagaatatgtactacttatctaagtacgtatagatgacatacagtatgttagtaatcaaccgacagaacatgtactgccatcaaaaacagatacggagaaaaaaattaggtggctgttctgctaatttttttaagttgatgttctgtcattctttttaattcatgctctgccattttttctgttggccggctaatatatatgttccaccggcacgagcagaagataatatgccaggacgagcgggtgcgaggaagaaactgcatccgagaagttggtttgcatgcagccgatgatttagcaactatctgaactaacaaactatttaattaaacaacacaggtattcatcgttattggatcctcgtcactccattaactgaatccgatccataataggagggagtaactactctcggtagtaggaaataggctatatatatatatatattagaaaaactattttacacccggggtatagaatagctattctatacctncctcccaccaacccaccttttctgcccccaagggcccaaaacccacctcccaccttggtcaaaggccagtcaaaggtcccctacgtcggtctattctagcccaaaccggtcggtgactttccccacgaccctctctcttcttagctctcgtctcggaatgacgtagtaacatgttgttcatcatgtagtaacacaatgttttacttacagtaacaaaattaaaattgactcataatatacttatgatggatctacttttggtaagcaattttttttgaacatcatggtgcaaacggtttttaaaaatagtacatggtgtgagagatattacccttcaaagatttgtttttgaagatttaactctccacaagtagtaatactatatcaaaagttttactactgcctgttttgcgttactgcaatcacatcatgtcattactacaagatgtagtaacgattataattttcacgtaacatagtgtcttactgtaattacttgataacgttactgcaagactataagttttgcagcaataaagcgtctaactacattttttgagtagtgttactgcataaacacgtggtaacgtgtaattgtcgtgcagtaatacttttacttttgtgcagacttttgtgcagtgacaagtgtatgattagcatctgagacttttaacccatatatttttgtttcaattcctgaattactgcaattcaccacaatattacggtcaaaagtgcaataacgtcatatacatgcagtaacgttatattggagggaggaaaccaattttcttgagaagagggaggaaaaacggttcttgaggaggggagtacgtagatgctttttgaagtttaatcctccacatgcagtaacacgataacatcatggtggaaacggttttaaaaaataatacatatcttatgacatattgcttttcaaagattgacattttgaactttagccctccacatgcagtaatagaatgtgtaatttacagtaataggggtttatacatgcagtaacatggttttaccaaatgtataaaattattcaaaacactcctacatcaatcagaccttgctcaaagccacctacaaacttacctatggcccacctattcgaacttcatctcgtaaaaatgacatagtaacactgcatttatcatgcagtaacatatctacttggaagtggtaacatgcacctattatgtagtaacgcttctacttttgtgtagtaacaagtatatggttagcatgtgaggctttaactcatatatttttatttcaattcctagtttatgtagtaatactattcaagaaaatgcaagacactttgttactgcaaagcttattgtctttactagactcttatggtaacgttgtgatagaaatgtagtaacgtacagtagtaacaagtaatgctattgtattattacttgtggagagtcaaattctaaaaagaaaagcttttaagaacaatatctctgatgtcatgtatggttttttaaaattgtttgcaccatgatgctagaaaaaaaatgcttatcaaaagtacatccatcatgactatattttaactatatttgagcgttgttactgcacgtaaaacacagtgttacgagacggtgaccgccgcgttactgcacagtttcgcgaaacgagagctaagaaaaggtgggtggtgaggggagttagtaggtgggtttgactgagctttgaccggcgggagggagctttaaccggcgtttgaccgaggttggaggtggtttttgggccttagaatggaggggaaggtgggtgtggcccttgagagcgaggtgtacaatagtcttaccctatatatattacatatatattacgcacatatatatatggaatacatatatatatatatatgcatatgtataaatacatatacatgcatgtatagtacaattcatttgctcactagctagctatgacttcgacgccggcgttatgtcaaaagaagaaagaccgacgttatgaattgtcgatccgtcgtagtagaattcaccctcgggattaaggacttcttcgttgatgaatctcatcagttgttcctgaacaactgtgatagaatctttgtgtgggagattgtccctgatgtgaatacactatcattcgaaaaataatgacatatgaatatatgaaattaataaacaacaaatcgatacgcaatgaaattttgaatggtttatatatacgtacatcgagctctcgtgtggtgtagatttgggttgataggaagtgggcatactcgcatacgtagtagccgcacaggttagttccctggtcatgctttgcacattacatgagaaaggacaagagatttaatatacacttacattaactgtaactagtaatcatatataattagcatatgcatgatttaaaattgttaaaaattctaattatcatatgtaaataccacatgcatgatttaaaaatgttaaaagttctaataatcatatataactagcatatgcaaaatttaaaattgttaaaaattctaataatcatatgtaaataccacatacatgatttaaaattgttaaaaattctaataatcatatgtaaataccacatgaatgatttaaaattcttaaaaattctaataatcatatataataagcatatgcaggagttaaaacttttaaaattctaattatcatatataactagcatatgcatgatttaaaattttaaaaattctaataatcatacataattaacatatgccgtacaacaattgatttatatggatattcaatacatccaaaatattttacatcgtgtacacaacaattacggcaatacatcggcggtgacggttgaccgcacgtacttcctcctcactattgttccttccttatgatcgctacgtgagtaaggggtgtcttcgtttgataggaggatgctagggtcaaccgtcaccgtgaaagggggttgcccatcaaactgatcataatcttcatcagtcttgtcctcaactccgatgatttttcttttgcctgggagaaccacgtggcacttcggctcatcaggccctttgcccttctttcctttgctagacatgtccttcacataaaaaacttgcgttacatcattggcaaggacaaaagattcgtccgagtatcgaaccttgttaaggtcaaccgttgtcatcccactgtcatcaatcgttacgcctccaccaatcagccaaactcattggcaccggaacagaggaaccttgagaggtccatagacaagttcccatatgtcctcgatggcaccgtaatacgtgtcagttgtaccatcgtgtcccatggcatcgatacgaacagcactgttctggttcgtgctctttatgtcttggtttctcgtgtagaatgtgtacccatttatctcatatccttggaatgttgctatcaagccagatggtcccctcgccaggtaggcaagttgttggctaatcgtctcgttacccatgagatgttgtcgcagccacacgggcaatgtatcaatgtgatgccgtgtaatccatgcatcagacttaccgatgtttctggcaggaactagagccaagtgctcctcgatgtaaggagccaccaatgaagattgttgcagaaccgtgaaatgggctttacggaataaattgttgtctaccgtcattgctgcgttccttccgagagtcccctttccccgtagtctcccttcatggcgtgattcaggcactctgattgggcgaaggtcttcgataaattctacgcagaattcaatgacctcctctgttccataccccttggcgatgcttgcctctggatgagcacggttacgaacatacttcttcaaaacgcccatgtacctctcgaaaggaaacatgttgtgtagttacacaggcccgagaataccgatctctttgacaaggtgacaaagcagatgcgtcattatattgaaaaatgaaggtggaaatattaactcaaagctgacaagacattgcaccacatcattttgaagggcttccaatctatccggatcgatgaccttctgtgaaattgcgttcatgaaagcacattgctttgttattgttgcccggacattgtctggaaggataccccgaattataactggtagcagttgtgtcatccacacgtgacagtcatgagactttaggtttgtgaacttcttctccttcgtgcttattattcgctttatattcgtgaaggacgtccaagaattcccaatagggtaactcccaaaatatatagttctttttccacatcgccgcgtgaccatcttcgctatcaataggctggctgccaggcccctttccaaacactactttaagatctttcaccatagcaaacactgtttttccactgcgatgtttaagcttcgtacggtggtccgccttatgttcaaagtgattgcctttcttccgtacagggtggtttgcagcaaggaatcgacgatgacccatgtacgcaaccttcctacagtgcttaagatacgtactttctgtttcatctatacagtgagtgcaagtcttggaccacttattagactgccccgataggttgctaggtgtaggccaatcgttgattgttacgaacagcagcgctcgtaggttaaactcctcatgtttgtcctcgtcccacacggggacactttctttcttccacaacagtttcagatcttcgaccagtggtcttaggtacacatcgatgtcgttaccaggttgcttggggccttgaataataatcagcatcattatgtacttcctcttcatgtatagccagggggaggttctagatacacatcgtaacgggccaagtgctatggccgctgctcatctctccaaaaggattaatgccatccgtacttaaaccaaaccgtatgttacgtgcgtccttaccaaagtctttaaatgttctgtcgatgtttcgccactgcgaaccatcagcggggtgtgacacagtatcccgtcctgttgatgttcctcagcgtgccaatgcatcaatctagcacttccccttgctcctgaaataacgccttagccgtagtattatagggaaataccacatcaccttaggaggaattctcttcttcgttagctgcctgtaaacttcacctggatcatctcgtctaatcttatatcgtagtgctttacaaacagggcatgcttctagattctcgtactcctcaccgtgatataggatacaatcattcggacatgcgtgaatcttctgaacttccagccctagagggcagactatcttcttagcctcgtttgttgtctcgggcaatttgtttccctccggaagaatgttcttgacgagtttcaataaatcgccaaatgccttgtcactaacattattttttgccttccattgcatgaactcgagagtggtatccaactttttgtgcccctgctcggaacctgggtacaacgacgttctgtggtcctctaacatacgcttcaatttatgggcctccttttcactttcacagtcctccttggcatcctacaacatctgaccaagatcatccgcagcgtcgttattattagcatccctgtccacctcgcccgtttgatttccttcaaatccagcgtattgagcccagtccggaatgttctcatcttccacttcatcttcttccatctcaaccccttgcttaccgtgggatgtccaacaattatagcttggcatgaaccccgactgaaacaagtggaaatgagtagtcctggatacagaatacttcttctagttcttacacttattgcatggacaaccaataaaacccttatgcttgttagcttcggccactctcaaaaaataatgcaccccgtcgataaactatttggaccaccggtcagcgtacatccattgccgatccacctacatgaaatgaaaaaaagtcatacataaataaatattcataaaataatgacagccatacaataatgatcaaacaattaaaaactctttcaatagtcatacaataatgacatatcattattcatacaataattataaaataatccaacaaacaattcttatttattatttttgaatttttaaactaatattaatgttgtacttcttttaattttcaatttagtttgttttctatttttcaagattaattttcattatattttaaactatgagaataaaacttttttaagtaaacaaacaaaattcctatatattcttcttccccacaaatttgtttctctcatcaacttacgacaaagttttggagacaaaaaatgtgtgaaacatagctccaaaagtaatataacaacaaaaaacattggaggatgaagttactaaccttttagatacctccgatttgtatataatcaccaaaaaaattcacatgatgagctnctgtccatgtgaagtgcatntcatgggccag

SEQ ID NO: 6406 - DNA, 39844 bp, Oryza sativa
  unsure (1)..(39844): unsure at all n locations
aagatgtgtaggacatctggtgcagttgcnatcannnnnnnnnnnnnnnnnnnnnnnnnnnnnnnnnnnnncattgaaatagtcaaaaaaaaaagtttaaaagaaattgagaagatatattaacatgtgatatatcactttataaatatacaagtttaaattcaatttgtacatctcgcaagaaaaaacaaattaaacaacaactagttaacgtataaccatagttaaatttgtttttttatctaaaaacagttcagaattcagatatcgagtctgaattttcagaaagttcaggtttgagttgatttgttctatttcactggatttttagcaaagataagtcattttccagcagtaatgcacaatggatcaaacaataatttcaccaatgtaaaatgtcagtcggaaccaccagtagcatccattcagacagaggcttgtaactgcgtctgtgtctgaagctgatgcccagttaaacgtattgtcaaacagctccactcaatctcaaccggcaacaagtttcagattgccgtccttgcaacggttttttgtaacaacggaacatagattattggtctcaagtctcaactctgaacctagtccttgagcagtgactgtcccaagtcccaaaccatctgctaaactacagcattagccaaggctttacgcaatttggttgttttcactagcaacgtgaattgaaccattagctgatctatgatcatcagaattgtcggcgtccaaaaacctgacaggatttgactgcattctatgaattttaagttcagtgcaggaagcagccttgagatattagtcgtaactaacagataaaattgtcgttatgtcatctcgatctgaactgttcgtgttcttcagatatcagatttcaggtacaccattttccaattccgtcagatttagaatggacatttaacactgcaaacttgttccccgaattttgaaactattcggaataaccttcaaactaaatgcagaccaaagctgattcatgacggacccaatctcacaaagtcacaactcgcaagtgacagaactaatttttacttgagttagtcacaagcaggtgtacttggcctcagatgttatcaggaatcagcgcctctagccgttgcctcatcgttggaacttgctcatctccattgtcgacggaaacagaagtagaggcggtatcatcaatctcacaattcttgagcctcttcggaggaggagtagaaggagaaatatcaacttcctcaacaggtcgaacttgccaaaagttggcactcatgtccatctccgagtttccatcccatacaatctgaagatgtgcacaacgagcagagtagaatccatatcaatgcaattattgagtaataatcaatcacgcggtagtgatcaatcttgcatgaacaaaacagtaacactgggcatgcaagaacgaaatcgatgatgatgctgtgctgatgagggacaaaaaacaatcaaacaaacaaaatgaaaattcattggcatggatgtcaggaagctgtcaagaatggattacctcgagatttcgccacagctgtccggtggcaatggcggtgaccttgccccgtggcccgacgatgggcggcgcgccgtcctcgacggcccacacaaactccacctccgccagcgaggtgagtctggcgcggagcccctcctccaccgcctcgcgtggcacgacgaactcgtcgccgtccttccgcgaccggtacgccaccgtgaaccgctcgccggccgccgcgtgacccgccgcggctagtaccgcctcctgcacggccgcctggggcggggtcggaggcctgtaccggcgcatcgtattcctgagtggcctttcgagcgtgcgctggcgccgcaccccgacgtacagctcgccgtcgtcgtcgtcgtcgtcgcggcgacgcatgaagatgacgctgtctccgtcgacgaagtccatgtcgtcccgaaatttcttccagaccttggcgagcgtgactctcttgcccttcctgccgtagtcgaacgtcatcggagatccatggaggtccttgacgaggaggggctggaccgctttggcgtcgaccagcggcgggaagacgcctttggcgtcagccatgggggcggagaagcggatgcggaagtcgaagtcggaaatcatcagcgtcttgacgaagtaacgcaactgctggccaccggcggcggcggcgggtgcgggagcgggagcgggggccaggcgcgggacgtcgtggtcggcgaccgggtcgagggtgatctcggcgtaggcctcattggtgagggcgtcggcgcggaggcggacggcggccaccgtacagaggaagacgcgggggccggggacggcgagctgctccaggagaggggcggggaactggcaaaactgagcggcgtggccgtcgacgaagtagaagaccaccgagccgacggcggggaggcggccggagttcggggcggcgcatgcgagccacatgtcacggtctacgatcccgtcgccgtcgtcggcgagcggcgccgccgccgccgccattgtcgccgggagagaggacgaggggttttgggtggagcgggagatggatttgtcgaattgaggtttgaggcgaggcgaggtgacggttactgtttcctatatcaagtgggtatttgtatcgggacgctgatatgacgatatgttcaaaatttcggtccgatattttgaacgaaatttagtcacatttgaacaaatattgttaaaattcatgaaaaaattaaaaacattaaaattttctgccgaaataaatatcatatcggggttcgatatttctaaaattttgaaccctggcctcctccgtccagaacaatgtagacgattttttttactgatatttttccttgcagagaggtaacccaagcaaaaaaaaagaaaaaacgaaaagaaataacagtaaaaaaccgtgcaagtggacgctggctagctgtaagcctgtaactaactggtcatttaaaacgtagccgacaagaaagaaacatgtaataacggattaatcactgtaattagcaagacgaaaggagaagggttaacgaagtggaggtggcggcgtggcgtgtatatataaaccccatctgctggcgtcaattcgaatttcgaattcaacacatttccaccacttccactacctcccgtggaggagatcgaacaatggcgcagccgcctgacgccgccgccgccgccgccgtcccgccgccggtagtcatcgaccgggatgtctggcacgcctgcgccgtcccgtactccggcgtcctccccggcgtcggcacactggtctactacatcccccatggccacatcgaacagtgcgccgaggatcccgcgctgctgctctcccgcctcccggaccccatccaccccgtgccctgcaccgttgccgacctcgtcctcgacgtcgacgccgagagcggcgaggcgtacgccaccatctccctccttccaggcagccacgacgacacgaccgcgcggcgccaggtccccgcccacggcgagccggggttccgcttcttcgagaagcagctgtcgccggccgacgtcaccagcaacgccctcgtcctccccgccggcgccgagcacgtccttccgccgctcgacatcgccgcctaccagaccgcccggctcttcgacgtgagggacctgcgaggcaagcgcttcgagttcgtgcacatctgggacaagaagcgctgccgctacatgctcggcgacctcggcgtcaacgacaacgacggctggagagggttcgtcaaagccaagcgcctcgccaccagggacaccgtggtcttcatgcgccgcggcggcggcgacggcgacggcgacggcgagctgcttgtcggggtgcggcgcgcgccccgcgcgcgcggcggccaccacccgaggcccggggtcgaagacaacaaggtggtgtccgaggtgtggctggcgatgcagggcgtgacgccgttcgaggtgacctactacccacgggagggcacattcgagttcgtggtgtcgcgcgacgagtacatcggcttctccttctcgccgttctaccctttcgttcccgggacgacggtgcacttgcggatgaacccgctgcagatcgcccaatcgatttcgggcaccgtcaggaccttcgaccatctacgcccatggcgcatgctcgaggtattaatttcatcatctcatcatccccttcctacccaatctgatttgttcatcgatcaattcgatcgttgcatgttgagatgattgatcgatcgttgatctgaaattgctcgatcggtgcatgtgtgcaggttgattgggatcaagcggcctccccgatctcctacaggatacacagacaagttaattcttggcaagtcctgcgtcagcctcagccagcagcaactacttcggctgtgcgaattcgggatgccattgttgccaccccgcaagttcagataatggcgctgccgaggccgccgccgccgacgacgacgacgggaatggtgccggtcatcgaccacgacatctggctcgcctgcgccacgccgtactccggccgcctccccgtcgtcggctcggcggtctactacttcccccaaggccacgccgagcaatgccacacctgcacgacgtgcctgatcccggacaaccgccatcgcttacgctgcaccgtcaccggcatcgattcgctgtcgacgcccagtccgatgattcctacgccatgatttccctctttccgggcgactgctacgtcacgcaccgcccgcttcccgccgcgcgcgaccccgtcggaggccagcgggagttctgcttcttcgacaagaagctgtcgccgagcgacgccgcggcgaacggcggcggcagcggcgccctcttcgtgatccccaagcccagcgccgccgagcacgtccttccgcggatcccggacctccgcgtgacgaacctgcaaggcggccgctgggagttcggccacacctggagcgacgccgacacggaccgccgctcctcctcccacacgctcgccgccggctggagcgcgttcgtcaaggccaagcgcctctgcgtcggggacaccgtgatcttcatgcgccgccgccccggcggcgagccgctcgtcggggtgcgccgcaagccgcacggcggcatgccggtcgggatccccgacaagcacgtggcggacgcctggctcgacgcgtcgtccgcccaaccgttcagggtgacctactgcccatggcagggcacggcggagttcgtggtgcgccgcgaggaggtggaaggctcgccgccgctcgctccggggacgagggtgcgcttactgatgaaccccgacgacgcgcgccgccgcagccagccaccggtgtacggcaccgtcagggacgtccattgccggagcgagtggcgcatgctcgaggtataattgcctgacaaaatcaattgttcttcagttctttgatcaccattttccaggattcgacatgctgctgggttgctgtttgatcgatcgatcgatcaatctgattgcatgtatatctcgatcgatctgcaggttgactgggatcgtgactccccgctcgctcccacgatgaacagacgagttaattcttggcaagtccaacccgttcagctcgctcttccaccacagggttctgatgaggaggcggcagcagcaaccacatcgactgcgcacgccggagatgccaccacgtctgctccatcgttggcgctgcaacttcagacaatggcatcctcttcttcttcatccgcaccaattatcccgagtcgtggctccgcgtttcgcattgtaaatcctcgagatggatcacagggctaacaactcagcaagccatcagtagtcgtagtggtggtttcatggtgcggccgatgcttcaaatcacacttcgaattgctggtcggtggccacaaccaaaatggttgtaggcgaggaccctgaagtagtgaaatcacacatacatttatgtgaaattttgataaacttcccaaggtatattcactgaacttttccacggctactgtctcattgacattcatgtctttgcttgcaatgaagattgagaaacaaacttgaataggctaattgatccacttatcgatgccacaagattggttgccagtcacactgacacactgtcactctattgggtccaatttgcattactgcaattcatacttgtttatggagttatggttaagagcatctctagcaggacctaaacacagcccctaaaccattcattcttgtaagatgtgttatttttacgatcgaaccattcatggttgtagaatgtgttatttttaaattatataatacatcaccggattcacatagcttattgtggtgatatggagacaaaaaaaaattacatgttggtgagcaattttcattttcattggtgaattatgaatcttagttgcatgttgttgtatatggcattatgctcacaccgcatttacatgtttgaaaattttgattttggatttgaattgtggtgtgtgaaattgtgaatttaagtgtggttaaattatatgcattagaaatatttatgtttgaattattgtggtattaaacgtagtacaaacatggattgtatgttaaaatacaagaaaaacatgagtaagagttaggaaatactaggctactgctgagttggaagtattttttggttccttggtaaatggggcaacaggcgaggggccacgctggccgcggtggcggagggaggctgcggtacgggtacatcctgtggcggtacgtggtccgcgagatgaacatgtgggtgcggtggtgtatgttcggcacgcggtggcgaggcagcgcccgcggcggagaatgaagggtgcggattaacgttgttgcggatgtgcgcgattgtgtgggtgacgatgggttggtgggctagctgcgcctgcgcgccaggcattatataggcggacgctgtgtagagtgcgtcgcgcggcgttgtggcacaggcgcacagtttcgagaaaaaaccgtgtcactgcgtgtgggtcccacgggtacacctgatttacgctgcgtcatttttgcgctaagtcatttaggcgtggtcaatttctcgttgaagcccaggaatgttttctgtcttgtctacaaattgtaccatttccggtgaaagttctgcaatcccactccaaaatccgaagaaatattatatgttcggttggttggtaaccatgcacaattagagcaaggagatacggctatggagaagagtaggtagtatttgatttagcagttgccatgaaactatgttggaagaagctaaatacatcggcacatgactttggaatgttcccctaaagtcatatatattgccacatattttttaaacaaaactctatagacaaagccacatttatttcttcttaaataaaatctccatgccacgctcaactctagtcgaaattgtcgactctaagttcctccttagtgtccatgtttttttccccatgaaatacgtattttttttggaatatgcaaaaagattgcgcaccttttaagaggaataaaatttacacggtaggcaaaacaaaaaaatgagggggaggggggttggaagaaaaggaggacttaaacctattcttgcgattacaatgagatgaccaaacaacctagcacgctacgaagaaagcgttggcaacaggggatgggcaagatgccaaagggcggcctcttgtgacatgcctacgaccacctcgaaccagggccgagaacagttgttgaacgcgcggttgttccgttccttccaaatagaccacgcgccaagggtcacgaccatgttgaacccacgacgacgctccctccaaactttgagtcggcaggagtagtgccactcatggaaggaaacagcatcagagggaaagcaatgtgggaggccgagactcgagaggacggtccaccataactggagggccatgaaatacgtattgaaatcatcctagcagtcgaggtaactctattgagggtaaaatttatactgttggctatcaaacatttttggagtctttttttttttgtctaaactagacaaatcggttatttgttgtctcaacttttagaaacgcatgaacgacacactaaattatggagtattccacaataattttgattgcattttgttgacatagacctaactgggtggtatactatttacatcaccaaaagatgcataatatgacctaggctagtgaatatcaccaccgtatcaatgaaaactgccacatatttttgccacacaacacaatgttacacatcttcaaatatgaaaaactagcatgtataaaaggtgagaaaacagagcaaaattcacagaagattcagaaccggcttaaatgtgtcagctcaatgcatagtactatcaagttgcacaggcacacgaagttctcaatatccagaattcctcaattgctataacaacttgcctacagtttgcaggaaatttactccagaaatgcgatctaaaatctgcaattcctatgacaaacatacacgtagttcgtacgaaattcagccaaaagtctcaaagagagaatttacatcaagcatcaccacaatccacatagtacctatgatctctctgatgcaaaatctctgcgctattcatggaacggcatgacccagacaggtggggccatcgccaccttgggccccgcattgtggacggagtagagcttctggcggcgcacgtcgcagcaccgcaccggcacgtcgtcgccggtgcgcacccgctcgtcgcgggtgaagtagatgcagttgccggcgcaccacggcaggtgccgcgcgtcggcgacgaacgccgtgccgcgcccgacgaacaccgcccgcccgcccaagtccttggggcggcgccagaaccgcagctcgtcgtcccaccggaacgcgcacatgtacatcttctgcttccaccagcgccgttcggtcgcgacgagcaccagcgcgccgccgccggcggaggaggatgcggtgtccacggcgagccaccaccgcgcccaccggatgctctccctgcgtggcgcgtccgcgaacttgtcgacccgagggggcgacgcgctgccgggcggcgggatggacacgcgcagcaccatgccgtcgtagcacgccgcgtagaagctgcccttgtggtgcaccacgctcaggaactcgcgcctgtactcgtgcggctccatgtattcccagcccacctcgacgcgcgtccacgacgcgtccccgggacgcgcgatggcgaggcaacggccgtggcggtagacacagagcgcgacgcagtcgtcgtcggagctggcggggctgcacgagagcgtgacatcggtgatgtagggctcgggggggcgcaacccctctgccgtcttgaacacgcgctgcagtaactccgcgcccgtctcctccacggggaggcccgcacgaatgcgcgccttctcggacggcgtcagacgcaggaggaagcgctcctcgggcgcggtgacctggatctcgaagagggagaactcgtcggggaggcggaactcgaggtgcgggagcagcgggtggacgacgtggatggtggcggtgccggcggcgccggcgactccctcggggcccttcctgaccatgacgagccagccacgggtgctcccgacgcagcgcgcgccgcgggcgtgggggaacgcgatgtcatggcggcgcccgtcggcgaggctgaggaaggcgcgggaggccgggtcgagcgccatcccctccgggagcagcagcgccggcatgagccgctgcggctcggcgatcaccatgggcccgtcgcaggggagctcgagccatggcttggagaggaaggtggcgccgtcgaagtccgggttgcgggggaggcggcggaagacgttgcgcaggacggggcacggcgggagctcccagccggagggggaggggacggggacggggacgcgggagcggccgtcgacgtcgacgtcgtcgtcgcgggcggactcctccacctccacgtacagatcggccggctcggccgccattggagatggaggtgagcggggttggtggaacgcgcggcgcacgggagcagggaggttctggaaatggaatgttgttgacggcggcgcgttcattgccttatatagagatactttacttgtagttctaggcgggtaggctgtgtaactgtgtacagagagtggttcgtgtggctccgcagatatcgacttggtagacacgaacacgctgcgcatgtgtctggatatatgctaggcttgatagaattttcttggtttgactgtgttctttactctgttttcctcacttcacctcttatatttttcgccgcttcttaaattgttaaacgctatatttttttaataaaattgttttaaaaaccatattattattattccatttttttaagtttttcactactacttaaatacttaattaattatacgttaaaccgtcgcctcgttttgtgcaatggggtagcgttgctaacttcaattggcaaacacaaagcaaggcactgcactcatttagtgaagagatttttttttagagaatggtattttttacccggtctctatatccaatcggatatatgcagcatttttttaataggaacttagcctatcgaacaaggaactagccctcaaataactcaatctgaaattcacttctatggagatttgaactcaagaccttggtgtgctactcaagtcactgcaattactaggcaacatatcgtttcacatttggtgaagagatggcattagcattacctggcaagattgttttgtaaccgctgaaaagaaaatcattgtcatgaagcttatatgaataggtaaaataaaaacccagttgttatgtgtgggatacgggaatgcattacattttgttgaggcatatcgaggctctgtttagttttcacccaaaaattttacaccctgtcacattgaacgtttgaacaaatgtatgaaatattaaatatatgttaaaaaataactaatcgcacagattacgactaatttacgagatgaatcttttaagcataattgctccatgatttgacaaggtggtgctacggtaaatatttgctaatggcagattaattagacttaatagattcatctcgcactttacgtgcaaattttgtaatttgttttgttattaatctacgtttaatacttcaaatgtgtgtccgcgtatccgatgtgacacgccaaaacttttcaccatggaacaaacaaagttatactacatgcggagaacaacatttttttaaaaaaaaaatcagatattcagattttgaagaaatcccaaacacactatactgagtactccaactcaatacggcatctaagttagatgtcgtgagtttgaaatttggttgatctttctcaccagagtaaaagcaaccctcatacgagggcaaaccaattaaaaactgttatttatcagccattcatctatctattatatactaaaagtccataaaacttcctataaacgctctcaagtcaccatgtggcaatctacaatcgcttctatgccaccacgtggcgctataataaattagaaaataatcatagaaattcttaaaaaaaagtaaaacatgtaaccttgattttcatttaaagtggtggacccattattttagaccaataaattattagatctataaagaaaatagtctctcactcctaatatcctgttcacgtacgagagaaaatatttacgtacaattaatccatccgaacaaaaaaaaagccaaagatctaaataaagaagaaaaaaacacaaaaaattacgtatgattggaaaagaactcacagccaagattaattgtaaaaaaccacgaacctgaacgaccagccaagattaattccaactcacggctcaagcacgtatatgtgctatctgctctctcttttctctgtaagttgttgagatctaaagcataataaaatctaaacaacattaaatttatatcttcagttgaatatagacttccatggttatacgtcagtgtcctcctcatggagggctacatgcatgagtggatctgcatgtattaacttttgaaaaatatatgttgattttctgattagtttgattctttatattcctgacaattaaataaataatttaaaaccatatggactgttttatctatctatatgtctgtcttctattatatactgaaaattcatgaaacttcctataaacgctattaagtcgtcatatgagagtcctacaaacaccgctaaaccatcacgttgcactttaataaacagctggacccactattttcattactattagaattgttttttccacctccctttcctatccccatcggcatatatccagcagttatatatgtacgtaaggaaaattacctacccactatttgccaaagaaaaaaaatcacctacaaagcgatctatccttaccccccttattttcttcagttattcactatttaaaactttataaaacatatgatgtatctattctataaataatatatatagcatcgatattacctatatattaattacaaaaaaaactgccacatgtaaccatattcttaataatcacttcatttgtcacaaatctcagtatcaagtctaacaacaatttttttactatcagttatttgagaacatataatgttttagttatatatcccaaaaattatggaattttttttgtttgtacttttagtagtattatatctatatgtaaggtcttatattcaaattcattacatattgggaggaagaaaaaacaaaattctaatacatttatactcttaaggccgtcaggatttttaacctttttgttgtggctaaaatataatgaatttaagggtaacactttacccataattgtaatactaaattcctaatgcacgttagctaaaagaaagttacaaagagtgattgtttggagcatataaattcctaatgtttaattataaattttagagtaaaaatatttaaatcatgacggcaatcatgaaaagtccaaactacaataataatcacgcttgccgagttatttttagttatgaaattatattcgtggggtatgtgaagtctcatgcactatgcaagaaacaatccgaaatcaatttagattccgctagacttttttatttggaatatgtatagtgtcaaatgcacccaggcatcagttcatcaacaataagaaactgcaacataaagaaaaaaaatagcatgtgcatctcagcaacgaaatacaataattagttgtaaaatatctagctaattttgctatataccgaaaagaactatcaagttctatcgattgttggcaaacaataatatgggcacaagtaccattaatttacatagtgaatttaaacattttaattgtataaataattattttaatcacactactgcacaaatgattgtttgtgagcattcttttcacatgtggctcaaatgtgtagcttgctatgtggcgagccttttgcctcagactcatgggtcatctttgaaaataacttttgcaatccatttacaaagaactattttagtgaagtgcttaacctgttatgtaacgtatacaactattttagttgagcacttaacccgtaagatagtattgaataaatctactactttcgttacagaaaaacatagcttattttacaacataatgatattttattctttccaaaattttatatttctcttcatatgagtcatattaaacacaccaagagatgaaagtcaatgataaatcaacaaattcaaattcagtaaattcctatcctttaagtagctccaagggtttctccacaacctacatgtataagcctctaaggtggtaatacaaattagtatcctttcttattataatatgattaaaagttatatttttccataataaattattattttaagattcatgttgactagacattttctttaaaataccataaggtctaacatattactgagaagcgctatataagatatgtatatttcatcaattaaaaagagggctaacagggatggtaaaagaataaatttacaagcaataaaaatttctcgagacttcttaagaaaaatgtaaacaatgaaaattcaattaaaaaaataccttactttagtttcaacttattttgttagaactattttcaaaactaaataaaatgcatgcccgcgtattcgcgcgggctagctttctagtttcatgcaaaagtaaaaccttcaccccatgacccatggaaatccctagattccactgcatccagccaaatgagaatatacctcaattcttaaaatccaaactaaactgaaataaaattttagagacctgaacaaaccaaaacaagaatttccagataacccacggtaacaattcaaccatcactaactagtattattttgtttaaatatctgaatacagccactaaatcatacccctgaatcaagggtatcaatcacaacacaacctctaaaatgtacaaggttaccaaggatctatatgactaaaatcttaatcaacacacaaagttaaatgcagcgcacaattaaaataagtacactcatatgtttggttgtttgtttcttttcaggggagaatcatctccctcgatcatcggagaaggactctgagcacctactgacgctttgcatcaacagcttccttcagtttcctcccgagggcgaaggcaagaggtggaggcaccgcattgccaatctgcctgtgcttgctctggatgttgcccgcgaactggtagttgtcaggaaagccctgcagacaagaataggttagttaaacggtcagtactgactcccctccaaattcacaatatcttagaagacaggaagagaatgttgaatggatggatagcaatagcagcttacctgagatcgcgcacattcacggactgtgatgatcctatcctggtcagggtggaagcacatgccaaccttgcccattggctgggggtctgtcacagaagtagggaaattgccctcccaatccagcctaccataaagccctttccactggttgtgccttttagctgtgttaggcaggcaccaagggatcaggtccaccagttggccagatgatagtttcacctgcacacgctcataatggttaacattccgctgatgcaaggaatgtatggaagagcacaaaaggaagtgaatgcaaccgcaaggtagatggcatttaccttctcatctggtaggtcatgccaatcacaaccaggccgctttggaatgcgttggcatctgatgaggttcagttcattcatctccttagatatgtgatcattcagcgcgatcgtgttccctctaatcttcttctggaaccaggagatgggttcgccaccgtactgcattacaaaagaggggattcattcagcatataaatcaagagaagaaacaggataaaatggagcggatagccatataggagaagcaattttacctcaagtaggagtttactggcgccattctccacctttggtaaatcgcctattgtatctctaactgttattgcacggaaaggagcaccaccagcagtgctttttgcagctgcatagtatttaccatcaggcaaatttattttcagctcagggctagcaaacacatgcattggttctggccaatcaggcagagtctctccaggtgcagcagcccaaatgaatgctcttttcctggactgagcaacaccaaaagtccctgcctctaaaattccaaaccggacctaagcaacaagtaaacagcttctggttattataagattcaaaacaaatgctgtacataggcattttaagtatgtataaccagaagaataattacctggtatcccatctccagaagggatgcaactgtcagtcgaaatgtctgtcctttgttgaatgaaacaaagttcctaacattttctaaaagaaagaatctggggcggaaatattcagcaaaagacaggaatgctaaaatcatctcacattgaactttactccatgggctttggttaaatctgttcatcccagaaaagccctgagttgagaaaaaaattacaaaattgaagtcatttatcacaagtattgaagtgcaaacaatttgcttgcctaggtgcaaagaaaattccatcaagtatagcaaaataatatacctgacatggaggaccaccatttatgaattctacttcaccagggacaggaaggttcataatattgtcctgagaaaatttagctgcttgttcagcagcctcagaagttgaaatgcaatcatcagcatctccacatttgtccataattgccctgcaaaatcatataacagtccctattgagctatataggtaaaaagaaaaccacagaaaaaatcaaggaagtgcacggtgcacctacttcaaaatcacattgcagttatccacaaacaccgcagcttctggatgatttttggtaaatgcttcaccagctggttcctcatattcaatcgcccactttgtaaacgatacacctacagaatttaaatggtaataaaatatcagtctgatggccgacatgttgatgataaagctaaacaccattattgaaggaaagtgcataccagcttgctgcagtccttctgataaacctccacagccagcaaaaatgtcaagagttgcaagacggttctctttggacacctttgtacatttatctgaatccacctgatcactttcacagatctgctttcctttgttctttttcaaagcgccagttgccttttgttgcacagacatgagcttaacatttggaggcaactggtccatatatacagcacacattcagttaactatggaaactaacattgctgaataaaaatggtacattagctattgactaacctgctttaatgctccagtggcaggatcatagaaatgttcacagaaaaattcatgttcaaccatcactggaacatctgagtttgagatgtcgatcttctttttgacctcacattttccctctatcatatccacaggcactttaactatattttcactatagtatacctgatccagaaaaagtatcaaagccaatgtaaggagaaatatcttgcaaacaatgacagcaatgaattaatgatgacaccagaatttaaacatagaaaaggaggacaaagaatgtaacctctctaatgtcagaaacataagctttggctgatgaaatgtcatctggtctgtaaaatcttctaacactgatttttgttgatgctggatgaatttttctggatccagcaggttcatggacatccaatagatggcaaactacatagggctttagacccacatttcgccctcccttgaaggttgcacgatcctcctcttgagagaaaaagtcaggtctaatatacaaatagtcattgacattgtaggtaatgtttctgtaaatgaagctgttcttggatagtatttgcaattcatcacaatctggctctttctgctgacaagagctacagaaaccattaccaaggcccagcttatcatgaggaagggagaaaaatgcacccttctcaggccagtacaagcttttgcataaatattccattggcaaacctttcttcttcctatcttcagctttggcacgctcaatcctgtcagcttcagcattctcttttctatacttgtgaccccagggcaatgattggagattgacagacatcaattctttgatatcttctaactcaaattctaaacattcattggttaagaaaagatccctttcatttgcagcattgccaagaacagtctctgaacctttctgaagtagccttccatgaaccatttttgctccattaagtttctgaaacatgtactcaacaaagcacatgaccagttctcctgaatcatcttctagtgcaactgtccgtcccaaatttattctgagctctcgaacataagcacatttgtatagagcttctccagaaggtgttttaccaatggcttcaccttcccatctaatttctttgcatgtttgtgataccaactttcgagaccgtgttgatggtggagtttttgagacattttcctcctcaatctgtgcttcctcttcagcatcctcatcttcattttcttccagttcatcatcaatttctttagcttcattcacatctgcatccttggaatcttcagggaaatggtgtgtatagtaatcactccatatcctgttaatcaacctggttgttgttgcacgcatcacttttcttcttgatgctggccccatagttgcacttgggttcagattctctcctctcatcacttgaacctttttcttcatgaccaactttgtatgccttctttgctccatcttcatcaaaagaccagtagcaaatgcactccgccggatagtctcatctggaaaatctgagaactgctgaagaataatctgtccatggaccacaatatatctctcgaccagtgcaacattagatgatacaaatgcaggactccctttatcaaattcagccactttcttgatgacatcagcaaaggaaagctttgaagcacgactttgctcttttagtagagttatgatgctaacagagagcctggctgttttcaagacaggctcacaccaaggagcatattgctttgtaggttgccgtagcttatacctgaaatcacgagccaaatgtaagcatcaatgtagcatgcagaaggaaaattgtttcccaacaaaaagattgtgtaatagaaaaaaatccacattgaacagatctggctggagtacttaccaggccacatcagttcgaatggttatgcaaatcattgatccaccaaattctataacccactccttgatagggctcagataaattgaaacgcctgcatcctggtggttagaactacttgatgaagacaattttgcagattcagcagtagaacagcaacttccatcatcctctctcataaaaccagatccaaagacaactatatcattttcagcgcctgctttcatggggattagttccaaaggaataagcctggagtctgcattgtataaagcccagttgttgaggatccttactggcacatcagaatagaagctatcttcactgtcaaatatgtactcatccatttcttgactagagggtttatagtatgcaggcagaggatagtcattggcaatctcagcttcactaattttgatgtagacatttttctgggaagttgttccacgtttacctctctgtttcatcatcttccattcctcttcttgttgcaacaatcttgctaacttctcatcatcatcttcagatacctctttacactctgcatcattaatcttcaggcttccatttgaaatgttaggctgcagcttgcttacttccactctagatttgcacccatctcttagagcaagaagaactggtagtgtcgcaaacttctcatcatcagtgtttgctgtctcatccaatccaataagctggttgtatacaaactcaccattggagatcacaaagtctttgctcagtgtaccactataacctttgatagcattaatagagcgaacaacactagcaagcaattcttccagacctagattaggattcccaccaactgatcttgcaagttttctgtaaacttcaacacagacctgtgccttctcatagaagtggtcatagtaagatttgtaattgcctgctggcttcacacattcgtagtcagcaacttctgttgagacccagactactgcagtaccttcatcataaccagatattgcccagtcctcaattcgcccaaatccttcacagcgcactcctttttgacgatctttttccaaatcatcatccatgggcatgataagagctgtgatgaaaaaatcatcaatttctgacatttcaaagggctgtagtttcccatcagcatcatgcaagatgaaatcaatcaatttccgacaaggtcgctgaacttctggtcctaattttgtcagctttacggcatccatttcctcctcttccatcttatttccattggtcgcgaccacagaggatttatcagataagcgtacagatttctctttgaaatcagagcacgctgctgctctccttggcctcttgcaggcagcacgactatcaccctttccaactccattcatctcttttgtagcatccagaggtccctcatccagtttgcctttatcagttgtatcttcgtccttcttttgtggctttgctctgcaccttttctttcctgaaaaccccacaactcagcatgttaatcaacaattaagaaacaggaatgctggaatatagtaaagactttaggatgtaaaactcaaacatgaaagacaaaaaataaagatgaagatttttgagggggaaaaacaaagatgaggatgcataaagtgtacaaaacaggaaagtattggttcaccaactggaataaataatagaataaactttcaccaaataaaccacaatcagataacaaatgctttctatcagtaacttgaaaaacataggcattagaaattaaatgcggcaacatcacagcaaataacatatatatctactattactattctgctttcctgatgtacatccaacggtgaaatatgcattttccaaatgcaaaatggcacaagtgacaagaagccattttcaaataagtagaaatttagcaatccacttttagagcgattccagcactcattgtgaataatagcaacacctgtcatttcttaagttaacaagacttcattattctgttttggatataatgcacatttaatgccatgttttgtgggaaacttgctggtggaacgcatagataacctaccgttatggtatcatgtacaagtcaaacaaatcctaggaatcatgatcgatggcatgctcacgaagcatgccaattggccatttgggcaattgtcaaggatggcaaaaactctttccgaatctgttggctgccgcatttatgcattaacatacagatgatgagtaaactaacaaaaagtagtcaccggaaacatggaacaacctgggaccacggggacaacattgtccctgccttgttaaaacctttcaaaatagcattcagtgttacctcgatcccgtttgttgatgcatagatccggaacttttgatggccaaactattgttaatttatttcctttgaacaaggtaacatgcattgagattaatttaccttataagtatgtaataagaatgcttttcagagggctgtccaaggttcctaacaaaagatttcttaagccaatatgtgattaaactatgctacccattgttaataagccactcaacccaaggcattgttgtttagataagggaaagtgtaaattccaacatctacatcaactaggattgcacacaaccaagaccagaaaaaaacataacgtcacaatacttgtcaatgctaagactggtcaagaaaaaagaaacgtagacccgccatcaccaccattaggcgaccaaccacaagaggacaacagttgaaagaggtccttggggctttagtattgatgacaacacctccaagaagggacacggctcgcatcatcgttgctagatctaatcagtgaaaattagatcgaaggttttcacctctgctcccatgggccaattctcctatttcgatgcctttagaagggaatatcaattaggccagctccaactaatgatggtaagaacaaaggttttcaccctgagaagaggtatcggagttcaagattatgtctcagcatgatctcatcgctagatccaaccaatgaactgccaagccaagatctctaccccatcagtggcaagaaagttccacaaagaccactagcctacggagagccgtatgccaccagcaacacaaaaaataaggttgatacagaaggcaatgccgctgccaccagcgatttgctagcagcagtgacgaggagatgcgatatttgattccctttggaatggcctatgccgcctccggatcagcctttttgagcaacacagagcagttgcaattggtttgctaatgtaacaccagattaagctgaaatgcagcataattatcagcttaaccaaagtgggaaggccacaagcattatacgcctaggcccatgcccagtccaccagttggtgatatgatggcaagagacgataactgcggcagtgatggtgatggtggctaagtgtttatctatgtcttgacatgccttgcattctattcaagttaaggctccccaagacatctacctctaaccaattacacaactgacaacttgataaacatgtgcattactccgtttacacgattgtgaatgtgtgatgctgaacttgactagtgaattttggttaatacgttttagcattagacaccaactttgcttaaatgcatcgttgttgtggaacaagaatgcttgtgcttatataattcaatgaatattggttaatagcagatcaggaagagggagaatggtgggagatttagcgtgtattcctggtcaatataggcatatatgccatcccttttcacaatatattttacaaaatgcatatttgttatgatagggcagacccctggtcttctgccaaaaaataaatcatagcacgcttgatcgaactggtaaaatacatgacgtgtggcagatatcatctatcaaacaagagtcaaatgccatcacagatttacattctcaaagtcaaagcaaaggcgtaaaaaactatacaggtaaaattagtgtatatcacaaggtattcctggtaacggtaaaggaacataatgtcatgccataaattgaaaggtgacacttcattgtcatacagggcaagtaaaagacgaggtaattaagaacaagacctgtggtaacgggagaacacggacttttcaccatatctccctgtaaatttaaaattagtcagacatgtagattatatattagcacataaatgcagtagtcttgctaccatttgaaattaactatggaaaaagatcgaatgagcaacataatttatcaaaagcaaatatttgcaaggtataattctatgctattaaacatccaaaacagaagtgaaattgttagtttcaatacatactatttgtctgtttaactatattttggagtagcacggaaacgatgcataacatgtatctcttgtgcagtttgcagttcatttagtcactatgataaaaagtagtagcattcgttgcgcaaaagcaaattattaacataaatcatggaaagtaaagataataattgtgtagaatcatctagaaatgacagcaagtaggtcatgacacacccatgtcaagaaaacccacatccaaatcaatgaatcatgtactcactaatacaaaaatattcccattcacaatttagttcacaaacacaaaagccagcagattacaaaaactgataatgaagaatggatagataagtacgcatattgagccaaccaacggtaaggtagtgatttttcctaaaacatcactgaccttaagataaccccaaagtttgattaaaattggtccaccataagataggaaagcagggaaaacaagtgagcactactgaatacagtaaacacacagagaaaggtagtggcagaaacaaccacaaaaaaagtccaatgttccaaaccatgctatcacattcaaccaattaataccaacaagaaactctaaaacgaattgctgtagacaacgtttggttctactgttgcacaactgtaggtagcaaataaggcgcccagcatctcaacaacccactaatcgcaaacccaaaatcaccacatcagcacaatatagcaacataaatcactcaaaactcatttgctataaatagaaagtgaatccatcacagaaataccttgtagattgatgaacaaggttaccagctgcggccaatcgttggcggcggtgtaccaagggccgcgaacaattgttgatgaagataaaaaatccacccacagattcgctacccctgctttgcagttaacgccagaataattatcagatggggaaaatatctagttaactaacctagaagttgactattttggggaaagcgactcaacactactattaaagaggacgtcggacagattcatggcaacaagattaataactcagccaaacagcaccaaaccacacttcatcaaaacaatcttctaaaccccacaacatacttacataacataccatacgaagattagtaggactacaaataggcagcgttggcggcggcgcggcgaagcatagcgaagcagccccaaatctgggttggcctcagccctcagacgaagctaagcacgccgaagcagcctcgaatcggcgattccagcaccaagatgaatctccagagcgcacatcagaaaccccactttgtgaagcgaaattaaaaaaacacgaccaaaatatccggggatagtggaaggcacggtccccgaggcaacagatggattaatcccaacctccaccaggacacgccccgtcccgtcctaccaagtgagaaaaaacaggggaaccgtaacagtagacaggatttcgctggctaatccagcgacaaatccctcacgcctagaatttgcccctaaatcacacatcaaccagcacaaacagaacggatttgctaaacaaaacccctcctaaaatcaaatcctcccctaaaacccccgaatccgcggggtaatccatcattccccaactcgaagcaacgctccgccgcagcaaaacaccgaaatctcgaaaatgtttcctatcaaatctcctcctaaggcacagcacgaacagcaaccagcaatgtaggactcaaatccgctccgtgaacgctttccacagccaggaagaacaaatcccccaaacctggacgcgcaacctgacgaaccagcagcagcagcagcacgatttcaccggccaaaaccctccgcccaaaccccacaaaatcacccgtacgaagccaaccagacacagatcgagaagcatcgccgctacaacacgcggggtaaggaaaaaaaaacaacaaattaacaaatcctacatcaccacacaagcttaccaagccacgcgtcgacgcgccgcccgcggagcaaaccggaaacgcgcctcccacagtcaccaccacaccccccaccccctcgccggcggcggcggcggcgcaggcgaggttgtcacgaggcgaagcaagcggcgcgacagggcgagcggaagcggaggagcgtggcggcgcgggggaggggctttagggggggggggggtgtggggtggagcacgcggcggcagtttcaggttttttggaggatttgtgttggcggccgcgcgcgcgtggaatggatgaatgggaaacggggagcggagggcggggttccttggcgggagccgcgtcgcccaaaaaaattttcgggaccgtttcacacgggggatttggaaatcgggactcgggaggatttttggttaaaaacggtaggagttttttttttttttggaaggggttgatgagcggggttttgttttcgtttacatccaaattggtcaggttttgctccgtttgacgaattgcttctaaaattggtccaaattcgaacgttgtcgtttcctttttttgctggccttttccagctaggcattgcgttggtcacttgtttccaggttttctcttggttcaaacgtcagcttttggctgggttttgttgcctcatagctgtagtgagtcacgccattgtgtgtcatgtgtgttcttttgaaccaagcgtttaaagtatttttagtggaaaaactaatatatatgaagttctgtaagtgtaaatattagttatatcaaaatattagctatatcgatatcaggccatctcttgtgaagattataaatctacatattagagacaataatcgtactataaccacataagtcaagctatggtgtttgggggaaaaatgatagaagaggagtgcttgtgaaagctgagttctacacctaacttttctgtgttggtggtataaatcttttttgaaaggggttgatgagcaggattttgttatcattttacatccgaaatggtaaaaatgtatttccatttcgggaattgcttttaagtttatccctgatttgagcgttgcttttttttccttttttattggagttatccaactaggcgtgactttgggtatgattggttggcaacaaaacataattccacttatgtcttgttcaagcgtcagctttggttgggttttgtatttttgatgccttatggctgcggtgagtatgccccgctcatcatgtgttcttttggactaagtactctaaactttagagtattttggtagaataatagttaatatatatgaagcgatgacgtgttacaaatattagatatcatgctatctcgtgtgggaaatagaaatatagtcattggagacaacaatcgaactatatcaccagaaatcccttcaacataacataggtcatcaaaggaatctcaaatgactcaccaaagcacgaaagtcaatcagaaaattgatacctgataagtcgaaccttgtgtaaattatctaatctactaatctaattctttagcctagcatgatcaccctatgcgaaagatagaggtaaaactttatgtgtaccttgagaagccattagcacgatgttcatgatttgctcggtgatgaccgatgtggaagaagaggttgaagcccctcaagccgctccggtgtttgtcggtgtagacaaagtagtcgtagtagcagcacataccaaatcgccggcttgatcccgaaggggtcgccggtgatgggatgtgacgtgacagcgttccttcggcctccacttgcatcgaccaaggttggacacacgttcccccctctagcacttgttcagatcgggattagggtttagtgtggcagcaagatagagatcttcacctcgttttttgtctggcctccccttttattttggtatcgagggaattgggggcagctccaaaaggaaaggatatggcaccaccgatcgtagtgtgtagttaaggaagattttaacacgaatttaatcgcggtgattgcgcatagacaacggatggaaatggtctttggcacgatctcctcccgatttccaaatcgagacatcaaaattcctaacaccatgttgtctggcagaaaacatctcacatcttagtttgaaccaagaggttaaaaaagtatgctagtaagactaactatttagggagtagaaatacttgtatccaatggtatatctaggatttagtgtataggtggtccgactaaaataaattgtaaacaccacaattatagcaatgctaatatatacaatattcaagtgtaaataatatagaataaaccaaaaggacaccatgatatattagtaaggtgaattcacgtgatgtgtttgtgatgtcgtcaccacatctcgtgggtaaacagcgaacccggacctcacctcgacttcacagggggatggcacgaagttgtggcaacttcgttcagagagaatgtgttgtcgcggcctgcaagctctcatccgcatgggttcatgtcctatccgagcaaactcgtggcattacagtattttagtacaataccgtcgattatctggatcaacaatattatttatattgttatgtgttggatctacataacgatagcgacacataaaccttgaggtaatactctaatctagttgtgtatcagtatatgggattatcttgtgcctaagggtttgtgtatgatgaacatggcgccattatgatgtgttgtatctatcgtctggagtcaccccaatctcgggactctgccccctcttatgtaagatgataggaaggattaaaaagaaggttatctagtcggttgcaactaaattctcctattctatatctagaagggcttattcactttgctaccattttcaaccttatcttttttttggcaaagttaaaaaaaagtggttgcatttagtttgttgccaaattttagtacgtacatatgaaatcttgctaaaatttaacaaccttgccaaaattttggcaacattaccaaaatttgacaataccaaaacttggtaaggttgaaaatagtagcaaagtgaacaagcccgaagatattcggaatcatcgagatgtagtatcccagtatttgctagaataaggcttgctatgagatatccggggtaccgtgtacactttgtgtcccagaaaaaactcaatcctagatatgaatatgaacatacgtgcgttcaggttcgtacctaagattggtttttttgggaccgagggagtaccccacaaatacttcatttaaacttgtttaaaaactgaatacaaatccatgttctgatgaaatctcgcaatatatgattggaaaatcgttttaaaatggaaaaaaagaaagcctaatgggccggcccgttaactggcagcgacactacttggcaacgagccacgaccacctcccgcggcttgagcggttgagcccaaatcaactgcattggcgaaaaagaattccccaatttgccgcgatagtcaagcgacgacgacgtgctgaggcgatggatgtggcgtcgtcgctgcctgacgacgtgctcgcggccgtcctccgccgcctcccgccgcgtggcctcgcgcagcgtcccgctgcgcctgcaaggagtggcgccgcgctcgtcgtcgactcccgccgcctcctgcgcgcggacctcctcccgctctcgctgggcggcatcctcctcaactgccacgactcgcggttcacacccagttcctctcccgccccaccacgggcgccgccgtctcctgccgcctcgactacaccgtgccgccgccgccgccgccatgccccccatctaatacgtcaagggccactgcaacggcctcctcctctcctacctccaggcatggggaaaacgagtacctggtgttcgaccccacacttacgcccaactatgagttgttcatagtgcccgatcatgttccttacaagctgcgcgaggaagaagaatgcgaggaatgcgaatggccgccgtggacatatattgatcctacctgtgttttcatccaagactggttcttgggaggagaggaaatttgctctggaaggggaggctgcagggatgttaccaggtcaaatccattttgtgatcatcagtgtggatactggcgaagagcactttatatatgctgctcctattgatttgtcatgaggtagatacgtactaactctccaccccttaattaattaagcatgcattgtgattcagatcatgttattctgttcttttgttgaagaatatcattgtcggacaatacgtatcgagtgattagaacgcccacggaagatccaggagatggtcaattttatctaggaaaatcaagcaaggggatatactgtgcattattaccatcatttctgaggccccaacttcaggtttggtttcctgaatgaacggtgtggtcagaccgagtgggtgttgaagcatgacatggacatttcccacatcctactgaatctgaactatgatgaacaacaacgtgatggaccttgggccttacaacattattattcactcttataattataagcctttttattatgatgatgatgattactatgtggaagacgagccaatagtggaagagaaatttgagaaattcgggtgggactctgacagtgataatgttcttgaacctggaagtaggcgcaactgcgcaaggattgctatgtctatttccttgcatttcatccttacaaagatatgggccttgtttagttctcaatttttttcccaaaaacatcacatcgaatatttggacatatgcatagagcattaaacatagataaaaagaaaaattaattgcacagtttacatggaaattgcgagacgaatcttttaagcctaattagtccatgattagccataagtgctacagtaacccatatgtgctaatgatggattaattaggcttaataaattcgtctcgcggtttctaagcgagttatgaaattattttttttcatttgtgtccgaaaaccccttctaatatctggttaaacgtctgatgtgacagttaaaaattttcttttcgcgaactagacagggctatgattttctttggtgataaatttgacagagtgctagcctataattggagtagctcaaagcttctggatttgggcaatgtttttacaaaaatttttattcatcatgctccatacatgcacaacgacaaactggtacgatcatctctcccatacactccctgctggttgggggagctcccagaaaaactaaatttgtaagttcagctagaagattagaatgctcttgttccaaactattttaagattaattactcttgtctattcttttgatatttgtggtacacagattgttccctgaaaaataaaattcatatctcttcactttaaatttccttattttccctgctattgcgtgtacgattgatcttgagttgctgcatcgaccatggctgaaagagctagttgcttttctatctcggctgcaatgattcagatactcaacctggagggctcttgaggaatgcacattcttccggtgagagttgagctagacaacagagatttggcctggtagtgtcgtgctgaagtctatgtttgcaagctcattggcttgtgattgtgtactaactagtaaggtagaaataatggtcagtatacctgtgaagagtccatggttcccctggtttgacatgtatgctgatttgtaagggtcatacctagcaattttaggccccaattcataacctttctactatgtacacgcaagtcatctactaatttgtaatttataatgtttaacatataaaaatcggtcttgtcgtgccattttagtcttagtttgcatgtaccagacaagttcatgcaccaaaacgagcattttacaagtttatacactacattgcacgtaactaacaagtttatgtaccgctaatgcaatttactctttcttttgtgataaaagttggacttgtaccaaccatgtttgagatagaacgatagttggcccgataaacaaactatctagaagagatgtgtgctcggcagaattatgtgccacactatttaatccatatgaacgtgaattttaacggccatggaatatccacgcatgacatttaagcagataacatgtaccttgtaggaatttaatagtattgtgttatgcattcaagaacaagaatcatttgatccctgagttgtcttgtgttatgcattcaagaacaagaatcatgtgatccctgagttgtctgctctcgattttggcaatgactaatgttctcttattggagggggtccccaacttctacgagttgttgtcggcggcaaaaatccacctagaaagcactaacaattctggtcaactacaagaagagcagttccatccctagacaagaaatcaagaatgcattgaccacattcatcatgatgcttggttggatgtgtgcataggggtgaaagcacaataaatttttaccggtggcatgcatatatattatatttatactaacttacaggataaatttataactcgtatatattaaattataaagtcaagtgaattctggtatacgtgagatgtaaattttgagggggccaaggccccctctacttacatattaaatccaacactactagcttatgaagttgcacattcacgcgactttaaccatcctaaagtgtgctactgataataagtttgaaaataagttatatgttttaagaaacatatttgtcttacatacatttcggaataagttacaaaaataattgtgactattacctagctctttacgtgaaacgttataacgtgtcatatatataatagttatgtatgctaaaacttaatgggataaataaagctataaattaaatttaaacttgttttaagatatagcgtagaattttgtcttgaaaatagacttgtgcgagttttcttcttaattgcataattacatggttcaatcacaaatgatgatgggggagacaataatgaaatgtactgagaaatcaaactatgaaagttgtttattgtagatatgtgagaatatatgggttttatgcaaacattttcattgatcagcttctggttccttccacatatccttgatcgtgcggttgtgatccatttcattaattttgtttgcttttcaatcagatgcccattatgtaccacatgctgtggctcttccagctttcatgatcagattgtcttttcacttggtaagatttgtgcagataccattaccacatgttaccacatgtgatgtgaccgcgtagtataaacaggaggtaggcaaagttggtaaggttccctgtatcgatcttaccatcaaatcctatcttactataaagttataactcattaactcctaaagcttaacattgaaagatactacatcatctttcactaacaatcattaaatttaaacataatacaaacatgctatattatctataattttataatttattaaattttagagctttaaaaatgcaagcatgttaaatcatcatcccacctaattcacataatatttcaatatatatctttattattttttataatatgctatgtacctatatagttcgtcctcacttaattaatattatttttatcttctctcattaagccatatcacatcaattgtttttagtgctcaaacaattaatctatggtctaaattatctctcttattttcttctcttattaatccataccatctcaattatttttagccttaagatgattaatctacggtccaaaccatctcaatacttttcttctttcataaagtcatatcaccttacttttacgtttgaatcatcattgtatatattttgtaaatttaaattatcataaaccacgttaacttatataatcttatgttgtctagctatcttacatattatttttacttattattattatactaaactcccgcagcaacgcgcggggtcttacctagttaaatgaagaatcatctcctaagctttgctcatccacgacaaactatggaaatctataattgaggtgccatagataagccaaaatatggggggtccaaagatgaaaagcctagacaaagctgttgaaacatctacattattcttagtaggaaagaatactcagtctcttaaaccatccatcccaaaatataactaccttgaaattcaaagtttatcttgaatataggtacatagaaggtgacttttaccacattactcctctcatgccaccatgagccctatcacccctattagccctcaaaatccacacctcccacatactatctttgatcgccatcacctcaccatggattaatgaggtgtactttggttctttcatcccaatacttaatttttaacatagtactatattatagttatattttgagattgatgaagcactaaattctcttacctgctgaaaagagccaatgctagctaggcattgactaagttgtgtgctagcaagctgatctaggagctgactaattaaataaattataaaatcatttcttattactattgcttacctagtcgcatattatggttgatctgtatatattgccacctgcttatttcagggcattgatttgtacagctcagatgtagtttgctctgttcttgctagttcacgtatccatgtagctgaatctcagcgcttagttcatctgagtgacgattttggtgccggtttgacgtcgtacaggcatagcctagtgttgcaattaacgggtttaccatttttatcagagtatggaagcggttaatcagaaatttagcatggctgctgttgaaacatttcggccgaatgtgcgagcagggaataagctggcaagtgcttagcacaattattccgatgaatatctaacattttttttataaaaagaataggtagatcgaaatagtatatgatgcgtacgcatatactacctccatcccaaaatgtttgacgccgttgatttttttaaaaatgtttgaccgtttgtcttattcaaaaaaattaagtaattgttaattcttttctatcatttgatttattgttaaatatacttttatgtatacatatagttttacacatatcacaaaagtttttgaataaaacaaatggtcaaacatgtttaaaaaagtcaacggtgtcaaacatttagggaaggagggagtacaaaactgaaaaagaggtcttattcaacacataatacatatgtcatgtattgtaccatcaatactatataatattacacttgtcaaaaacctatttggctataaaaaaatgtcacattttaaatacacaacctttactaggtcctcctcttgtaggtgctgaaaggtccagccaaagtgtgcagttggatttcaatgtagatgcccatgcacaaattttacttacgcttcgtgcttcttttcttgtgagttgtgactgacatgcttcaattttacattaccaagcactattcacatcacgcacacataattaagcacgataagtaaacaaataacatcaatgtataatgattttgaaatatgcatgtgaatatttgaaaacagaagtaatatgcaaaagttcatgggctaaatgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacgcgcgcgctcgctcgcctcgcctggcaggcggcgcgcgtgcacgacgtacgcatcgaatggtccgaaaaattggctcctcacccttgcgcagatgcagcctctttttgcagttttgttttgctgcaaattcggattcgtttttgttttggaaacgttccgaaaaatccggtgcgtgcaaatggcgtggagtccggataagttacgcgcgacttatccggttcggttacgcgcaatagagatcgtgcgggcgccctgatcaagcgacccttctctatataaaccgacccagttttgttttgctgcaaattcggattcgtttttgttttggaaacgttccgaaaaatccggtgcgtgcaaatggcgtggagtccggataagttacgcgcgacttatccggttcggttacgcgcaatagagatcgtgcgggcgccctgatcaagcgacccttctctatataaaccgacccgccgtcttcacgcagtatatacgcaaaatcaatctagggtttgcctcctactctgtactgcgccgtcgctcgtagactactccatcccgctcgccggcgtgcaccagcgatcgggagagcaggtctccggaacctctgcctttgacatcctgcaccgggagaaggcggcaataaggtttttgggaagcgcttcgcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacactaaaaacagcactgcttccgatgtcttccatacatactccggcctggtttagttcacgaaaaaaaaaattaggtgtcacattgaacgtttgactggatgttggaagagcttttcagacacgaatgaaaaaactagtttcataactcgcctagaaaccacaagacgaatttattaagcctaattaatccttcataagcacatgtgggttactgtagcacttatggctaatcatggactaattagactcaaaagattcgtctcgcgaatttcatataaactatgcaattagttttttattttatatatatttaatgctctatgcatgtgcccaaaaattcgatgtgacgtttttgggatgttaatttaatcctccatgcatccttttgtttagttcccaattttttttttcaaaaatgtcacatgttatattatcattgatgttgataaatttacaaagcaacgttgataattttttttagaaagcaatgttaattttataaagctgatgttgattaggatgtgacgtgcatatgactatgtataagacatgtaatatttataaatttgatatgtactttatccatcatcatggaagtgatgaatttcatatatttctaactcttatatcattgctcggtttttttttatcattttctaccatcactatatcccattctatttttattgaagaggtgtttatctaatagcaaccttctcagatatatgtttacatagttatcctgatgagcccctaaatcaataagattagccatgttgtttcctttttgccttcctctgcacgcattagacaaattcatgcaccaaaacgagtattttacaagttcgtgtacaagattgcacccatttaacaaattcgtgtatcggcgatgcaatttactccaaaagaaattaagatcaaaacaagattatatattgagtgtgaagctctcttacatgtttttttggtccgcattaacacatctctattcaaagttttagcacaacaaaatcctaccaataaattaacctccatatcacaccaggctaaccaatgactctttgtagctatactaatccttggtgactgtcaacctggtcggaagaagaggaatgcttcatcccaacctcgcatgccaccgaggtcgtagagccacggtttcccaaaccgccgggaccaaggttaccgtgccccggcggtaagtacggttattgtgtggtaaccgcggtaaccgtgacaaaccgtatgaaaccatgtaaaatttatcaaaattttaaattatttttaaaatttatttaaatttaaggaggttactgcggttttttttaccgtactctgcggtaaacccggtaaccgcgcagttaccggcggttttgtaaaccctaggtagagctgagctgaaagaatgggagtccatggtcatcatcatctgggtggtcaaggcttcggcgtcaacaacagcaaaggacataaaagcaatgtttgtggaggtgctccacctaaggaaatgcgaggcagtgatctccaacaccacccaaaatctttcctaataaagtttgagcaccggcggcgccatgctgaggcgctcaagaaggggttcccaagcgccgtgggcttgagcttcattcttttcaagtggcacaagagcgtcctcagcatcgccttgatgttttgcgtccatctctaccttgacggtgttccgcatcatgcctgaaaggctgactgtagcgcgcacatgtgtattgaagaacatcgagatgagcttcattcattcgtccaacacacgctggatcaatattcgagcgtggactagcaacccaaactctgggtgtgtttggtgcacgttaaaattgaaagtttgattgaaattgaaacaatgtgacgaaaatattaaaaatttgtgcgtagaaacgttttaatatgatgaaaaagttaaaaatttaaagaaaaagttaggaactaaaccagtcctctatccccaaacgtgtgtggataatcttcactagcagcaggcgtggcaatgtgctccacactgactgtgacggtgtccgagagaggccgcaggagcgttcgcagcacgcagtgaagtactgcatgtacgtgcacttggaggagatctatggctacgcctcgggcacagtgaccctggacgataaaccagttgtcacccccagcaaagcgtcgacttccaccacggcacctcggcgtgacagttgacagtgagccaacgccagagcgggccttcaagcgggaagggaacaattacagtgctggcatgggtgagggatttggtccaacgacctatgtttcacgggaatagagtgttatggagggatttttaaaagttccatataagttataatgtaattatactacgattatactatatttacatctaaattttttagagaaaatttgttaacaaatgttacatcgaaacatgcattgaggacttaggctgtgtttgagttagcaaattagggtgtgacaaacttagggtgtgtttggttgagctgtgacttttgaaaagtggccgtaggctgtgacttttcgaaaagcagctgtggaatatgggctatatcttttgaaaaagctcgttaggttcaacagttgtgacttttgaaataactagttccgcttacaagcgggccccacatgtcatacgcacattggaaaaaagggaaaaagaggggtaaaaagagggaaaaaaaagaggagaaagacatagagatggccatcgacacgccggcagcggcgggtagccanacgcgcgcggcgaagtcggtgtgaagtcgccgccgtcctctcctccgtgcgccccaaccctgggcaagccggcgctgggcggggacgagcaggggcggcaccgtacaggcggcggccagccagtcggaggggcaccactgctgcgcaccgcatgtgaaggtcgcaagaaggggacgggaggaaagaaatcgaaccgttttctcataaccaatggcagatgggtaattttttcccttaaaagccactggaagcaaggtaggaggtgcttttagtttgtactataacaaaagtagcttttgggtagaagcagctagcttgagccctgcaaaagcaggttcaaaagcccaaccaaagacacccttaatcacatcgaaacaggccttgaggtcttaggttgtgttcgagttagcagattgggtgagaagatctctcgttttacacgtgcacgtttatcaaactgtacgtttttttaaaacatatatataagttgctttcaaaaatcatattaatacaatttttgagtttaaaataatcaacacataattaatcgtgcgctaatagctcgcctcattttgtatattttatcaatattctcttttccctttctctccaacactcccttaggagctaaccaagaacatgcaacctgaattctaacgggaagtgaaattactataccataatcaagcataatcgctgggagcaaaatcacggcagcaagcatatgtgatgatggcaatcaatcaagccagtcgtcggcgatcacggccaaaagagagaccgagaaaagcacgcgcgctcgcgcgtacgtacgtgggtcctgtccagatggacgtgatggcggccgcgcgcgtgcggtgtcatattgggaggaagaaaaaacaaaattctaatacatttatactcttaaggccgtcaggatttttaacctttttgttgtggctaaaatataatgaatttaagggtaacactttacccataattgtaatactaaattcctaatgcacgttagctaaaagaaagttacaaagagtgattgtttggagcatataaattcctaatgtttaattataaattttagagtaaaaatatttaaatcatgacggcaatcatgaaaagtccaaactacaataataatcacgcttgccgagttatttttagtatgaaattatttcgggggggatgtgaactcttttgcttttggggtaaacttctggtattttttgatttggtgcatggattccttacatatatttaaactgatagggttgccaccttgggctggtagcgtattctgttgaggaagccctgtttgccccgagaaccctgcccgcgggggagaan

SEQ ID NO: 6407 - DNA, 38658 bp, Oryza sativa
  unsure (1)..(38658): unsure at all n locations
accacctgggtagctagttgaatttcttttctttcaattctaaatattgttttctgggtctgcccggtcactgcttgtacttaagtgaaaaaaggctaatcgtgcctaagagccccaaggccctggggagtctttgaggccagaggcaacctatctcaatggtgactaaagaggctaagacactcccaaaaggaccaaggctcaagctctctcctctgattccatccacaaattcccccaatgccctggggggcccccaaagtaaaaactccttgggtccttgaaggagtggggcctggggaagtgagatctaaccatatcgtgatctccagcaactcctgacctcccattctttctcttccttttatgtcctttatggcattccttccgtctttttcctattccttaagcgtattcatctctttccccccccccccccccctacagccgccgaggcaggcgagccggattgcccgcccgtcaactgcgcccccgcacgtagtagcgtacggtgtgtgcgctttcccctcccctcgtgtgttcgccctggccgggccccgtacgcacgctagctcgatcgatcgacaacaacctcgactcaagttggggggtggaactgaagcagacgacacaacaaccgcggatgggcaaggaaaaacgccccaaaatactagtactccaaagcgactagtcgtaaatcgtcaccgagtcccgccattttcaaaccgagcattgccggagaaacaagtccgatgacgaccttgggggcacactgttcggaccatccggtcgcgcagggccgtttttcgcccgcacgggtccaattgccaaaatatatactatcgcgttcgagttcgatatgttagtaacatgtatattggggcacttgtagtttatgttctatatttgtaattgaggccacgattgcatagatgttatgctctgccacataggtgtgaatatattacggatcgggatcctctaactttacacaatgaagtgtacagtgccatgattttggggtaattcttagcccgtctgatttacgacgaacaaatgagattgattgctatagtactccatccgtcccattttaagtgcaaccataagttttagcgctcaactttgatcgtccgtcttatttgaaaaaattttataattaatatttttgttgttatgagatgataaaacatgaatagtactctactcgtgacttatgttttaattttttttaaaaaaaattttaaaataagatgggcagtcaaagttgggcgggaaaaactatggctgcacttaaaatggaacggagtgagtaattaactacaaataattggttttactgtagcaacatgctcattttaccgtgggcctctgccttcagcagccggatccttatattgctgcctcttataatatagtaaagtcgagaatgctctaagccgggcgaccggcgcggggggagccggatcgggcgctcccccacgcgcccctccccccacgcactgcatgtaggctctaggccccaccgcgtctctgctcctatctgccattgtaacaaatcacccacatattttggaacctctctattaagggaatttggtttattttttgttccaccaaaaatatttcacctagtgtactcacaatgtttcactatgtatagatataatgctgcagtgaactgaaatattcattgcaacaaaaaacccacatattttggaaacccccttttaatggaatttattttatttttttccaccaaaaaatgtttcactatgtatggatcaaatgttgcagtgaactgaaacattctttcactaattgctgaaacattgtttttatataaggtgaaacaacactcgatttaaacgagtgaaatattttcgatttatgaaacaattccgatatacctagtggaacatcgtgcaacatttaaaaataattcaataataagctaaaaaaaattccgtcggaatatatccatgtgtggtcttgttttaaagatttaattgcaacgaatttaatggtctcaccgcgcagacctccagaacagtgcaggaactggtattggatgcgattatggaggagttttgggcattgccgagcggcaagattattgtgcccccttctgattggagcagtagcttgatggcgccccgtagctttgcggcacacaatgccagtgagttttaagctacttgctgggtcgagctaaggttgtttatatcccctaattgttggctgcatgtgcttgaggcagcacaataaccccgttgtcatcatgtaatctgacttttttttcttatcttaaccttaataaaaacagtcggcgttcttctggcagctggggaaaaaaagaaaaataggggatctatgatctaaaataggggatctatgatcttgttaggcacaactccatatcttagatctatagtaaatttaaagtttgtatgttgaattatagttgtttaaaatttaatccaaaatagaaatagaaatctaaatatatagatttgtggagctaaaaatacttataactataagaaattttgaattgggaactgcacaaaagaagatctatgttaatagctagaattcgattcaaacgaacaaaatccatcttaaatttataataattaaaacttaattaatcatatatattcactttcttattttccgtgtcttaacttcatctccatctttattaaaaagagcatcacttaaattttgctcgtgatcaagtccacgatgagacgagtcaaatgaatccagccaattagggcatgtacttgtcacgcctagaaattcacgaaccagaatttctaagctgaatgtatattaaacctctgtccaggaccagccagggtacacaaacgacaattgttgacatacagatccacgtcttacaaaaatataaaagattacaaatgcagcggaaaagataaaagcgagctaaaccggaaagcttgacttcagcagcaaggcgactccattccacaggcaatccttgacggcagcgacggaaccaacctctctgagacggctccaactgagaagaacttcaactctggtgtgggggaaaagagcaagactgagtactacccactgtactcagcaagtcgtaccggaagaggaggtatgatgcaggatatatccaagggggctaaaggttcttttgcataaagctagcatttaaaagcagaagttgaaagcagtaaaacagtagtagcaattaagcagtattaaccaatcactgtccaacgctacaccacgttgcaacaggcccaaccaaccacctgaactacaccagttcattaagctaaactaggggtgagactaatcacggtgaatctggtcgaccgcccataaccgcgggcacggctattcgaatagttttactctgatcagaggtgtacaactgtacccacaagacacagtcccatgacacgttcccgtgcgccgacatgccaccacgacataccggaaagaggccgtgacaggacccttcgcataaccctctctaaccgatcgcaccacaccttagggttcgcccccgtccccaacaggcaacgggcagcccccctttcgtgccacggtgaatccggaagccgatcaaccggacaccccggccgacccaactccatcatgcccaccctcgcctgggtacatcggctagagaaaagctacactacaagcccaaccgttgcccacgctggcttgtggtaagtacgataagttcttccagggcatcccgtgaaccgctccttaatcgccatggacacgactagcaaaaccatgcacccacagcccaccatgtagtgtattttaattaaccaacaccattgcggtggcactaatccaaagctattgccaataatcaaagtctatgctttaatgtgatccccttttgtgcactagttgaactaagcatggctaagcatctcctaaaccaacatctagtcattttaatacccaagttattaatggcgtaagggaaacaacatatagctgagtaataggacccatcccacatgatattgtaaaacaatgcaatatttaatagaaatgcgggacatttgtaaattgggtacaatatgatcaattgtaatgtatgacttgccttgctctcgcactgatggaaccacagcaacgtcttcgagaaaccgcgaatcgacgaaacgggcgaaatctacgcgacaaacaaagcacacaagcaaaacatgctataagactactgaaacaggaaacaaaacaatttttaatggattctatacatttttatgaatttactgagacttgaatggacttaatcggagttcggatgaattagttatgtttttagaagattatctgtgtttttactaataaagaaaaagccttaatgtatttattgcgcaataattcatcccagggctgacgtcagcaaggggtggggcggcgccgacatgcgggccccactggtcagcggctcaaggaggagggaggggtactggcaggcggggcccaccgggcggcggctcatgggggaaggaggaaggcagcctggctcggctcggcttcaagccggccggccggttatggcgagggcggcggcggcaagcggccaccgacggcggcggccggcgacgcgggcgacggtgcatcgcggcgacgcgcatgtggggagcggcggcacgcgcgggaggaagagaaggggagggagttctcaccggggttcggccggcgcgggaggagacgacggcaaacggcgacggtgagcgaccggagggcgacggcgaacggcggccgagctccaggacaccctaagagaggaagtgtgagaggttagagggagagagggtgtccatgacgagcgagagccatggccgacagcggcagctatggtggtactcaccggcgcgcggggagaagcgggccccgacggcgggattggatggggatgcggcggccggggtagctttggcggcggcgaagctaatggcggcggcggattggctcggcggcggctccagcggcggcgagcggcggccggaggagtggaaaaggcggtggcggcgggtgtagcagcgcgggagcgatagagggcacgggagggagcggtggaaagaggaaaaggtggaggggagtggagggatggtttatatgggctcgggaggggcggacgaggccgggaaggtggccgatttggccggcgacgtgggggaagtggaggaggagagagagagtgggggaaaggagcaaatcccccgccgtttgcgggcgcgcgagctagcgggaggtgtggagaaggtgagcggcgacgtgggcgtgcggcacgggcggagtgggcgcgggaagcggggaaaccgacggcggtaggcggcggtttcgactgcgggaggtggaagaaggggccgacaggtgggccctacctatcggtgacccggaggggttagggaggagggaggagtcggcttgggccggcccagccgagggaaggccggcgcgggaggcgaatggactgggccgacggcccaagaagagagaaaaaagaggaaaaagaaaaagaaaaagaagaaaggatttttccagggatttaatattgccctttgttcattttaattggttaaaattatttccaaggctctgaaaattccactaaaaatcctgttagcatattttgacatgtagaatccatgaaaaaattccacatgtagattccgattattatttgcatttattaattagggattcatctctaggttaaaaagaacaatttcttcggacgatttattttacaaattttaaagctggcaagggaaacttcagggcatgacaacaatggagtagtggtcttaacctgccacataggataagaccatacaaaagccatgatgtttacaatgaagacaacttctaaatacattttgtgtgtctgcccctagcccctatgatatttgttattataaataactattttagatcttataacaacaaaaagaaatatatagatactcctaatctagatatgtacccaccgtcagcctctcctgtcatcttctttattttctattcctacccatcactatcctcattcccacaactggccgaccgcaatgccacctcctcctctcaacgttgtcacctcctcttcagccacagcagcgctgctcccctggcctacttcgcatccacaggtgcacttctcttccacctccagcctctcctccgcgtcttctctgcgagtggcgatggtggaagggataacatcattggactccccctcctttctttgcgagcagcgacagcggatccccatggtggcggtggattaagctgcgagctcgtcggcctcttgccattccttctctacgaacggcgatgtcagatttggccgccggcctcttccctcccccattcttgcgacggccgagggacaaccgccggcggcggatctggccacgagttcactgaatctggtcacgaactcgctggatttgcaacggcgacttcagtagcaaggagcggcgacgacctctgcgagagaagtccttggcagtggtggggagtggcgaggctaccacaacgtcggcgagtggcaacaacgactacaccaagtcctaggcctcgcctcgacctctaattttttcccatgcatatcacagggctccggtgttgctcaacgcatggtcccgagttgtggtttcgcaatcccaagctgaagcgcgtcgaggcaaccgtaacctgtatatgcacatatcatagaaccatggtccccaccgccatggatgttcggatctgacgtgaaggacattttttttttgatagatgatgtgaaggattgagagtttgagaccgctatcgacggcggtgtattgtacatggcattacgcataataaatagctccaccctccatgcctccaccatctcacccgtcgatcgcgttcggttcggacacggcggagcccacgctgccctgcccctccccgcagccgcgcgcaccgcgcatgcatcgttcgatcgctcacctagactcggtctggtctcgcagtgcgggcgcgcgggccacagcgcggccgacctagccggcaggtggcgcatccgcgcatgcgtgcacgcacacgcgacgcatcggcatcgcacgtacgccgcggccccggcatccggcgccacgggagcgcgtcgccatccgattggctgcggccacgtgacgttgcggtgctcgatcgtacagtgtggtaaagtgtgtagtacgtggtatgtgtcgggaggggaggcgccaccattaaccgtgggggcgcgcgcgagcgtacgtacgcgtggcgggggggtcgtacgtgcgtacgccgtgtgtcgggtgagtgggccgggcaagcgagacgcgccgacgagacgagacgagatgggtggagtcaaagcgtggagcaccggagtttatggctggccggatcgatcaggaatataatgcacgcactcatggatggtgccgctgtaacgtaacacgtgtccttcccgcattttgcagctcgttatatacgttcgccacgaaacgtgcgttgaatcgaaccgacgagaaatgggggcccgtagccccgtacatacagttaactcagtattattgatagagaagaaagtcgtgaaaaaagacctattcgagggatggaacacaagttacacaacccaataggcaatagcttgctcggctccctgcctgctgagctatactcgttctccgttagatgtagaaagagttgttgttaattgtatcagttagttattaaatgctattaatttacccctagccaagctaaaatctatggtggccggatccgatgacgactgatttgatttcataaattcttaatataaaagcctacacttgaatgtaaaaaagatgactcgatgctgagattactaataggttttatctaaacacctacactttgtttttttcttaaaaaaagtaaagaaagaaaatagaaaaataaaagcctacttgatattaggagcattgagaggcacctagctagtaacgtatactcactcacagttgtataaaaccgatctggcttttctgtcgatgggccagcatgtacgcatgatggtgtcttgtcttttgggaaaaaggaggcacagcagtgtcacagcacagccaggtttatgtatccatatatgcccgtgacagcgagacggctaccaaaagccccgacctaattagccacccctgatcatcagctaccggccattaactcccgttgatttttcttcgcctctcccatccatccaatgctaatttggacgttatatatgtgtcactgacagctacgcacattcatgcgtgcttagctcgcacgtacgtatagttaaaagctagtgtacgtgtgcttattttgttctctctgtgcaagaggggacaaactattattcttcgcgtttggatgtatgcatgcatagcttgaagcctaattgaacagttaattacatctcgttcgtctcaaaatataaataattttaacgtttaaaacttatttaaaatattaataatcttttcacgtagttcctttatcttaacaggccacaattatcttttctttgtccactacttatctcaaccattcgtaataatttcttatttaatttaacttctttgttacttcctccatttcagattataagattttctagcattgaccacattcatatatatactaatgaatatacacatatatgtgtgtttagattcattaatatctatataaatatagacaatgctagaaagtcttataacctgaaatggatggagtatttatattttagtagaaaggaaataattaattaattggtttgttatcctcattgggaaaaggtgctctctccttaaaataagggggaaaaaatattgtcgatccgtgcaatgtgcatgtagagacagtagtagatcgactaatgatgctggctttggatgtttgtgtaactataagataaatttaatcactagctgcatttttcgctcgtgctctttataaagtttgtaaatgcaatcaactagcgatttgctctaatcgtcagtaggttcctttcggctagccttttgtatacacaaactactaactaaatgatcgatgtttgctaaaacttctacaagtacaaaagaaaagacgaacacaaattgcggggggaatgatcattattatgcatggatttgatgatggggtgtaccagaatggttggaaacgttgcatgtgcacacgcaaaggccaaagggcagtgatgaacacgaccaatatattccgtgcgtgcgaaggatgtgtgtggcatgagtccaaagctgcataatgttgtagaggaattgtaacggaaaaaagcctattctactgttaaaatgttttaccggagtattatttaaccctctaaaatgtttttgaatttttagtaactattacacaatatactggaaacatgtaagatggaattaagcacacaactaccatgggaaattttgaaaatgactattgacatatttttttttataaaatttggacatgcttttataaagagaaaaaaagacacactcccttcagtcttatatataattcttaacgttttggacaataatacagtcttcaaaatttatctttgattatgatttgtattataatgcattacagtaagtaaaaattaattttatcgacgtattttttaagactaatgaattgtgttctactgtgcaaattaaatattttaaaagtaattgatagtcatattaatctgctttagagtattttaggtggtaaaataagctgattttttttatttgctacttactccagcaaaataattcgagtgagttaggtataccttttccttttataacaaatggacctctgtacatacagaagtatacattacgaattatcaacttgtaagtagctatcagttctccgaagcagcatctaactgaaaattggcatgatatatataatttttttcgtcaagtagaagaataaaataacaagcccatactgtgtctgccatgatgagcaccgcgtccaatcagaaaatcgaataacccactattaaatgagccacatgtaggcatacagggaaactccaagcatctaactgtatttcccgtgtcgattccctgtccacatcatttgactaaactctgattaaaaattaacacaaagcactgcactaacacagcaccgcaacttaaatcaaaacaaacgaaaaataatatctctctgtcccaaaatataaacacttttagactttggcacggtttcaagatactattttaatcaacgctatttaagatgttttaaataaaaaagttacatattgtgatagtttgtttaatgataaatctaataacattaattttatataattaatatttttttacatttttaaattaataattaaagttataaatatttgactttgcaccatgctaaaatgtttatgttttgagacatatggagtaataataataaaaaatcacaaatttaaaagacagcgtcgcgaacccgcacgcgcgagccgcacccaccgtcgccacgtgtgctccgcccattgggcggcggggccccgaccgcacgcgtgacgcgcgggcccacctgtcggtcacatggcgcgagccaactaacccgacccggcagggaatcccaccacccatcccgtccaaagccggtggggcccgcctgtcggcccgtgggccccaccccaccccggcccgcctgtcccgtgggccccaccggcctccccgaccgcgcgacatgcacacctgcgcgccaccatttaaaaccaatccccccctccctccccacttcgtcctcatctcatcttctcctccaaattcctcttccacatttcctcctcctcctcttctttctctcaagaaaatcagtagctagccatggcgtcttcttcttctctcaggagcaccagctgcctcgcctccgccgcggagaccgacgccgacaacctctgcctccgcctcggcccgccgggaagcagcatcaccaccaccaccaccaccggcggcgccgacccggcggcgaagaggtccctcggggcgaagcggtcgctggagagcacggacagcatggcctccggcaccggaacttccgccgccggcgacgagcacgacgacgacaccgccgcaccggccaagtaagctcacaaccccctgaccctgcacaaacacctgtaacaacaacaacacaaaactaaccatggctaaaattctccttggttcagggcacaggtggtaggatggccaccagtgagggcataccggaggaacaccttccatcaggccgccgccgccgccgccgcaaccaagaagggtggtgatgagaaacagaagcagcagcagcagggaggagggctgtatgtgaaggtgagcatggatggggcaccatacctgaggaaggttgatctcaagatgtgcaagggctacagggagctgagggaggcactggatctcctcttcaccaagtgcttctctgcaaccgcctctgacggatgcagcgatggccagttcgccattgcctacgaggacaaggacggtgacctcatgcttgttggagatgtgccctgggagtaagtgccatcatcatcatcatcatcatcagatattcagaatattcagatgacatgttatcagtttcttcagatctgtatctaactctaggttgctctgtttcttttgcagaatgttcatctcttcctgcaagaagttgaggatcatgaagggctctgaagccaggtgatggtctgatggatgatcaaaggagacaaatcacaggctaggacacaccacatgagaagatggatgatgaatcagagatcatgaatcacatggcatgagatgaatgggatcaagaagggagcagaggactagaagagccctgatggcttgtgctcttcgttgctgtacagagagagtttaggcactgccttgtttcagtgtttctgaatccaagagggacaagatgtatgaactgtgtatatagtcttttaattaggctcatttcttttttcagtttgagttttgtactgtatgagcgaaggctggaaaatatgaaaaaagggagaaatttgacttaagcttggtcatttctccacaccaaagattccttgtttctctgtgttcatatcataaatacagtaccaagccagtatttgtcagatcagaggtaattccttattcagatctgaataagatcaaaggcatgtcaaggctatatacctgatctgaatgaacacagacacacacaaacaatttgatcttattggtgatctaatcaaagaagtaaattaatttcagcaagatttatgccttgaagaccaatcaagtgcttaacctgcaggccattggttcaaactctgaagaagataaggcccttgcctggctgcctgcccacactgccaaccaagcagatgcagatgcacggatgaatcagcacaaactccgtggaagaattacctcgaaaaaataaataaaaactccatagaagaatccaaacgcacagaaagccacgcaatgctgccttgctgcttcctcaggggagcagttcatgccacaccatatgcagtctgcactctgcaccagcaagacaaggaaaaggacacaaaaaaaattctgtcaaaaatactcacatagtatcacagctgatgacgatgatgattattcagaggacaagatgatgcgtatgcatggctggctggtgccccaccttccaggaattctcctgcagccagaatatcacgctgcccgagccatggcctgcagctgcaacagtgaggaaatgtactgaaaataacgacagccgaccacctgccatcatatgatcagagatccagaggttaagaggagccatgtgacctgatcagcactgggggaagcaaaacgatactgtaatggtgatgttaatctctgaaagaaaaaagcatgcagggcagcagtacagatgatggcaatgtgaaggtgaaaatgtctctccatgttactggtgccgttccaaacttgcaatgcttttcttgatagagacgatctgtcattagacccacaaatgtaagtgtgaatcggacatctaggggacagcgcgataatcaatgtatggtttacaggtcatggagttatggtgtagggaactgattcctgttccgtgatgcttcctcaaaatcacaaggtccatgaactgggttcacaaggcaaagcaaattaaaatggcttgcttgttgtgttaacaataacataagttgaagggaaacaataaagttcatgttgactacaactgtttccataaaaatgaagattattttgtcccgtaaactagtactacagaaaagttaactagtcaagggatgcacaaaaacattctctcaatagcaatttcaatttcaagttaagaagaagagaatcacccaagttccaggcaatatcaattcacatatgcttacagttttggttgtgcctgcaaccattttattttccctgaaggaatcacaagttcacaacctgtaactggacatgaagaatatatcatggacagtgatggaatctgtgaagaatatcacggacagtgatggaatcggtgtttaccacctctattcgtgcacaacaaactctgcactggatgtgccaagaatggagctgttcaggaataccatgaacacaaaaatatattattcagatcaaaagtggcaaagcttcacggggatcatgtcgcccggcgttctgtgcctggatcagtcagggctgcagttccctgtgccgccggaggcggagcacgccgcgttcctcggcctgggacccgccgcgtcgccactcgccatcggcaccgacgacgctggggagagaagaagaggaggaggaggaggaccaccgtgcttgcgcgtcgcggaacgcgcggcggcgaggacaaaggagagcggtgcgagggaggctcgaggtggacgtacgcctgctctgcggagactcggcggacggcggcgccggaggttggcgagggcggttcgtgagaggaagtcgattgactctcgaggtcctctgtcattcgaatgattatgaaaataaattaactagatagattaatatataataaatcaatccatatgaacatataagttaaattttaacttttagaagatgaaaaaaaaagaaattgaactataactagttaacgtatatttatagtcaaatatgtttttttttgcaacttataaaaattgaccttgcatatttgtggagtggtttttcacatattaatctatcttattgaatttttttcaaatgtttacataaccatttagatgatatgcaaacaacgaggtgacccctcgacaatgtataatagtttcctgttcgtgagatcggagtggttcaccgacatgtgggcccatacaagttcacctctcgtcttcggtcggccaagtagatgtagattttacctggttttggtttatctttttttaaagaatatataaaaattgctttcaaatattaaataaacactatgtcagatcagcccatttgtgatgacctatctataacgaaccaaaatatcccgtcacggatgatatcatctctgatgggtaaaactaaatcctgttgtagatgaggctaagaaaatggtttgtcatggataagaactcatatatgctagatctatataagcaccaaacacataacatctctgacaagcccacatacaaacctgtcacagttgacctctttcctatgacgggtgttgagtttgcactcgtcataggtgagatacctcacctcaaacgtcttcaattcttatacatgttagtgatgatttaaaaataaagaaaaatcctcccgtcacccgttctctcttctatcttacttcaactgcctaccaccgtcgtcgaccgttgggagccgtcttccccatgcactccttcgatcgccaaccgtcatccctccccccgattgccggccgccgaggcttcgttcgcacgactccacagactaccaagcactgacaaccgcctcagcaccatcggtgttgactccctccaacggcgtcgagcttggcaatggcgaccaactactactttgacaagtttttcattgcggcttgagggtttcatcgtcaacaacaagtctcgttgatttcttgatgcgtttcgtgttgatttcgtgatgccatgcgtgtttggatgtgaatgagtgtttggatattcccagatgtgtgattgtgatgatttttgtgttttgtaaattttttagatgaatgcaactgcaatgagaaatagaatggaatatattttgtttttcttcattggtaatctgcaccattgacaagccgcattgtgctacacatcacaggtgagtcacctgtgatgggttgcaatgccaccagtcaaaggggcattgtgctacccatcacgggtgagtcaccttcacccgtgagagatgagtttagtcatccatactagttacggaccttcacccattagagatgagtttagtcatcactgaccacttatctctgagtccattagaggtgatgatctgagcctgttactgatgacttggtgatggtttgagtctgttactgatgacttaaaccagtgtagtgaaatctatttttcaggtttgcaataattaaatatcaattaatcatatgctaatggttttctcgttttacgtgtgttacttcatattcattttaaaacaccaccaaattgtagctcgatttctctttgatgccggagtgtacgagcatgttgagggtacgagtgtgttggtgtaggtggacaatacaactactagtaatttaattatataaagcctttccaactgtatggatcatccatagcctttggtacaagcaaacctgatcttacaatctttttatactatccctaagaacaaaaaaaaaaaatctttgagcgtagttgttgctcgtttcaatgctcacagcatggtcggaatgaactcaaaaagcctagcaaattttgggcagttggaagaccaaaaatttattagcatcaaacaaattttcatattgagatccattgtattctaactccaattgctaagttagggactgttaggggtggcaatttctccgacggggctagggccagggagatttctcacccgcgggtaagcggggcggggcccgcaaatttccggggttaggatgggggaactcgtgggtgaccctgcgagttcccggggtatgtgtttctcatgcccattacaataattagagcctagctaacccattccaaattgatatatatataagctctatacctaagttcccctcctccccaattactagatcgattccccagcccttaggttctcatgtcgccactataggtcatgtgcagctctacttcatttttctaaaaaaaacttttaaatactccaggttgttctattgtggacaatgccctctaattttctatccgcgaggatgggccattgttggggcacatgcccctccaattttctatccgcgaggagggggcatatgccccgttagccttccctttgctaacctatggaaatttagcaaattagactcatcatcatatgaatcgtgctcatcctgaacatgcctttgtatggaatttagttagttcacttcttaattgttatttattaaagatcactcgttattaaatcgtttggcttttaaaataagatgtcataattgatattctatatatgtgtaggcctaccatggcaaaaatcatatatcgagaagcataatagttcatcattaagagagatgcatctattttgggttcaaggtgccagttcatcattaagagagttgcatctattttggttcaaggtacatgcagtattgatgatgaaaattttgtgaattatacatatcttaaggtgaacaaagttttcataatgtatctattggtacttattctattgaattcgtatcaatatgcaacgagatctccttatatatccccttgaagattacatgttctatctgttaattaggatttttttttcaggaatagaagaccttgtgagaattatattttctttttttttggattacaagagtacatgacatagtaagacaaaaggtttaagcaaatgctcttggctactatgttacccgaatacgaggatacggatacgcgatacggcgatacggggatacggcatttttcaagaatcatggatatgtggatatgcctatatatttaataaaaaataaaatactaataaactctcttgacaaattgtgaaaaccaatgcgttcacagaaaaattaataaacttgcggactgactgctaactgctgattattcacaaaaaaaaagtgctatctcctatacttctcttgtctgccacaatccaatccagcgaggcttcttttcattattattttgcagctgccctagttcttcgagtgtaggagcactggatgccgggatacactagcttggaattcgatataaaatccatcggatgatttggatctacattgatatagcacttgtactaagaaaatagaaattggagcagcaaaaactagtgcaggtcaagcacggaaggggtcaacaactcaatcattcaatggcatctgtcgtgccctgcgtgttgtctggcgatggcgtttcgtctgctaatccggtggtggtgatgctttgcttagatgaatcactgcagcattcatcggcgtcggcggtagcagcgctacaaacctgcagcaatcatgtggggatgcgtgcctcaagcgagcacaaggaagacggctctagccctggtagccaggcggggcatgatgcacgacggtcgacggggaaggtgctatgtctggaggcggcggccctgcgcctggaaggagattcagtggtgggcatcagacgtattagtgacgtatcgggtttgttttatttatatggaaatcacaaaattgctagatacgtatcccgtatgtatcggcgcttatcggagaaggcgtatccgtatctgttcacgtatctgatactgatacgtcgcttgacagccgtatccaggtatcctagcttggctatgtaaaaaaccaaaactttatgaatgtaaataaatatatgatgcctaaacattcctaggaaaatatactttctgatcctgaaaaccctactaggatgatcgatgaacaactattggtgtattatctggtgtcgacatgttcgatgtgtggacagttggccctatgcattcatgacttcacattcttaaccccagctttatatcgagggcttgaggcaagcaactcgacgattcttgatattgatgatcaacaaccgcgattcacccatgctgattggcttggatttgcattgtttcgtgactaaggaacgtgtgtcaagtggtgttattacatgaatcaattagctcggtattacttttgattagttgctttgcctgacatgctaagaggatactaaaatgtggtctagcctttttaagttgtagatgagtgatatcaggcatctgtatggatgtgtgcgaaacaagagcgtagtgggtgagcatgagcgcgtgcatcgtagtaggagaaaataaacttaatggttaacacatcacttatgaattccaagtgtcaatcgcattccacatatgtgtgaatgaaacatttaatccaggggcgggcccaactcaattcatggatattgatatgaatacccaagatttttgattaaaaaaatgtatgtatatatatatatatatatatatatatattgtgtatgaaaaaaaagtgtcatatttagcacacaatatgtatgctatatattataccattagcactatgtgacatacatgccaaatattaggcttttggctgcaatgtttttttgccccttcgcatttcgcatatacaacctcgaaatcctgggtccactccaccctaatttgatcacatgtacttctgactttgaagggatatagcctctctctttcagcgaggaattaacaatgaagaacccaaacacgcagaaatcacacatgagactgctttttcagggggtgcaatttacgtcacactgctactaattatcccattttcctaaaatataaggttttttaagttttgtatggtgattaagaaagtagatgtaactaaatgtcatgactagtgattggttaagatgagaaattaggtggataaattaaataagagatgattgtgattgtttgatatgagggaataggtgaagaaattgctaggacatattttgatcattagaagttagaacggagggcgtacgtgatgttttgatggagccttcattaggctgtggagttttttttagaaatattaatattttaatggaaaattaaaaaatataggtcagttggctaaaaccacaagtttagtaatctgtccaacaaccattctcgaaccacgattattcgatagggctatggtctgataaaaaaagtgcatgcatgcatgagggtgccctatcgaactttgggtgttcaataggccctgcttacctacatgcaaaatcagaccatgcacaattgcacatgcatcagctttaaaaaaagaaaaattaccgtgcagatcctatcaaacaatggccgttcccttgtcaaattttgattgttcgatagggtgttaaatttctgatttcagccaaccaacctctattttttaaattttcaattaaaattttagtatgtctaaaacaattccacaaatacaacgagagattcgattttcgacactctacgaactggatttcgattatttgatatcatggcccactgtcatgggcagaagtgttaatataaccagagtggcaacaaagagagtgtcaaattattaaattttaccaaatataagtatgaatcagacatcaaggaaacagcatgataatcacatcatgtttgcatgtcatgaagttccgcagaaaggaactgattactgctcctccacacaagtcccatgaactctcacacagggaaaacaaaaataacgtgaaatattttacagtacttgagagatattgcaaatttttgtaccttctaattgagagataccagattttacggtagaaagtgaaaatatgatactgtaaaatctctcaaataatattcatgtttgtggtaaaaataacataagttagcaaggctttggtctttctttttaaggaagacgaaatcattaaagtaattgtgaagcgcaagcttttggagaagcgtacgatggagcttctctatttttaggtggaactttagaagaaggattgaagcttttttatgctttacccatgtaacgggagagtcttatgtgtgtttgtgacttttagactgtgtacaccttcacaagatgtagagggctggtttaatataatccattatcttaaaaaaaagagagagaaacaaagccaattgataaaatttaaccatgagtttagataaagtctgactaatactataaccgttactttaaactgaagattattatgagtagtaataactcatacagtaacgccgtgtttagttccaaaatatttcttcaaactttcaactttttcatcacatcaaaactttcctatatacataaacttccaacttttctgtcacatcgttccaatttcaaacaaacttctaattttggcgtcaactaaacacagcctaagaaaaataccatttcatttgaagttaagaagagaattagccaaattcctgggcagtcggcattcacatgtgctttaggttttcgttgtgccacaacctgcaactggacatgaagaatatcaagtgcagggatggaatttgtttccctcaactcactgaccaaaaatattattcgtgcacaacatactcagtatgaaatgtgctaaccttaaatactctgagcagattcaaattgagggcaaatattcagatcgaaagcaattagtttgaaattatagaagaaatccttatattgtggtcgtgcacatcattcagataactgcggtcggtaacatactcaaccagcaatgtttttttctgcaaactcttctggcagtgtaaattgggagcaccagaagatgtctcttccatttgatcgagttttttttttaaaaaaaaaattggttaagtttcaacctacacctttagagttgtttttttttcgttgcacgttgtttattattattatatttatgaaagttacagtgccctacaaatattggtttgccacaaccacaaaccaacgtttctggcgtgtttcaatgttttgaggtaatgaggaataccagcatccgtttgcgactgaattgacttttaactttctcaataattgatactccctccattccataatataaggcacaaccacttttcatagatgttccataatataagacatgcatgcaagcatgcaattaattatagcatcttcttcattaaattataacttttttaaatcctccactcttatattatctaattctattggatgcatacattatatttatgaggatgatccaaactacaagatgataataattatttcttgatctttaggttaagggtggttgtgccttatattttggaatggagggagtagaatttcttaaacagaatttcaaccgaggacaaaccttctcaggaattaactgattatggggaaacaactagttgaccatacgtgcactaagcagaaacgtctagatattatcttcctgaaatcacttgaaaagcgacgatgctaactaagctaattataccgtactgctgctgctcctgactgcgttttcaagcttgcagcaacaaaacacaaatattgggattgtgaaaggcgcctgcgccattgggacgctgtaataaggcaggtagcgcgcatctcgtccgccgcggtttttaacctttgattcttcttcctattcaaaagtttatataaatgatatttattttgttgtgacttgttttattatgaaataaactttaagcttaacttatatttttacatatttacataacttttaaataatatgagtgatggaaaattatgtgaaaagtttaacattgttatataaaaaaacgaaggtaatagttaacttgtcagtggccagtgtgccagagcatgttcatgtacaagatactactcactatgttgatgtgttttgcttcgttagggtaagactttgaccgacaattactttgtcatggtatactttttatgacataaaaattaatgttattatttcgtattcgaaactacttaggattatattttttatgattgtattttttatcacataaacaatatattaatgaaacaattgttatcttaacgaaagaaaacacaccttgtaataaaaaacaaaataagcgttataatataaagacggaggaggtagtaattttttccgtttcataattgacacttttattggtagtatattgtttttagtttgatcatccccgttttatacaaatacattataagtactaagaaaaaaaccatattaataaagtatattacactgtaaagttgtagacgtataaatcccgttcatcatcacaccacgttttaaaagataacacggtcaaactagaacaatgccagtcaaaagaacctctttgagtgaaatgccaaacggagggaagtaatttgataagctgtagaggcagcaaaaaaaccaaaaacaaacaaacaaagaaaacaatgtaccctaaagaaatgcatccatggcgccgtcacgggacacgggtcgcacaccgactcacagtcaccgcagcggccgtcgtcaccggcgtccatggcgatcgccggcgagatcgagctccgacgccggcggcgccgtcgtcgtccggcgatgtcggtagctagtagctggctggacaagcgaggaggagagatataccgtgttacctatcaacatggcacaccctgctttattatataagcatccatcgaaattaatctcggaatcgcctgcaaatcgagggtgcaaattcggcgatgttccttgtttgcgcgatcgatcgagatttgcacttaaatgtatccatcttgtggtgctaattaccatctaaagtgacggtggtggtgggtgttaaaactggaggaaatctcacggagctatgcggagcacaaactgcaaactgcagatcaatacatgtgaagtgtgatgtgatctcaagtttattttcttaacatacttctgatctgaagatttgagtggagaccatggtaacttcgtcatataatacatgcctaatctgcttcggaacaacacatgcaattttttgggtggggggaagcatcatgcttgaatcctgcaaacttgtcttcagggctggatacagaagtagggcagcctcgaaggcacttcaatattttaagaaatagaggatagcatgaaaaccttatatagattttactagttcagccttctatctacgcacagctagtctctgacatccatactactattaaaagtctctgacatccatactactattaaaagatagtggtgatggtggtggccatcaccaccacaactaacatgtgggtcatgatattagaattttggggagtcattcaaactatataacttgcaaatctttaattttctaagcatgacagttttttttgtttttttaagatgaaaggttgtgtttcaaccaatgtaaaatatatttttttcaacaaggacttaattttgctgttttcaatactcaattgaaaagcgcgagcatttggctaatagtgaaaaaggaggcatacatacatcagtatacaatttttcaaacacatctgacagtttctctggtaggattttgtaaacaaaatgcaatccctggcaattttgacagattgcgaaatatcaactttcaggcaaagctgaagggcttgaagctgttctttcgcaccgctcgtttgcatggctgtattaatccaaaagatgacgtcagggtgcgagaagcacaagctgcaagatgacgcaagcaacaagcggtagcaaccaaagctcagataccaagcgtggtatgatatgatgaacaattgaacatcatgagagctcgccaggagttacctttagggcaaacaggggatatccttttcggttccctgctgaactttaaccaatttctgcaaaaaaaaaaatcctacaaattcttttgagtttcatatctgattactgaattcaaacctttttcatgaatattataattgacattcgtagtttcactgacaaaccggtcaaccttggtcctgtaattgtcaatgtgtcatgccagctataatttccttcacattgtttatacagaacataatgaaaaagaaaaaaatatctgcacatcacattgtccatacaattcttgaaggattcagaatgtagagaaaaaaaaaagaagctttaagctgactgataggaggttcaagttcaaagcaatgccaaatcaatcaaccacctttccaggcacatctcattagtgttgtagtataacatagcaccaccactaacaacaaccattgctcaccaaattaaagcacccaatttgagcttttctacaccaaaggggggcaaaaagccgagcatgattaccaaagtatttaatacatgatattgttgtcttgttaaaacacaaagtgcatatgtcaaaaagattaatacagcaccagcacactggatcaaacaatggaatttcacatctggagtcctggaccaccagcagcactagaaccaggttatagtgttatctttctccaacataattcgaaagaagcttgcatgcgcaaatggcggcaaaatatgcaatggcaatctggaaaggtacaaaaaaggtgccagtattttcacttgtttcagacaagtagaatatacactggatacaattcttttttcaatggtaatacaagtagtacaaataattgtgccaaacaattcaggccttttgtaaagtaaggctcaaggtattaggaaaaaagaggggcaacatatttaaacaaccctttatgacctgcctatgatctatatgatctatccagcagtggaatcctgacatggtactcaacagtaagtcaataacccagaaacatccatcgacgttcaaatatccatgattggtgacaaccacagtggcaagtaaactcaaaagagaaaacctggacattccgtgtgatcaccggcaatgtacagtgcaagaacagctgtaatccacaacaaagatggcagtacaaatccttaacacatgttaagtcagcacagatgatatatatagtttcatgagtgaaccaataatacaagaggctaaaaactttaagagggcaggttcttatcaagactatgacttgcagacagaaaagtaaagcacataaggagcacgctcccactagcaaccagattaatacacgcttcgcctccattgactaaaacatccgttgccgctttggaaaaatagacaagaaatagcaccaccattcaccgtcaacatcatcttccatctgaacattcttttaaattgtgtcaaccatttgtgcagacttaacacacatacatcagcttcttttcattagtccaaacgtccactaccaaaagactgaccgaccccaccacaaagtgtatggctagtgcactacagacccaaaaggaaatgatatgagcgcatgccagactctttggtagctctacccatcactcacactcgataggggcattgaaagatgtaggagcatgagaacatcgcttaccatatctttgcaatcaaagcacctttgaagaaaagaagaaaagaggagacgacatcatataccatgggtactactttgaggagaggatccttaggccttttccagttagcaaatcaaaatgtccagtatatcctacactttggataggtcgacgcctagtagtagtaggtgtgcatgctagtgttattgttactatactatgaaggagtgttgggttcaggcttcactgagtgtccgtcctgcgaatgctgtgtgtcatagatcgccatcgcaagagagattggcatcatgcatagtgctttggattggaggaattgcattgctgctccgatgtcttcttccatcagcttcgctacctgcttttctgtgccatcggttgaccacttttcccaaatctgttgtttgctcccactgtcacttgcctccccctaatgccattcaagcaagatttagtttaaagatcaacgatattgtgtgactgacggacaagggcatgcaaacaaatgtggcacaagacaaaacatgattattcaagaaagaattactgtcatgttgtattgtagtatcatttagtagtctccagtgttaagtaatccatgctttcaagttttgttgatgacaagagtcgcatctaacaatataaatgagataggtatttccttggtagacctacaaaatatagctaaggatttgaactactcaactcattagtaaaatataaggtacttgttagtgcaagcgaaaattgtgtttattgccgacagtcagaaaaccctagcaatgtatgctgacacatataaacaaataatgtaacaaaagaaagcacaacaaaaaagaaaataagaaggcagaaagatgagaagagcaaagaaactacacaacttcagaagattgacatctagataaatataagagggcagaaagaaggtaagaagagcaaataaactacacatagcagcacattgacattagtaaaagaaatctaaacatactgatcatgtgtcatgttttatataagcgacaaatacataaaatttatcgtgactagcccacccatcttaattgaaatgagttcaacataataatctactggtgcaaaagtccataatcagaaggtcttacatctgaaaaaaagaagattaccttaactgagattggaatatcagcaaccagctgcgcaactgcaccagcaccacccagcctgctcatactcagaacctaacattatagcacaattatccatgtcaaacatatataaacattagctgttagttatggatgtgctgttataagaaatagtgacatagtacagataaaacatatatacctttacttgaagccgaagaaacttcacataatcaaggatttcgtctagcatagctgccctgtctgtctgcataatttaaaaataatacatcaatttttaacttaacttcttttgcatcagaagagtgacactctatctagatcaattgcagttttcaaataattgaaaatcacagggcacatagcagtgacccaaagggcaagtatttttgttatttcaagcagcacattaatgttgcaaatggatatatatcatctgttctgaagatatccctgttcattagctgaaagaattagaaaagcaatgaaaaaacctcagttatcaggacatgatagccctggaccactttctaaaaattccatcgatggcaggcattgaaacttgcaagtctttggcttataatgtcaataaaaaatgtgatgcatcattaccttgtttgtgttggggaccaagtcctgcagggccctcatcctttcggctattctctctctccttagctgcattgaacagatggaagttaaagaaaatacctagaagaatatggaaaataacttctagggaaaaaaataatgcagttaaaaataacatggtcctgtaaacttatagaagggaccagcaagaggttagcctttccatctttaatgactattagtaatatagtaatgaagctacaaggagtatacaccctcaaaccacaattattagataccctaaagacaatcatagcacattcgctacaaaacaaggttccaatttgatataacaatggccaaaagttggtgacttccaatacactacaacatcatggttgtagcagcgagcagcctatgatgatgcttaaaccacacaccatgcagtttcaccgcaatatctgcccaacacttggctaagaagacaaaccttgtcccttaaaacatccaattacttgcaccataatctaacttgtaatcgcaaaaattcggtggcaagctatcttcgttacaactgaaaaaggcaccgaaaataactcggttgctaccacaatcacaagcattcgttcatgaacatatatgtgcagcatggtcgaatttgctgtagcgatacggttctcgttagccagggtggtgagtttcattaatcattaccctctcagcgatactgtggggatcggtggcctgcccgcgccgcgcccgcacctttggccggggcgccggtggctgctgaggctgcggcgccgccatggccccctccccgggcttcggctgcgcgtggaacacctgcacatccatcagacaccaaatcatggtcagagagttagtattccttccaagcaaagtactgtacacgggcttgttccactcaattcagggctccgacctggggaggcggcggggcgcggaggtgcggcggctggactccggcggcggcgccgaacaccggggcgaagaggccggcgagctgcacggggtcccggtcctgcgagaacccaaattcagtcactcctaggcgcagaacgacggcgaattccgaggggggacggggcgaggtggggagagctcaccgtcctgccgccgtcgtggccgccgtcgaggaggcgcctggcggcaccggcgccctcggcgtcgaggctgagcgcgagcgggaaggggtggtggtcacccgagccgaatccgccgacgccgccggcgccggccgcggcggcggaggggatgctgaagaagtggtcgaagaagtcgtcctcggctcctcccgtcggcggctgctgccccgccatggatggacaccaaaccagaccaccacgaccaccgacctcctcgtcgtcttcgtcggcgaggcgaggcgcggcgcgagctcctggcgcggtggcgcgaggggcgagagagagagagaggagagagagagagagtgggggaggagtgaggagagaggcgttgtcttctcttctttagtagaggtcggaggagagagaaacagagatgggttgtgggccgtggaggaggagggccatatagaagatgagacaaatacccctgggggatatgcaattattcctttcaacaatggcctttatattgtcattaagagcaagtttaatagtataggccactactaactctaaatcatctatagccaatgtaatagtcaattcatacaatagttgcttactatactattaataactggtcccacatgtcatacattcattacgtcttgaagtccgtgctgtagctggctacagatctatagcccgctgctcttctctctcttcctttctctctttaaaatatgtttataactagcttatagcctactattgtacctgctctaattattggcagtatgattcttagccaggttctttccttcagctacaaactgtaaactccatcgttttatgttgctttgtaaattgctaaacatgtgttttgtctaaaaaaattctatataaaagtatctttaaaaataaataagacaatttttcatgtttatgattattaatatttaattaatcatacgttaatgagtttttttcttcacgtgcgaacaaatatcccataccaaactcagataaaaacaggcccttactactgctgctgtcttttggggatggtttttcctccctcagtctcaactctcaaataaaaaggaggaatggcttttgcaagtgcgaggttttggaatcatcaatgctgtgaaacacaactacatttgtttttgaaaagccctcgctttcttttcccccgatgacctattgattaaatcattaagcattttcttgaaaagacctaataaatacctatgtttttttttctaatctaacttttaaaaacttaaccaagtttattaaaaatattaacaacatctaccacaccaaattaattgcattaagtctaatttagtactgttggagtatggaactcaacaggggaagctaaatactcccctttgtgaatacggctagggtgcaagatccaagctcgagtgtttaatcgcatagtaaaaatgaacacgagcacacatatataggtttagattgcacagatacgtaatacctactcatatgtgatagattattgatcaatggatgaattataagttgatgtgggaagaaaaactaagtgtgttggagaaattccttgttcactgaatgtttggttaacctagcttcaatgagagtgtgaacctttttttggtgacatggaactttcttttatacgtgaaggagctcgttcacattgccattgcatgtaagcaaaagtggagaatactcctctgaacttgatatgtttagtctgatcaatgtccctcctagccggcctccggatataaaaggcacatctgttaactaaagtggagagggaagtcaaaagttttcgttccagttatctctagacccacataataaatcaacagccaaagccgacagaggtgggtcccagtgacggttgctgaggacgtgccatgtcagcatgccttctgttctctctccggttcacttgtaggagtagaagtatacatacacccctatctgcatgcatgccacgctgtcctacttctctgtgattagggtattttaggctccaggttaatgggccggccttattcgtccggcgagataggccggcttcgtgcgacgcgacccactgggccggcctcttcccccgtcgccggcccggccattgtttcaccaaccgcccgcctcagatcagtcaaaccagctgccggaagacgacgcagtgctgaccggtcgaggcagccgatcgatctcgattctcgagtctcggttgaacctggcaatacaaggccaagcaaagcttcttgcgttttgttttccctttcgttttttttttgttcttttttcgcatcggtcaaaggctacgagttaccatcaacaacaacacagctccatccatccatcggcgtctcgtctcggcgatcgatagtactcctaacacggacacaaacaagaaaagaagaagaagatttctacaagtttgacaagtactctctactctagccagcagtaggaaaggaatggggaacgtttgtagcatgatgcatgaggcaggatcagggtgaaatggacacctgcacggctgctagcacacggcgtcgtccatctcgctttctctgctctttcctcaacaccgggagagaaccggcacgtctattagttttctttttattttttcaataatactcgttttgcttttagactagagtgaagtatctactgctagtagcctatcgtacagccgtacaggcaagatactctgtaattaatattgcgtaagctacagtatattttattttactagcaaatatgcccgtgcgttgcaactggtgaaaaaacgtaatgataatatacgtttttcatgcataaccatgtcgataacaatcagaaaattagagcgtcgatggagtcagattcttttcagctttttccttttcttttatcagacaaatttttttttcgcccattttttttctcctgtttttttcggatcggactatttttttcttttttcgcccggtcgatttttttaccacgatatatataattcctttttctttggaatatgatagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttcttttttttttctccacgatacatataattcatttttctttggaataggacagttttctttttatctttttaaactctttttaccgcgtcgatgtagtcggattcgtttcggtattttttccttttttttcctttttttttgtcggacatatttgttttttttccgcccggttttttttcgccaggtttttttatcggacttttctttttttttcgctcggtttttttctcccgttttttgacggacgacagaagcacctagagaagtgttttttttcttttctccaatccaatacagatcggatctcttccagggaaatcagattttttttctccagggaatcggactctttttttttcgctttttttattcattaaacggtttgtctctcggacttttttttctctttttaagggatcgggtgtttttttgccagggacgggtgtttttttcgcccggttttttttttcactttttttttggatcggactttttttttcgtccggtttttttgatcggacaaacttggttttttctgcccggtttttttccacccggtttttttgacggacgatggaagcacctcttattttttaagtagtagtagatgataaattttactgtagaacacctgaattcatggttttatctcccaaacacgtaatacactattaaaatatggttattttgtgttggtcactatagctatgaaaatattcatttccaattgaataagagataaatagtgtgaaagatcataaatatccttagtcccacgtgccagttttcccatctccctttctccttgtctcttcggcaagccattacgacgcatatagcatcgcaagggagaaaatatgttgctgcctcgtccaccaaccttgaattcaaactctactattgcctccgcaaaactttgcctcctcgagctttgtcgtttgcaacgggacacagctcgagtagaagatggaggaagccgatctcgatagcaaggcggtgtagttgcggaggaagcgaatctcaatgctgcagcgataaagaaggtggagctcgagctcgactacgagcgatgtgatccctgatgctcactgtcgaggtggttcttttttaacttaggggtgatggatatggttatccctaagctcgaatatcctgagctagaggcatcatgatcaatgatgcgccattgacaagatccctgctaagggaggtgtctaagctagagtctactggaatcatttggacaagaagactctcgtatgcaagatgctaggttatgtgtcgtcctagaagccaatactatccgcggtgtcgtattgaggtttaacctagtgctactgtactcattgttgctgcagagtttggcaaaatacagaaaaggaccgaatgccatggagcttcttaaggagacaaaggaatatacccgtcatggcttgccgaaaagattggaagaaataaagaagagagacgagaaaattggcatatggggccatgggtattacttacttttcatacaatttttcttatggacgtggcaacaacaaatagccataatttaactattaaacgtgtttttttctcaagattgacgtttactatattggagctaaaactatataagttacgatgcgctgatgttgtaaaagatattaccatattttataggctgagattagaacatcatgtacattttaatactaaaatttacaaagtttgaccgctcttcaacttcattttaactagacaaaaaaaattcaaacgatactgtggtactacagtaatatatacctactacaaagtataccaagtaccaacacgaatagcaaactcatgtttgcttattgcattgcacgtgccacaagaacaaaagaacaatatcccccatgaggtcgactccgctgtcactgacactgtgggcccaccaggaggcgccggtccggctcggccatcccacccacaccaactcctcctcctcgtattaataccgacccaaacacaaacaccggctcacacgctcgcctcctccctctatccccgactcgaccaccaccgccgccgcgcgccatcgccgtcgaccaccaccacccatggcgttcgcgctcaaggcctcaactgcctccgccgcggcggcgtccacggcctcggcctcggcctcgtccctgtccgtggctgcggccgcgcccgggaggcgcggcggcgcggcggggagggtctcgttccgcggggtccctgctcccatggtggcgatcagggcggaggcggctgccgtcggggaggacgagcgcgtcatctccggcaccttcgccaagctcaaggagcaggggaaggtgagcgcgggggggccgttcttcgcgcgcgtttcgatttgattttgattttatgccaccaccccccctcctcgtcgattcggtgcgtggggatgcggccgattcgtcatctccgcgcgtgttgggtggggttggggatgtcgtggtgtggatctcctctccccgtttgctcgcgatggatttgattcgtcgcgattcgtgcgggggtaatcgttgaatcgttctgcggttgcatacttgcatttcagtgcggtacgattggatggatttgcatccggtgatacaggccgcggttgatggataatccttatccagttttcccatgcgtcgtgggtttaaattcgtttcgaaaaaaaaaatcgtgccgtcgcggtcaggattgatgatgcgttggaatcatctcgaggataattgaatcattgtgattagtgttggatgagcccaatcacctttcctttattatttgtgatatattactatgtagaataccaattgatatgagatgacatagttatatgtctcctaagttgtgataggcatccagatcagcattgagttcataccttgcctttccccccttctgcaatccactttatgtttgtttactctcttatatgtttgaaaactttcagaccgcattcattccattcatcactgctggtgaccctgacttggcgactacagcgaaagcgttgaagattcttgatgcttgtggttcggatctgatcgaattgggcgtgccttactctgacccattggctgatggccccgtcattcaggtataccatgaaaaacctctgctattgttctatgatgtttgatggtggttgtgagtcttggttatgagtagttttaagtttttaaccatttcattgcatcatttcaggcttctgctacacgtgcactatcaaaaggcaccacatttgaggatgttatctctatggtaaaggaggtgatacctgagctgtcctgccctgtagcgcttttcacatattataacccgattctgaagcgtggcatcgcaaacttcatgactgttgtaaaagaagccggtgtccatggtatgtcctagatattttctgttatgaatttacaaatgctattttatataaaatggcattctactcaatacacacctaatcaactagaaggggtattccatttcatatcttgtatttcaatttggactaacattaatttaggcattcagaaaattagaacttgtataacaacatagacaaatttacaccactgatatttgtagagagtgtcatcagactcccacttgtcagttgttatgtgtacattcttgcatttcaatgtatagagttatagactataaagtaaacccttttctagctgaactatggagtaaacctagaacaatatggtagtgttgaactgtttataaaggtacctatcaagtttcttatgtattactgtgttgcaggtcttgtggtacctgatgttcctctggaagagacaaatattttgaggagtgaagctgctaagaacaaccttgagctggtaggtccactctcatgctatgaaccttttaaaaaagctctaatattgttctgtcagtattgctttgctgcaaccgtgcataactgagtaatttaattttgggtacatgggtcctgagtcctgaacttccataattctgttcttttcccttcatatatacaagatgtttgtttccatgtggtactagcaagcttatgttgctgctgattaccaaagaacattgtgtcgttctgtctatgtatatgtaatttgagcccacatcattttggttatgccatttcagttaatgaatatgatttattttgcatggatgcctacaggtgctactgacaacaccaactacaccaacagaaagaatggagaaaattacaaaagcttctgaaggatttatttatcttgtgagcttctatatctttttttaacttatttacgaaatctaatgaccctgttctcatatagcatatattcctgatggccagtcagtaattttgcacctcatagacctcaacgttctaaaattaaactgaatgcttgtaatcacagtgcactgctggaaatttgttattatcaaatctcaagaatctgtttgatgatagcgaactagatttatgatggggcttgttgctaactcctatgttattcaggtaagcactgttggagttacaggtgcacgtgcaaatgtcagtggcaaggtgcaatctcttctccaggatatcaagcaggtatgcatcattcatcgtcagtgaattggtgttggcatctccaaaacatttatataacattcaaggatgctcatagaatctcttgttcttttctaggtcacggacaaagctgtggctgttgggttcggtatatcgactccagagcatgtgaagcaggtaaatcatactcaagaacttatgttcaaaacagtatacgtttaattccccccaattcattgcatgacctttgtcgcttcattccttgtaacagattgcgggatggggcgcagatggtgtgatcattgggagcgctatggtgaggcaattgggcgaagctgcttcacccgaagaaggattgaagaagctagaagagctagccaagagcctgaaggctgcattgccctgaaacaatcagttccatgaggaaagaaaatacagtccatttttttgtagtcaggtttgaagcatagtattgggagcatgacttttgctattggggttttcggggttactgttgtctgttgaaaataattaagtcattgtgttagttgcttgaacgaataaatcaaggtaagaatgatactaaatgttgcgaaaagggcctaacactgttttcgctttgtcgttggtgcaaatatcgaagagcggatataaacggagaaaataatgtcgtaattcacctatggtttacctgactgattcatgtcattctgaaacccagctatataacgatatgagcccattctgtcaatggatgaggcggcacgacattggttctgaaaatgacgttgctcttggctgtagtttgtctaataccaagtccaagtatcaatttattttcacaaatactccatcgtgtttgccattttcttttcgagattgcgtttatcattttatctgaattaccaagtcaacatgacttggctgaaactgaaatgtacattttctgaggccctgcactacagtctacaggcactttggattgttcagctgcagcccacgtatcagatgatatctcctacctctgttttatgtgcttactgtaattggatgccaattacattacttgctgaatttaataaaaatctagacaatctaagcagattataccaaccagctctgtagtcaattgaaaagtcaataacttgtcaagtaaaaccttggatttgtggcgatccctgaacttccaacaaagcaaagcaaaagtccatgctttgacatatattagtaaatctatgtgttgcaaagcaaacttctattttgcatctctgttcttcctactgttattaacgcgtggaatgacaagaaagccctcgagagaatatcataaggtttatgccaaaggttacacatgatcccaaacacatacatgaacatgacaaaaccaagatggtattgaagtacaaatataagaatatttttttccatgctagttcctactcacaacccaccacaaacctgaggaaggctgaggagttaggacaggtggtagaaagatttgatttgcacaaatctttgtcaagagaaaggaaccattggctttatcctgccttttagttcttggatagggggacatcacaggggaaaggaggaggttctcctcacactccaccacagaaggccaggagtaagcaatgatattccccttttcaaaaaacatgaagtgcaaaagagggagaatttagagatctatgtcttggctttggtcacaaaacccttatcggataagtgtcgtattctgtcctcgaaagattccaaatatgccgtatgctcgttgcgtgggtttattaaattgagtaatcaccatgattgcaagagacatattaataattattaattagggatagatatcagatatatcggttatttagatacaacatttcttgtttccttacagagtaaaaacataaatattagttttttgagtaaattcagaaaactgcacttttattgactaaactattactttgctgcaacctttgcgccacttttcagaaaactgcaacattagtgttagaaattatcacatagctgcaattttttcgggattccctgttactgacattccgggcccacatgtcatacatatatgcttcagagaggaaggatcggagcgccacgtcagcatgccacctcatggctttttttactgtagcgatgccacgtcagtgcgtgttcggaaggaaaaaatcgtggtccggttgcaccatttggctcggtcaggtgcacaggccgacagggtcaaaggcaggtccaagacctgataacgacacattactattgccctgattctcaccgtactactgcctcgattcccagcattggtgnngtnctacatagngtgccatcaaggcact

SEQ ID NO: 6408 - DNA, 8400 bp, Oryza sativa
  unsure (1)..(8400): unsure at all n locations
aggtgggtataatttactgggttagtttattttcttgaaaccaccctatcggggtccaagttctaaatttacatggggtgctcacatttccggctaattattctgtcagtggtaagtgccgtatccatcaccagcgagacatccgtggtgacttcatcatgttggactcaatcttctcaaggtgctcataggagtagnatgtgtgtgtgcatttatagatgtgagtgtgcacatattctagcgttctgtggcgacggtgggaattgggggagtagtaatgtgtcgttatcaggtcttggacctgcctttgaccctgtcggcctgtgcccttgaccgagccaaatggtgcagccggaccacaattttttccgcccgaacacgcactgacatggcatcgctacagtaaaaaaaaaagccatgaggtggcatgctgacgtgccgctccgtttctccctctctcgagcatatatgtatgacatgtgggcccggaatgtcagtaacagggaatcctgaaaaaaatgcagctatgtgataattttcaacgctaatgttgcagttttctgaaaagtgtcgcaaaggttgcagcaaagtgatagtttagtcaataaaactgcagttttctgaaatttactctagtttttttacctatctagttggttttatgtgtaactaaaccttacatcagatcaaaacaagtttataaattcaccacatatttccctcagctcacatctttctgagaacatgataaattcattacattgtgctacaccatatggggactttagaacatgttcgtcttctttttttttcttttttcttttttacattttaccctctcagtttacaaatacttgttagctttgcctggatatgtaacccaacactatgatacaaattttgtcaattctctaaaatttttcaagtttgaaacaaattaagatgtatggttgtgggtgaattaatctacattgataggaaatgcgttaaagtacatgcaaagcttatgaaattattgcaagtagtcatcatgcctcagtgagtcagtgtacatacttgtagtgcataaccaaattctttttcatatactagaaagattcaaagctgcaaatgtgcatgtgaggttgatgaatggaatacacaataatacatgacaataaacacatattaaagaatttagtgcaaaaaaattgtattgtcatggtacacattttaacaattttctttactttttatacattgtaaatattaattaatatctaaaacaaaatataaagtacgggaataaaatttaattggctaatgtggaaatggcatggagctaaatgttctatatatggtcctaacgtttaaagataaaatacatatgtgcttgtgttactaataatatctaaaagactaagtagtatgtattaaatatgctagagaacataagaaacttaaaaacttgacgtggcaaaatgggcgcttaagcgacacatattgcactttcagctgatcttattcccccttttaaatttcatgtccccattttgattatcacatggaatcaaccacattatacctatgcattcttgtgatttctgaaattaaactcgaaagcaaccaagtaaagaggagggggagaaaaagttagcagaaaacatggatgatacatgtcaataagctgctagcataaccataagtgtagggcacgtttcttaggacaatggtataaagttacaaactgaaatatcattgttaggtcagtttgatataatcagtttggattactatagacacttgtcatagtaaatagagatggatcatttcttaagtagcatcactactcttattcacgaatgtctttgctaccctttctgttatacttttcctctttttctgtagaaagccatttgtccttatattatcattgtcaaattaaggatgcgtaatctacaccctcactcaaaaactttgataagataaaaacaaataaatccatgcctttatagaaccttgtcaaaattatgctacacctgtgctaggaacaccataccatcgtagcttacttgcacgctttctgttaaccctttttcctaataaaaacgtattcgtccgtatcgttgttatcgctttgatcgtgtgggtttcactttatatccgttgaaacctctgttaacacgtccaaattatttatatcggtattatcactcaagatcgtgcgggttgttttgctttttacgtttcttgaagcttctaaagaggggacaaacctatataaataggagaggagagcaccctctcaactcagttcaaaattgaaaaaaaaaagaaaaaaaaagagaagaaaaaaaaacccatgggttgcgtagccgtagctttcccaccatttccttctctccgaagcctcctcctctccgcttcctcccgcgaaaccaaattccaaagcatttgatcgaatttctcccaaacttttccagcgttttcaatttcgccccgatttcggttcgaaaacccctcgcgaattcatttcaaactcgtccgagagcgcaatggagcacgtgttcgccgtcgacgagatccccgacccgctgtgggctccgccgccgccggtgcagccggcggcggccgccggagtagatgacgtcggcgcggtgagcggcggcgggttgctggagcggtgcccgtcggggtggaacctcgagaggtttctggaggagctcgacggcgtccctgcaccggcggcgagcccggacggcgcggcgatttaccctagcccgatgccggcggcggcggcggaggcggcggcgcgctggagtaggggctacggcgatcgtgaggcggtgggggtgatgcccatgcccgcggccgcgcttccggcggcgccggcgagcgcggcgatggaccccgtggagtacaacgcgatgctgaagcggaagctggacgaggacctcgccaccgtcgccatgtggagggtactctctctcatctcgatcgctgcttgctttgcttgcttcatggcttgtacagttgtactggtgggttcaccatttggggtggtggtgatgggatggctgtggcgtaattaagtgcaatttttagggcatttcctgtgattactgtggctagatggtcgcaatttagcatagatgtgacatatcctagctgttactatgaatctggaccggctctctgtccagattcatagtactagatgtgtcacatccctctaaatctcttatattataaggagggagtataaattaattttataagagcacgcgttgatgtcgatatccgcatcgtaagcccaggcactactcacgtgtgtgctttcttatccatactttaatattgtcagagtgggatgagacaaactttaatattgtcggggtgtggtataatatttatattatttccgtgtatagatttaggagtaatatggattaggattgcatggaggtgtagagactttatgtgacttcttggagccgtgcattgcttgagtgcaaagttaacaatttggttacatgttgcaaaaatgatgtatagatcataggtcattgcacttattttgggtggtcctaggcggtatgattcatggaatattttttggaaattctgtattttaccatatttgcattacttttcttattattgttgtttgaaggaattattaggtcacatacccttggaagatgaaattattttagtagaaaaaaagaaactgttatattggaatctggtaaatttggacctagaaattctcaccagtcgattgtagatggggaagcagagctttctttttagagatttgctccgctccaacaaaaagtacctcgaggtactggtacctcatggtaccaaatcgtttccgatcgttggatctaacaatgcacatcctgcctaattagatccaacgatcgaaaatgatttggtaccgtgaggtaccggtacctcgaggtactttttgttggaccggagaaaatatcttctttttatgttagttttctaagtggggtatataatttttgcaattggatatcatactttgaactcattatgtgggttcagtttacaaatgactacagaacatgttgatctgagcttttgctagttgatttcagtttacaatgtgaaacggttccctatataagattataatgccattagaactaattaactatgagagtgtgtgtttagctccgatagttattaagtccctttgcattctgacttcaatttttggcatgtccatccatccacaggcctctggtgcaatacattctgagagtcctctaggcaataaaacatcactgagtatagttggttccatcctgagttcacagaagtgcattgaaggtattctattatgcatatgtgcttagttaaatcttctcagtacctatgagttatgacttatgagtaatctctaatgttgtaagcaaatctaatttttgcgtaatgtagttttcatattatatatatctgattggattttccccctatttcgacacattcaggtaacgggatactagtgcagaccaagttaagtcctggcccaaatggaggatcaggcccatatgtaaatcaaaatacagatgctcatgccaagcaagctacgagtggttcctcaagggagccatcaccatcagaggatgatgatatggaaggagatgcagaggcaatgggaaatatgatccttgatgaagaagataaagtgaagaaaaggtaatatgtattcttttgcttgtgtatttttatttttcaattcaacacatacaaagagtaaacactgagcattagcattagaaattaggggacttttacatctattgatttccttttttcttagaaatagcttttaagtaatatgctttagattatcaagataatggatccttagtttctttctaggtgtttcatgtttgtactggatgtatttgattatatacaacattctcacttttttcttagaaatgcttgagctaatgcttgctaggtgtttcaatgctttatatacctgactgaattttggtaatgcttgttacaagctggtgcattaaggataattattgtttccgtgcaagcagctattcatgcaaaaaaggaaaaatgcaacgtgtatgattagaacaatttaggaggcatttgcttcttgcttttcataacatgctgggaatatcatgtcctgttgtgtctagttgctttttctacatatgaaaaattgagtttatctactgtggtcttttttttcgcagcagtcagacattcatgtcgcctttttttgtgtaataaatacagccggatatttgagatttgagcttgtgttcttgtccaatttcaggaaggaatccaaccgggagtcagctagacgctcaagaagcagaaaggcagctcgcctaaaagacctggaggagcaggttttgtgttttacactattccatttgactgcacaacaaagttttggaatatgtaagtaacaagtgtaattgttgctaaatcattgcaggtatcactattaagggttgaaaactcttctctgttgaggcgtcttgctgatgcaaatcagaagtacagtgctgctgctattgacaatagggtactaatggcagacattgaagccctaagagcaaaggtatgcaactgtttaagtgccttttagtcctctgtatgaactgaacctctctttcaaataggtatccaattatccatgtgcattgattctggtcagtattgtgcatctttcatggtgtagaaaaccggaatattctacatatcaaacatataccaaattttcttggaatgaaacgaacttctagcatttgttcttaaaatttggtacaggagatattgcaaatgttgtcctcttgctccattcgaaggattaagttgtttgccatctattataacctgcaacaattagactcacttgttttgtcttgaaacaaccgggtgtaactacttttctttttcctgcaacgtaccaggtgtaaataatcgcttgccgaatggtgataaccaattcacacaatggatcacaatcaattttaacaaagaacctgagctacactacactactgcggtgtcgtatcttatagccatatgcttctagaccacaactgaaaattcatgaaccatgcgatgtgggttagctaacatcttgacatgattgcaggtgaggatggcagaggagagtgtgaagatggttacaggggctagacaacttcaccaggccattcctgacatgcaatctcccctcaatgtcaactctgatgcttctgtgccgatccagaacaacaacccaatgaactacttctccaacgctaacaatgccggtgttaacagcttcatgcaccaggtttctccagcgttccagattgtggattctgtcgagaagattgacccaacagatccagtgcagctgcagcagcaacagatggcgagcttgcagcatcttcagaatagagcttgtggtggcggcgcaagttcgaatgaatatacagcatggggatcgtctctgatggatgcaaatgagcttgtcaacatggagcttcagtagtaggagcatatcctaacaacatgatgagagcatttggaggtgcaaatttgcaacctgcaaatgctgttttgtagtagtagttgttgtcgctgtttttgtctgaaactgtagtttctatggattttggacttgctgaggaacatctgcggctgttgttgtttcaaattgagaaaatgagggacaatgggacatggtggtctcccttaatatagcgaaaaatggttggaatatggggtattgtgtttgtctccattttgaatgtttaacttgttggctggaacgcatgttgcgaaaatagcttttaaaactgttagaatcgaatttgccaaattttacttgatagttttttttaaaaaaagttagtacgaacataagttgattggcaattgctgagcttttatgaaagcttattatacacatattttgggtccacatgtgcaaaaataatcttaaatatccctgttgatttcttagtgaagatacaagttgaaaagaaaaaaaaccgagtgcctatggcagaaatttgccataccttagttttagaatggtcagagccctgttggccctagttttagattacagtccaaaacaaatgaattttgtagcttgattttcttttggaataggtctattcatatatttgctttagttatcttcttactccctccgttttataagccgttttgattttttttatagtttgacaaaatttatataaaatataatagtatttccaaaacatattatctaaatatattcaatattagatttaataaaattaatttggtgttttagatatcgctaaatttttcaataaatttactcaaacttaaaacgtctaagtagcaaccactgaaaaaaggagagccgtgaaaaagcaactaggaaaacccttagggcctgcttgcggagcttaagattctgagaagcagctggttgatagccagcttcttagaatctagaaaaattgggttttccagcttatggcttctaattcattttctggattctacaactacaacttatcagaatctggatcaaaagctggattgtttgggggagcttctgattctttgagaagctgcagtagctagaagctccctcaaacaggccctaaagcaactaggaaagcccctaaaattaaattgaaaaacaattcataaaaaaaaggattgcccacctaaaaccggggctgggcatttggtatgtttgattgagaaaacggataatatgccactccacaagattgcaaaggataaaatgccactcaatacgttatcattagtatactttgccactttgagcagttttgagaccaaaataccctctaatgtgaagagaggaagggagaaaggagcgatggcggccgcgactcgtcgccggcgggcagcgagcgcgcgggggtgggcggcgagaaggggaggaggacggccggcggggggggggggggggggtgttatgcagccaagggtaagcccatgtactggatacagaagaatatttgagctaactctatctggctgaatgatcacatatctaatgagatgaatgaactgaacctcatcagatgccaacgcattccaaaagcgggctgcttgtgattggcatgacgctaccatatgagaaagtataatgccatttacccttgcggttgcattcacttgacttttgngacgtttccatacataccttggcatcagcgggaatgttaaccatttttaagcgtggtgcagggagaaacttataatttggcccaacttggtggcccctgaccccttgggggcctgccctaacaacactttaaagggcccaacccgttggaaagggcttttttggaaggcttgtattgggagggn

SEQ ID NO: 6409 - DNA, 26764 bp, Oryza sativa
  unsure (1)..(26764): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggacagcgccgccaatcgagggaggagggcgccgacagggggaaggaggacggcgcggccgaccaggggagggcgccgacggagggaaggagcggcgctggcgcgttgctgatgagaggaggaggacaaggcggtggcacccacgcgcgctcgccgcctctagcacttcttgcgcgcgtgcaagcgcttgctgctcacggcgtcttgatggcgtgcaaatggagcagcaagcagagccacacgcattttgaagcagagcagcaagtggagcggcaagcagagccacacgcagcaaccaacgcgacgattccggagcgagtgttgccatcttgatggtgtgcaaatggccggaccctgcctgacggcgatgagcacggccgtcgttgctcctctctccctctctctccagagtgggggcattttggtctcaaaactccccaaagtggcaaaatatactgaagataacctattgagtgacattttatcctttgcactttaataagtggaatgttatcttttgcactcctgtggagtggcatattgtacgttttctcaagttacgttgatgtccacgatgcaaatgtccgggcttctcactgccatgtgggccccacttgtctggccccgctaatcctcgttcgcccgcagctaaaccaggtgacgtcgaacccacactcaccaatcaatccgcctctccgcaaacccgcgggccgccgccgccgccaccgccgccgccgattcatcgagtgacggagagaggtgttcggagtgaggaggagagagagagagagagagagagaggggatctcttcttcttcctcgcggccggcgccggccatgtcgtcgattgggacgtcgaagggggtcctggagatcgccaagttcggggtgtacgtctccgtccccgtcgcgctcacctacctcgtcgccaccgactccaagaccctcaagaagctcatgggcctcgtaatctctctctctctctccctctcgtcttgattcccccttctcttctgttcggctctctaagatcaggattggtcgctggatgggggtgaggattttgcccccttttgattaggttttggtagcatatatcccaatcgtcccaccaccgcgtaaagtagcactatccaatttgaggattgaaattcatgctaggattttaggcgcattttggggttcgatcttaagaagagggaagaaatgagaattgcattagtagagagtggagagtggcactcgaccttgagctgaattttggcattggtggtgaccgatggcgctgcagacggaagcggagatatctacatttgagcttgaattcattcctacgccgtttcgtaagatgaagaagccattggatcctgattcttccagaatcgtgctgatgaacaatgcatatgccttgttggatggctattccctttctggtgcgggttttgtttgtagcttgttcgcgctgttgctattaagcgatttagagagctaagctttgtggtgtcaagcatgtcaactcactgaccatatttatctgccactgaaactttgctcaatttgtaggcagcaatgctaatgttgtgagggtgtgtaggcatatatctgcttatatgtggttcattcacagattatcgtgttatgatgttcttttttcctgatgaatacttacattttcttcatgtttgttgcatcacaaaattaaaagagaagatctatctgccaatcattttcatgtgacccattttatatgtttctatcactttgcttctcaatggtgatatatagaagtctgagctaatgctctgtattcttccactgcagcgtgaatacgtggtatatcctcccgaaggtccacgtccaccacctcctgaagaacttcgtgaaagggctcgcaagatagctcgaaagaggcaacaacaacaataaatacatggaccatgatcacttcggactcccgctatttgtgacgaaaccgtgagtccaagaggaagctcagaaaagtgaagaccagctgactgtttttatcaatatgtgactgtatgatcttgttgctgtaagatttgaaataaacccaacttatgtaaaatctgtaagaaacacagtagtagcttcatcaataacttcgttctgttcccctggtgattcatgaaatttagagaccggtttcttctgatggttcatgaaatttcagctgctctggcctgtacactaccagatcttctttgttattatctagtgtgccataatatacaaagaatgatctttacattgaaataaagtatggttatatttctttgttactataagcatttcgatatagaacaaagattgattatcattcatacgttagcgtttgctttgcttggtgggtcagtaagactaagagccgtgagctgagcctaaatattcccttcttggattgcaagagaagcttcttgcagcgtgtgcatagagccaacatccttttgccgtccactatccatcacacggcaaaaggatattttcatggattttcccagcgatttgcatcattcatcaccatttctagacctggattaatctgttcttgggcgactggagcttccgtaagaacctctgtacaaaggaagcaatgatcttcctattcgtttcctgacaccgaggcaacgccagtaaacagctaaaaatgatagcacaacaacaattgggatcacccatctgcacaagacaagcatcgtaacagtaaggaaggcaaaatagagattacattcatgttgtgcacttcacagagagaagaaacttgcctgtcaatatcaagaactgggttatacacaatggtttcccatgaagagacgatcatgtgccagatgggattgtagtacaacaattctgacgaccagaataatctcgtgtatgtctctaagaagatgaatatcacccatgcagcaacttcgagtaaaaagaacttgatcacaaagcgcgcaatcacaatcatgaccaaggagaacgtcaccagccaattgaatagtttgttgttgtactccttgatgaaaagagcacgagaccttgcgagcatctgtgaccatgcagagataaggttatcatcaaggagtatatcagttcaagaaagattggtgcaggaatacacaacacaagtaataaagaacatagttggacaaaaaatgagtttcaggtaaaacttacaacatatcagaacgtgctggtgtatttaccaggaaaaaaaaaagaggaaggaaggtgaataaagatgttttactttcgaattctacatatggacaatcatctctgcttttcccttttgctattcataatgggtgaaatggtacctactacatgaaaccttgactcgatttgacttctaaaaatgctcacataagtagcagagaaaaactacctactctgtcataagaactactggtcaaagttgcaacagaattgatcaatggtgataattagtatataggaacggagggagtattgaaaaacttgatgcaaaatctgatagtcaaaagtgatatgctacttttgtaactggatacacctaacaactccatgtattactgcattatccctaaattgatctgaattttaagtgggtacaaaatccatttgttctttcccatcatagaagatgtctcaagttaaaagagacggacctttgacatcctacgttcatagctttccttggcaggccccacacactccatttcaaaactctggttacagcgaagaaatccagcattaaattttgccatcgaaggaagcttcaaggattgaaggtgttccattttatcttcacactctgaaaactttgctttgcacagcttcgatgactggtactcattggcaaaaccaaagtttccgaagacctaaaaagaatacccagttaaacacattgaagatatattatccattttgcataggttgtaagcaacaaacgagttttattcctaaatggaatgcttcaaatgtaagaatctcaccagagataccctataaaatctgaaagaaaaaattcgttcgtgttcaaaacaaagcatccaagcacaaaaggcatggaaagaaatccaacttgttgctacacaaaagatgtactaccactacacaatgaactatcaaacttgatttatggctattagtaattaataatagaattttatgacagaatatgaagaatcaagtgtttcttatgtgaagaactgaagaccatagcatctcagttcgatataatgtttataacatatacttcaatccatattcatattcattacaacataaaaattgcatcaatgacgtcgttttattatctgaaaatggaagacaacattaaacacgcatgaatatttattgtcaggcaaacctttctcatctcttcatcaagcttgaggatggatcgggtagtatgatgtttaccaaaatgctgcttgtcaaagagctttctagcttcatcttctgccaaattgtgaatcagctgaagtttatccactgatactggtagacccactctttccattctttcattatacaactttaagcagcgctcaagaattgccttattgaatacttctacaagtgatcctgttgatggaatttcacctttattcaacgcctcaagtatctaaaataaaggtaagcaacttcagataacagctcacaagagtttcaagattacctgcctaagatgcataaaaaaaaacaagccaagaggtattacctgccttaggaaagatacaaactcctttccatttagagttctaccctgcaaaagttttggttttatcatggaagtaacaatttgcttcaactcatctctcctttctatatataatgggtccagttcttgatcgtccatgtcacatagctttgttctttgaagatgaggctggcaaaaaagttcataatgtaataacttagtgatgtaaagatcacagcacataatcatcaaaatgagcatatatgttaaaaggtagctcaataccaaaaattttatgaattgtgatagtaatgatgttaaatgcacaaatcacttttccctaaaaaaaacatatctcatgttttccccccaccatgatcatgttttcacaaacctggggtaagctaaaagcagtgctgttatcgcccataaatgccaaagagtctctgattcggttgacctaaaataacatgaaaaccatgtttcttcaaacaaattagtatgccatatcttccagttattagcatatagctcgaactaattgtacctcatcaatatatttgtctcctgcagcaatacacaaaagtaggttaattcaagatccccacttcaattgtttcatgaagaaagaaaggaaataaatatcatcatgataaaaaccattaatacggtaacttgaactaaccattgttgttaggcacccgttggagagcttcatcaaccatttgctggacagattttccttctgcctcatgaaagttaacaatgttaaaagaagtttaatatcctaaaaacaaaacagcaacaacaaacggtgaaatgcaaaacaatagacatttgaccaaaataaagcacgagacctgtatatttccactattgctaatatacagcacatatcaagttattaactagtccctctgtagtctgtaccgcaacataagtccgacctcacaatgtacaaacattaatacaaggcaattagaactttttatggtccgacttgtgatttattgtctattcttgttatgaaaatctaattctcatctagtattcagaacatgctgaaaggaatacttgattatcaaaataaaattgttcatatgtaacgcaaacagaaacttacggaggaaatccctctggataagccacagtagttttgctggctcaaaagcaacatcttgcccctacagagacaagcactgtaactttgacatagtggttctagtttaaataattctaacacttaaggttaagtattaccttcactctggagtcaacaaatgccgacagaaaagtggaaattttgttagaacattaaggaggcacttagtaaattgtaagctccaaataggaatggcagaaagcaaaccttccatagaattcttcagcaatttcaacagcaaatgagagtctagatatatcagcttcacgaatctatgatcaagataagtcaagttaatagctatcaaatgagagaatggaggtgagcatgtcatgagccagagaaacacaccgtctctggaagattgtagataaggatagaacttaaaacagtggccagagcaaatatcctgcaacaaaaacaaaagaactaacagtccatttttcaccatttaaaattccaattcaaacttaatatgcatttcatctataagcaacaaacctatcatcatatacatttgattttccgatgctctcaaatccctcagtgtccaggtaaaggacagaaactttggagccattcacatctaactcaatgggagtaccccagacccatataccttcaatatgtggagcagagtgttagaatccttcaattaggatatggaatcatttaggataacattacaaagttgtcattggcaccaccaaaccttttgttttggtatctcgcatatgtccaactccaaaacctgcagagccaatttatcaatccatcattccaagtatcctctttcctggagcatggtatgtatgtaaggcaggaactcattgtacctttattgcatgttagggagagaagctgattgagaagaaaagattttccagatcgatatggcccaataacctgatttgagagtcagagacatataactcagcatgcaccacgacaaagaaataaatatagtgccttggcattagttgggaaaagcaaactatcaggtatttatgtgagctacagcccatttaaacatacagcgacagcagctattggtgtttcgattcttttaattgcctccaaaccttcttttgcaagacggagtttagtgtgaccatgatctggttcgacgattggaaacctgcacaactatctttgttaaaaaaaaaagaacttccaaaaccacaataatttttctttgcagtccactgatttgataaatatgagcgttgtagcaaatgatgttttccatatgaacaagtaaatgaaacacaactactgcatgatgctagtagtaccagccatatacatgttgtactctcattcactcagcattaagtcgaagaagcagacctacgatgattctgttaagtaaccaagtctacaatctttcatcaaaacaattaagaaggtgcctttcatatggttagatcatctgagagttccaaagccggttcaactggggcacactatgctgacacgaaagcggcttcagttttttttttaggaaaataatgggaatgtgtcatcattttgtttgctattgctctaattacttcaaaattttccatcttcaagatgtgtcttccctttcttaattatccacatatgtaggtgaaacttagcaagttgacatccattaaccaacaaagtatctacccaccacgctcaattagtccggttgatgcaagtagcaacacaccggctacctactccacatctcacatgaataatccacttggtttctcatttcaaccatgcatcagcagctacctgctcccctccaatatcccacttcccacacaatcatctcaagtgcccatttccaatgtggcgttaagagataggaaaaaaaacagccgcaattcggccgtactaacttgaatttcgcagcatgacagcatcgcgtgcgacagatgaacacgaaaaatgcacaccggaatctccatgtaatctcaaccccattaagctaggcaacaacagaatgcaaccaaaagcagagtctgatgctatacgattgaaaaaaaaaacaaacaatcagaagctgcctctggtgaatcgcacttacgcgcgttcgagctcgtcctgatcaggatccagcgcagccgccgccaccacagcggcgagcatccacagcaccgccaccgccgaagcgcgactccgccaccccatccgcgcgcgctctccctcccgctcggatcctccccccaccgctccacgccgcgcgagcaatcacctccgcccgccgccaacggaacgaaacgccaccgatcacctccgcccgccgcgcacgcaccgaaatggcctcaactcctcaactcctctcgtcggcttggagtcgagggcgagatcgatcgaacgatcgaacgatcggggaggggatcgggttgatatagcggatggggatttggggattggaagcggaggagggtttcctcctccggcgagaggggttgcttggaggcgggagggaaggagacgtcgaggcgaggcgagcgaggtggtcggaggccaagaggaaggagatggcttggcttggcttctctcgttatttcgtcaatccatcgtttcaaatggaggttttcttgtttttttagtattggaaagaaaatccattttacaccttaaattgttttatattacattagttcacttaaccttctaaactattccaaccgtttcatattataatttatttgattttttttcttttagtcaaaattcttcaattttaacagagttgatagtaaaatatagcaatatttttaatataaaataaatattgtaataaaatatatttaatgctaaatttattaaaactagtttggtgtcatggatattgctaattttctctataaacttggtcgaaacctaaagaatcttgactaattaataaagtcaaataacttataatatgaaatggataaagtagtaatgtattggttttttcttattttacacctctgatggtatttctccttttcctttccccatgtataagttatattttgccataaaatttggtagaattgataaatgtgttataacttacctctcaaattttattattattgtttacatagatcggaagcaatgagactaaattaaataccgagttttaaatttcaagtaaatagtaataaatgaattttaaaaaatagtttagaactttgatagtggttgacatctatgtcactacaaaaattttagtttaaaatactactcgtataaagaaaaacaaagaagagacataatgttaagtaaaccattttagtagtattagaggtaaattgaacttaaaaaatagtttaggggttcagggtaaaatggacttatttttgtttgctttttcctgttctaatctgcgattagtgcaaattgtggaagcctgattgatgccacgtgtcagccgggcgagacatgtgtgtggaatgggctgtgggcttgaaggatatatgggccgtgggcctgatagtttggatatgttcaaagcccagtataggaccagaatctgtcttggggggtgtctagatctagggtaaagttttagcgtgtcacatcggatattttatagggtgtttgaacactattaaaaaaactaattactaaatccgtcagtaaaccacgagatgaattattaagcctaattaatccgttattagtaaatgtttactgtagcatcatattgttaaatcatatagcaattaggtttaagattgattcgtctcacaaattactcacaatctgtgcaattagttattttttagcctatatttaatactttatatatggtgtaaaattttgagatgagatataaacagatcctttgttgcgttgttctggctggccggctcggccgttgtcttggctcaattctctttctcgagtcagctcacgcatttttttaaaaaaaaatgataatgaaataacacataaattttctttactcatttgaatgtttcttgtggtggtaccacccactgacatataggcctcacaaaatgggctcgacgtatctactagtattttaaagaaactataaccacttattataaactattttttttaacataaagccgctaaaaagtcaaatatgaagcaataataagtctcagaaactttatggcagaaggactgattgacgcatatatgtcatacatctgcaattttttttataacggtataaaccgaccatttccaaatactagaacacttgcccagctgcttcaaaaggtatattctgcctcaaaaggtatattagtacatatattgcctattatcattaattcacacctagcaatctcgaaaaccataattgttgagcaaatacacgtaggccacacaagccaccaagccaaatgagttgtttgcgagttgcctcgagctcggcttgtttcaattacaagttacaaagtagagttaggatgagtttgctttgttgaaaaaagaaagctatcgaaacttagtaatgcaaaagttttgcatggtaatatatactccctccgtccctaaaaaccaatctagcactattaaatatgacacatcgtaaattcactctattataatgtgtcacatcgagttctagacttactttttttttctttttttactgagagagtatgcactgtagtcatgaccagactcgtccttaattatttttatttactcccctgatgcacattaagaaaatgggacagcgtacttgctgccagtacagcaagtacaagctgattcacatcaggcggggtaaagaatattaacagctatctgtccaaaacaggagcagttactggtactggactaggactacgggtactccgatagtgcagcagaaaagcgagtttaatggtttcacgggtactgactgaccaagtatctactcccttcatggcaaatcataaacacctgtagaagttctaattaaggttggttacaaaagataaggacaggaatgctcgtatcagcggttaattattttttaatagagacgtatccactgataacggaacacatatgatgttcggagatgctaatagagggtagtatgtatacacatataaatattagtgttaggaaaaaaatacgaaagagacgaatttttacgcggaaaacccctctaatgtaaagaggaaaaaccacggaagacaaaatcaactataatggtttaggattacatgtataagggtgacccttatatataggcacatattaaactagtgcctaggactaataatatatttgagtcattatccaacacctaggtccatattgtgttccggaaaaaaaaacataaataagagacgtttgaagttggaagtatggttagggataatatgagaaacaaattgaatgaacgatgattgatgggataggtacaaaatgaaatgcttgtatttggcacaaaattcaaatataaaagttgcttctattttactcacttcatctaacaaacactttatttctaccaattcttaaataaattagtagtgaaaagaaatgaatatggtgcccctcattaatattgtcatttctacatcgtagggtccaataaatacatataccttagtctgattggttgtataacttctaaaattaatatatttatgtcacaaattttaaatgaaactggactacaatccctcatagttttcgtgcggtttactacaataaccaccaaaccgtggggtggcgataaccccacccaaaacggttcggtgaaccctggtaatgaccaccggattatcacaggcatgtttttcaaacctataattaaatgatgcgattaaaaacgaacatcatcagaatttctaagccaactttctaatactatttaatttaccccttttttatgcccgcactcgaattgacatactccggcttgttaagaaacagttgatttggatgattgttgctagaaacagtttgaggagcgggtgaggtagatcgaggaccccgggcgtgtgtttcgcaaaccgtaaaggcgtgatcgttgcttccaaagctaacataaatttaccaagcacgatgcacacgctagctcgtcttccatggtcgaggcgcaacgcaatgcaaaacagcactacagttggtttttatttcaccgttcctcgcgttaactttttaccaccccccacacaccttggattcgccgatcaaactgcctgcctcttcttcggccaccgtaaaattttctcaacctaagagcatatacaatagccagtataaacatattttaaaaagataaaaaaaagataagagcagtgagctataaatctatagccaactgtagtacggatttcaagacgtaatgtgtgtatgataggtaggaccagctataatagtatagcaagtaattattatataaattaactattatattagttataggtgatttgaagagctagtagtgggatattttgctctaaccgcgaaatcgcaaattatgaagcatcggtcggagcacagttttttttccttttttttttaccgatgggtggtaaaaaaccgaggtgagaaaagtccacagagagagggagagagagtaaagagttggtgggggcgcagccacgcacgccatcgtcatgggacggccggcgcggctcccgagacggcacgagtgcacccgcacggctcgtctgctgcccgcacgcccgccggtggggcccacgtgggccaccgctgcctctgcccccggtgtatgacacctgggccccactcgcaaaagtaaccgtcacccgcgcgtaactgtcatggtcaaagtggaagattaaactttactccctagtaaaaaaaaccaacctgaccctttataaggatgaatttagactacctttatccagattcatcctctagaatgtttttttcaggactaatagagtactccagaacaaatatggactaggaacaagtttaataatacaatctactattagcttcaaattatctataattaatctagtaagctaatacccttagttacctataaatatatactccctccgtttttaataaatgacgccgttaactttttctcacatgtttggccattcgtcttattcaaaaattttatgcaaatgtataagatataaatcacacttaaagtattatgagtgataaaataactcataacaaaataaattataattcctaaattttttaaataagacgaataaaagatatgagaaaaagtcaacggcgttatctattaaaaaacagaggtagtactacactattaatatttagtctgctctcacatacacaaacaagctctcacatacacaaacaacatgttaaagtctattgttattagaagtctataatttgactataaatttatagctctctttttttttcacttctcgttatctttttcacatatgtatgtttatagttggtttacttgctctatctaatttgtggcaaagtggttgaaaatttggaattccaaatattttcgcagcagtggttagtgaagtataattacgctgcaggtttttttagaagtatgcatcactactagtagtactccatacttgcatattttttaatactgctcctactgcctgctctgagcctctgatgataccaagtgatatgatacactcacgctagtacaagtagtgattaagatctgattaagcaaccagataatgttgcatatctctagttcatactttcatttttcatcctcttctcaacaatagggggcctagaagctgtcacagctactgctccttgcacttcccttttgtggaaaccaaaatttgttctagaataaaaaaaagaaaaaagaaaaatggaggtgttttctgtaaatgtctttttccaaaaaatcggaaaaaaaactgagaaaacaccatgagctaagcctcggacggatcaaagcggcgatggaaaaatgaaaaaaaaaacagagaaaattggcgagggaggagagctggttaattagctagtgtagtaaagtgagttcttcgccgcggttagagcacggcggcgagcccggtcaccaccttcccctcggggcgccgcggcggcggcggcggtgaccttttcttgctcgccgcctccggctccaccgggcgccacggcgatggggacaccaccatcgtaatcttcttcgcctcgacctcgtcgtcgttgtcgttgtcgttgtcgtcgccggcggcggtggcgctgaggtttggtggggtcttggcgtcgaagcgtagctcgaactcgccggagaagctggagagcgataccggcgtgggcgggggcgaccgcggcggcggcggcggcttgtcggagcagcggaggacttgcggggagagccacttggcgcgcatgtactccggcttccgccatggcgggacgtggaggcccttcttcctcaggctctgccgcgcgggctccgccacgacggcgacgatctgcccgagccggtccggcgtcccgacgaacagcggcgggagagcttgcagcgccgcgcggtacgccttggtcgacctcgccacctcgaactccgaccggaagtccacctccaccaccagccgcgtctccgccgccaccaccgcgtcgatgtactcgtgctcgcctgcacaaggtttgcgccgcccaccgtcgccgccggtcagcgccggcgattcagcagcatcgaattgggggcgaggtttagtttacctgcggggtaggagggggtcttgtcccaccgcgacttgcacacggcggcgtcgtagccgagggcggcgaggccgtcggcgacggcgcagcggacgtcggccttcttcttgccgcccttgcggcacctctcggcgatcctcgacgcgtcggcgaggaggttcctctccgccatgctcgcgctctgcaccaagccctgcgacgacacaaagcgttgatcactccggcgagcaattggaaacaacaatcgagccggggaaaaaggccctatacctttaacgcgtccagggcgtcgccggcggcggcggcggccgaagcggcggcggtggcggaggagtcggaggggaggaagtcgaactcctcgtcgtcgctgccgtccccgccgccgttgaagcagctgccgcagcggccacgcgggggccgctccacggcggcggcggcggaatcctccatgaagctgagcaccatccggtccaaccccaccgaccccacttccatctccgctgccttctcctccttctccctcacctccccgccgccgccgacggccgcccgctccggctccgcggacacccgcacaagcagcctccggaacctcgacaccctcgccggcgccggcgccgccgcccgcggtggcctcgtctccatcgcgcacggcaaccgcaacggcatcgaccaaccgaacccctccctcccacacttccaaaccaagaatggcaggtggtgccaaccaactgatcttgccgagaagaaacaacaaagaagggcgtcctagtactccttgttcgattgccgttcgccggcggccatcgatctcgtcggggagttcgccggaaaagttcgttgggtgagacgacgacgacgaggaggaggggggacgacgaggagtttgttcgcgaggttttataaaggcgggaggggggtgacgtggcgtagtgggtggaggggacgttgacaggtgggcccggcgggtggctcacggtattgtcgccgttgtgggggaggagggggaagtggactccgtgggcgcagctgaaatgacgggcttgcccctcggtggatgtcattgtgcaggggtaggattgggatttcgcgcgctgatggaaatgtggttttcatctttggcaatatttgctacgggaccctcagaaaacgtgtaattagctgtgggactcaataaagatgtgaattggctgtaggatattataaaatagtggtaattagctactagacacttgatgcattattttattattctagtggaaacagagagagaaagagcgctggaagtaccaacatacccccgtgtcgtttgcttgtgttagagtcgcatgccatcaagaagccgccgtctggggctgtggcggtgcaggtgcatcagatgctagcccaggcgcaagcaaggcgagaggagcaagccgagcaacagccgctgcctcgggcactggctctggcggccacggcaaggagccgatggaatagcaccacttctcgtcgatgcagcacctaccgccttgcattggcgtcgccgtcctcgccggttgcggctgcatcgctgtgcgcaggcggcggcgagggcggcgagggtgcgcgcggagagcgtgacgtggcatagtgggcacgatgtgagtgtccgcgacgccattgatgccctacccacgtttgcgtacgagcctgccagcgtgatggagaaggacggtgtcagcggcgccgcattgcgtgtggtgtgcctcatcaggagtaagaggacatgaaaatagtggagatgctgacatccttggctcacatagggaaatctggtcctttttccattgttcctctctccgtttccaccggaaatgataaaataatgtctccggtgtctagtagctaattatcacgccatcgatgccctacccacgtttgcgtacgagcctgccggcgtgatggagaaggacggtgtcagcggcgccgtattgcgtgtggtgtgcctcatcaggagtaagaggacatgaaaatagtggagatgctgacatccttggctcacatagggaaatctggtcctttttccattgttcctctctccgtttccaccagaaatgataaaataatgtctccggtgtttagtagctaattatcactcttttgggatgtcctatagccaattcacatatttgcggtgtcccacaactaattacacgttttttaagtattctgtagtaaattttgccttgatcttttcgatagggttttgggctttattttttatttttattatccgccatgcctaaacatgcaagtatacattttaactatgttattattactctctatatatatagaaataagttataaactctgtggttgtacttttcaatatatttttctataataacgaaaattgtaattttaaattaaggcttttgcctttctgctatatgcggtcaaaagtcaaacccaaaaggtgaagtgagtataatttaactggttagtttattttgctgaaaccaacctagtcgggttcaagttctaaaattgacatgggtgctcacatttgcggctaattattctgtcagtggtaagtgacgtatccatcaacagcgagacatccgtggtgacttcatcatgttggactcaatcttctcaaggtgctcataggagtaggatgtgtgtgtgcatttatagatgtgagtgtgcacatattatgagcgttttcgtttgtaatgtgtttcattaaaaaaagtcaaacccaaatgaaaataaacttataaaacaaaacctttaatttaattttaaaaataaagttctaaaatttaaaattataagccacaacacaaacaagcaagcccttagggcccctttgaataacaggaatgaaaaaacagaggaatatgaaaaacataggattctgacaggaatgcaagtgtaaaacagatgattgcaaaacacaggaaaaacataggaatgactgtttgattgggtcgcaggaaaaacacaggaattcgaggagagataaagacacaaaggattctttccatgaggttctacctcatgttaaatttccttcaaaacttgcatgggaaaagacaatccataggaattccataggattccataggatctattcctttgattcaaagggctatatagtaaaaaatcatatatgaatgaaaccctctaaaattcctatgaatttccttcgagattcatagcgccttaataatcatggctttggaggcctggtaaaaaaaagtggccactgaggggttgctataaaaactggaagcctctgttatgtcatttatagcataacttaatatgaatatcaaaattagctacacagagaaaaaaacagtacaatacttttatatataaaacatcgacagttttgtaccaatcaaaataagtatattcaattttgatgatagttcctaattggtaagaaccaaacatccaacatgaaaaaaaaaaacaaaccatatgaaattattcaaaataataaaaaatgtatatatcgatgctatatagaagttagtggtcatatcaaccatcacggttgttcacgtgatactatgatattgtaataactgtcgtgttctgaaaacgctatcgctgcctattttgatatataaataagttaataactacttcatttcaaatgtacctttgaaaatcacattaacagttagaataatggttaaaaatcgcacaatcattcctcgaaaaaaagcacaatcatttcagtttaatttagtcttcctgttcctccatctcataataagtttactattagctcctgttatttatcccaaaataagtttatttttaataatcattgcattagagtttataaaaaagaaaataattatgttgggagtagataaagtgagaaatatttgcattgagatatttaataagtagggatattatagtatttgtggttttgtattggtatgtgtgggataagtgaaaaataaacttattttagaatggagatggtagtatcgtacaaccagcctcaaagtattcattgggtttattggtatcttagctctaaatattctttgagatagagctaggtttttgagatagagttaggttagacaaagttattggtgagccatcatctgattattatggaagaacataaatagtggttcgaagccactgatttgtcttttaaaaaattagctatacaaattcgtcagttttttttaaatcaaatatactataatataattaaagtgtacttatattgtagatatacgatatgtaactagtgtaaattcagctaaaaattactcatggttggttggctaacgtggcttcccaccaaggattccgggttcgacaactggatggccacaaactgaaaattagttttgagaggaaaaaatattagcagctttctagcaaaatcagtaaaataaccactgatttagcctacaaactctatacaacatattaaaaaaattgtgtgggttggagctattaaactggcagtataagtgactgtcacacgtcaaagtgtactttttttttaagaactgctcaatctgttctaaaataaactcaacttcctatcggatttgacatattatgatgaatctagacacacttatatctagatttattatactatgatgtgtcacatctggtctcaactattttgggactgagagactagttaaaattttactaactaattaaatactggacaatgacgtatatatttgacagtgataatttgatgcttacgtacacaagccaaacccactgattgatctacagttctacacaaacaaaccctcccaaaaagatacagttcatcccggcccagctggtgggctccacactgcccacctcgctttcggttggaccgggccgattcgaccaagtacacgtggcgcggcctcaggaagccacagacacggccacaagcgcatcgcggccgggatgatgccttccgtgctcagtagggatcggcgttttttctttttccaaaaggccaaaaacaaatccccccggaatgaccgtgctcatcggtagtttatgactgattataaggtagtaacagtttattactgagaaaaaaattgtgagtaaaatttttgtatatccatccatagcaacttaaaagttaaagccgaaaaaaactacgccgaaaaaaacatcaaatcaactctaaaattaagttttaaaattcgaagtttgacgttggctcctttctgattaagtttcaaaaaaaatacaagctaatatttaaaatttgatcatattgtgttgggattcaactgtttttaaacattttttataacattaggaaaaccgttatctcccattttggatcaagaacattttggtgaaccgtcctacaagcacagcgcgcaccaaagagcggtgatgacgtgctttccgggatcttctactctcgcgtgtggtgtacatgtccagatacatcgtatggttttctctgtgtagtttatgatttcatttggtacatttttttttgtcttttgatagcaacactatctcattttccttgctgggatggacagcggttggattggttgcaaggtggtctaggcttggatttatcagctacaacaccacattttgatttttcaggacatgaatgagtgaatggatagcatgatatattttagtgttttgtagaacttgtgaaatatcaatagcaacaaccttttaataccaattacagttgttcccgtgattacttgatacaagtaatggcttgttaccctagttgttttctattttgttcgatgtaaataatggcttgttaccctagttatttcctattttgttcgacgtaaataactttgtttgatgatttatacattacacatggaatctaaattaaagaatcattggttaactaaaaaaatcgcaaagagtatggtttaaacctatttgtccaaattcattttcttaatgccccttgctagttttcatgaaccatggatgcttatatatactttgacaatatggccggttttgatttttatgtttttttttccaatggaactacaagagaaaccatcgcatcattatggtcaccttgtgaatattgtttgtccctttccacttgattgttctgtctgtaaggtgtctgcttcaggtaggtgctggtgcatgcacaatacatctttcgagaaaggataggttaaatctaaattgcaccaaacaatcatttctagttctatttttttcaattgtatattttatcccttttttttctaaaaagcaactacattgttactataacgatatcatgatatgcaagcaatcacccttaattttgcatatacaattaccaacatacgaaaatttgaagcatgtagtagttgttttcatccattttctactactattactacatacttgaatatatccgagtctttgttttcttagatgatatttttttacttgacttatttgtttccatgaccgctaagaccacagagttgataattgggagaatgaggcctagctaagagtggtaatttgcacctatctgctgatacaatgatttgatatggatcattcactaataacttcttgtccctttgaaaaccggtagctagactttaggaaacccatggttttggtttgatatgctagtattacgttgtatacccaactaaccaagttagctagttttgtgtaccctttccgaagtaagactaagttttttgaacaaccgaaacaatatttcatttttcgttagcatactttctaaattggtaaacaatattttgttttttcaagaaagctatatggaagtttctttaaaaaataattttcaaatttattatagttaatacgtaattaattatgcgtaaatgatctgctctgtcttctaatttgtgaacagctcgaaggaactgcacgatattccaattgggcctaattcttggatcacacgtaagtcatatattttccttatctggatattttgcaccatttggccttcatatctggactttttgtgtttataaggttgagaagatgtttttggcacaatgttaaattttgcataactaaactaattaaaaaaatccttagtccaaaacagaactatattatgattttctcaaagagtaaagtacataatagaaggcaagaattaattgatgccctaaagatacttgactggtagctaggttcatcctgccatgatctctccatatactacattgcttattttgtgcaggtagggcgttgcttcggtacacctcttttcaaaagtctactaatttcatgtcaaggtagttaatattttttttttgagaattacacagtacaacgcagacactcacaacgcacgcgcactcacccctatgaacacacgcacgcaaaccttacccctatgagcatcttcgaagacttggccggcaaattctggagagattgacgaagtcaccacaggcgcctcgctgtcgacgggtacgtcgcctatcactgaaagcacaacgccgttaaatcctgaaaaattcgctcccatggggagtcgaacccaggacctcaggtgctactgagactcttgtaaccactaggctacaggccctttcgcgtcaaggtagttaatattaggtgagcgcaaatctggatgaagcatatgataaaattttagattgaaggttatatatagatattgatttatttttaaagctaaagcagagatttgcactcacaaaacatgcacagcaatggcttgctttaattgagattcatagactttatttttaaaataagcgtacaaagcacacgccacagtccacagtagtatgagtgatttaatttgaaccatatataatcaaacatgttaaacactaatctgtccttttcttttttactagcaaggacactagtatgcattctaaactcactaaaagtcacaaattatagagacaacaccccactcacacttctttttctcatcattattaatggataagcaaaagggataatgatttagttgtgtaactactggcttttcccttgatgatgtgtgcttaattattgtttgatgggtatatgctgcattggttaggcgatcacaacctaaaatgatttgacagaccaactgcaaaaaaatgtagtagtctcccatcaactgctggttaggtgtaagtcattgacactgtccaagtttgcccccataaaacaaagaggaaaacagggaatctctagtaacaataaaaagctagaaaaatatacatatttttttacttgaatctaaatcccaactatagtcctatcaaaatattcactatatattctattcagttttgaggaagttgagtgtttgtcccaccaatttgtttcttatatatttttcattttttttgaagtattcaaactcatcagttgtgtgcgcaactacagaggttggagatgtagatgtaaaacatttttattatcttaaaaaatagtttgaggaagtctgcatgtagagagtatatatcccccatcactgtaaactagtcttttttttgaacgacttgcacgagatggtgcaaagttctattgatagagcagaaaaaaaatacaagattacaaccttggagggtcgtaaccaggaaaaaaatatgccaccacccacacaccgacattgccaacacacaagtccaggagaagactaacaccggaccggccgccgctaagcatgaccgactgccactagactaacaaagggacacagacgagatcgccccctaggggatgccaaaacggcgtcttcaagaagagaagcgacgaaaaaactaccgccgccgtccgtcgggactcaaaggagccaagactgggctttcacccggcaatcacccttgaggggtgagacagcacgacaacgccctcaggagggggaatgaaccatcgttgtcggtccggccaaggccagactgggttttcacccgccgctcaccacctgcgaatccacggctgacgcaccgatgctccaccaccacgcaagctctgccgacatgtgggacccttgcaccggcgtcccccgccggccagccttcgtgcgccgaagaccgcaccacacccaccggctgctcctcctcacacctaggtcgcctcctccaccgccggccgcgtctctcgcgccaagccggcctcctccaccggacgcgcctcacgcgccaagctggcctccgcatcatgttaaaatatatgttaggtacttcatggaacttaattacccgataacacgaaaggtaactccctaatataattagcgtatccaaatcctccgaaaagataattccaaaatcagttttgcatgtatatgtgtcgctttccattcgtgccttgcaaatattattcagtactcatcttaatttgtaacttaaaattatagtactatacctattccaatttcctgtccatggaaaggaattgcgcgcgattaagttgactatctagttcaattcttgtggaccaatgtgtcaccattaatttgtagacagtttaattaattaatgtagtacaagtttggcatattctatgacgatctcatcttgttaataatttacaccaaatcatatatttggggagtttgtcttacacaagtacgtccattgataatggtaattaattgattgttatttatatagagatgttatcacatccattcgtgtagcaataatatttataattaatttaatatacttttttttggcaatttcacataggatattttagtttgagcatgcgtgacgcatccataactatagtttaactttatggtaattaatttaactctggtttgatagaggtgtcatctctagttctctacacatggtttgccttgtcaggttctgagtaaagacgttgtcgacaactggtttgctaatctgtcttaagaaattcagaacttttagtgtgatcctgccgtcattggcgtcatgccctggtaaaataagcccttatctgaaatgatctgcttctgcttgattgactggtttctggatatgaactaactaattaatagtaatgtctatgcacaagtggctgtatacactcatgttggattggtgtagaggctaggttttataaaatacattattaaaaaaaatgtcgatgaataaactcaacaatattggtttgtttaacttactgtgaagtataatgcgtttcatacattagatcaatgcatcatagttacagccccatcaatcggccaaaagctgattatatgccaaaacagcttattagcaataaaaaataatttctgagtaaaatttatgcatatatatgtttgtagcagtgttttgattggctttctcaaacagttatagcggactaaatgaaactatagtaggtaaattgtgcatgagaccaaacagttagacccttctcaaatagctatagctggagataaccgctactatagccgaagatttaaaaaccagatttttagcaacttaaaactaacgctaaaaaagtaactacgttaaaaataacttaaaattaactccaaaataaatttttggtggtggatgattggcaaacatcgaggctcttagattattatactccaaaaaatattgaaaggaactacttgtagtgagtaggtagaggatcataggttgcaccagcaagaaaggcagatcgatcactgtaaagatcattgtaacttaggctgacttcagtccttttccatcacatcaacctgtcatacacacacaacttttcagtcacatcatctccaatttcaaccaaaatccaaactttgagctgaactaaacacagccttataagcatgagtgtagttcttcaagtgttctaaggcctagcagtattaggatctatggatagacattctgaaaccataattttgtttttcagaacattgcaatgtgcatagcaatcaaagggaagatcaggccctacaaattgaacagcttgaaaagggaagatcacatcagctacagctgacttccaaggaaaaagaagacagtgctatactgctacctctctcatcagtcagcagcaatgttgctctcattaagattttgcaagatttagatcagtttagttaatatgaaaaatcacaacaatgaacatttttttttgttgttcaatttgatatatagtccctccgtcccaaaataagtgcagccataagtttccgtgtccaactttaatcgtccgttttatttgtttttttaaataaaaacataagtcacgtataaagtactattcatgttttataatctaataacaataaaactactaattataaaaaaatcaaataaaacggatgatcaaaattggacacataaactggttgcgcttattttgggacagagtgagtagtataaatgatctagtttcagaaggtaatgttgcattaataaaaattaagtatagaactttttcctttttatacctttccttttcatacttgcatagaaagtttttttcctagatatctattaaattacatttgcaccaccttgtaccaggtcgttcaaaaaaaaacaaagaaaattaaggtgaactttggttaatatgaatccagtatgtaccagttggtaacccaagtaattattattcaggatgtatatattgaatacttgagtggttgaagaatgcctttcatatggtcaagccctagaaaactacagtacaagtaagtgcattgtgatgattggcagataaattattacactaaccatacacatatacaaaggcaacactagacatgtagagtgatttttctctcaaataaatgcagtgtagtgatttggtagggaaatcatgaaggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnta

SEQ ID NO: 6410 - DNA, 736 bp, Oryza sativa
  unsure (1)..(736): unsure at all n locations
gtggggntntnnnaatgagctcatcntgttacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagcttctacatttaattaacaagagaactatnngtattatctaacaccttnattatctncacctttcatttgatn

SEQ ID NO: 6411 - DNA, 715 bp, Oryza sativa
  unsure (1)..(715): unsure at all n locations
atcaagaatcttcgattgatgtcgcgtggcaaactcctgctgaccgtgaagtccaaaaagtacccacatctgcgcatccagggacacatcgtgaccgaagccagctgcgaaatcttccagaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgtggagaagttgggtcccaaggtcctcgagtcgctgtatgccggcgaactgggcgttaatgtggccaccgagcatgagacgagcctgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgaggagtgccactacntagacgagttcaccntcccaa

SEQ ID NO: 6412 - DNA, 731 bp, Oryza sativa
  unsure (1)..(731): unsure at all n locations
cgggggntttgatgtgcagctgtttatcagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgccgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagacccttctgggccacagcctggacacgccgctggatattgacattgctggggatccagaatatgagcgctccaagcagcgtggcaacattctctttggtgn

SEQ ID NO: 6413 - DNA, 753 bp, Oryza sativa
  unsure (1)..(753): unsure at all n locations
natccatagtattcgctgtggggtgcgtatccgatagttggttcatggtatgcgcnaaagtacggcggcggcagaaactccgacaaagnataatgtggtgncggcagcggcggaggaaaccaatgtgagagatgatgtgttcctgtccatgccaaccatggtgatcacctctccaaccgtcacgataatgcctatggaagccatagacaccacggtgtccacttccatatatagccgtgtcccggcccagggcggccaccatggtggcctccctcgccgagacgaaggtgctcgctggagtcacctcggttctcttggccctgatgatggttgatatccgatgactaggaaatcgtgggtctatccgactacgaaggcggtggcggcgacgtggtatacgtcggagaggcgatgaacttcatcgtggatagaggtgcggcagcgtagtaggagccatctttcctagattcagaaacaaatctatctgctcagtagcaccggtgggtcttggtgtcggcgtgacatgcgacggatcagcagcattagtcgacgatgtcaatggaaatgagtctgcaaccatcagtccgaacgctgccagtagatcgatctgctccgcggcgatggcggctgcaacgacggcggcgatactttcgccaagaaacgtacgtctacccacaggtgtacaggtggctagatgggaaatctctcactcggatgatggagaactgaaccactaataggcgcatcatcccg

SEQ ID NO: 6414 - DNA, 732 bp, Oryza sativa
  unsure (1)..(732): unsure at all n locations
cgtgtaaactgagatgcagtngcacagtacnncatcagncacaattatttttgtaacttattccgaaatgtatgtaagacaaatatgtttcttaaaacatataacttattttcaaacttattatcagtagcacactttaggatggttaaagtcgcgtgaatgtgcaacttcataagctagtagtgttggatttaatatgtaagtagagggggcctttgtcccctcaaaatttacatctcacgtataccagaattacttgactttataatttaatatatacgagttataaatttatcctgtaagttagtataaatataatatatatgcatgccaccggtaaaaatttattgtgctttcacccctatgcacacattcaaccaagcatcatgatgatacaatacaccggcgtcgatagcggtctcaaactctcaatccttcacatcatctatcaaaaaaaaaatgtccttcacgtcagatccgaacatccatggcggtggggaccatggttctatgatatgtgcatatacaggttacggttgcctcgacgcgcttcagcttgggattgcgaaaccacaactcgggaccatgcgttgagcaacaccggagccctgtgatatgcatgggaaaaaattagaggtcgaggcgaggcctaggacttggtgtagtcgttggtgccactcgccgacgttgtggtagccttgccactccccaccactggcaaagacttttctc

SEQ ID NO: 6415 - DNA, 491 bp, Oryza sativa
  unsure (1)..(491): unsure at all n locations
cgtggtnnaanatgcncatctcgtatggtacagtagttcatcacgcgtgctccaccccacaccccccccccccctaaagcccctcccccgcgccgccacgctcctccgcttccgttcgccctgtcgcgccgcttgcttcgcctcgtgacaacctcgcctgcgccgccgccgccgccggcgagggggtggggggtgtggtggtgactgtgggaggcgcgtttccggtttgctccgcgggcggcgcgtcgacgcgtggcttggtaagcttgtgtggtgatgtaggatttgttaatttgttgtttttttttccttaccccgcgtgttgtagcggcgatgcttctcgatctgtgtctggttggcttcgtacgggtgattttgtggggtttgggcggagggttttggccggtgaaatcgtgctgctgctgctgctggttcgtcatgatgangtcttgcggtcaagnggnattaccctagcaatcaaagnggccgct

SEQ ID NO: 6416 - DNA, 724 bp, Oryza sativa
  unsure (1)..(724): unsure at all n locations
gatgagttgatgcctctgttggaccncatcaacatggtgggaacacctgctgaaaaaaaggattgcccacctaaaacctgggctgggcatttggtatgtttgtttgttaaaacggataatatgccactgggcaagattgcaaaagataaaatgccactcaatacgttatcattagtatactttgccactttgagcagttttgagaccaaaataccctctaatgtgaacagaggtagggagaaaggaacgatggcggccgcgactccgctcccgcgggcaccgagcgcgccgtggtggtcagccagaaagggaagaggactgccaccgggggggagtcctaaatgacaccaatagaagacacagaattggacgtcatgagttgctggagatcacgatatggctagatgtcactaccccaggcctcactccttcaaggactcggcgcggatgcattccagattgcggcgcgcctgctcctcctgcgctgtcttgcggagagacagaatgacctccagcctttgtgtcttgccatggactcatcatgagctcgctcccggtgaaaagcgcgctctcgcgaagaaggatcccgcactggcctgaggcccattaggcactattttacccttccttcaaccttagccccaaccagaagcaaggcttacccaggagaaccatgagttgaaaaatgagagagaaatattccaaccaaccaaccaaggtggcc

SEQ ID NO: 6417 - DNA, 774 bp, Oryza sativa
cgatgcttgatttgcgcgctggaacagcacatcatcaattaactggcaggactcgcatggacgatttgaaacctcaagaactaaactgagcccaaagcgaaactttatggtccatgtcagctattcacccctaaaaaaaagggactagttcacttggctgggtgtgttgatgatgacaacaggtggcgtggtttggttgtatctgaatgttgggagaagacattcagtgtggctccatggatgggttaggttggattagagctgagtaagagacaatccctcagatcatgggaaagaaaaagagatgaagacgctaaaggaataggagaaagacggaaggaatgccagaaaggacagaaaaggaagagaaagaatgggaggtcaggagttgctggagatcacgatatggttagatctcacttccccaggccccactcctccaaggacccaaggagtttttactttgggggccccccagggcattgggggaatttgtggatggaatcagaggagagagctggagccttggtcctcttgggagtgtctcaagcctctttagtcaccatggagataggttgcctctggcctcagagactcccccagggcctgaggccccttagccacgatttagcctttcttcaactcacgcccaatcccccacagggcagacccacgacaccaccgaatgacagatgcacagagagagaccccagcaagccaaccacggcggcccgacccggaatggaaactgcgaccgaccgtggatactagggg

SEQ ID NO: 6418 - DNA, 5848 bp, Oryza sativa
  unsure (1)..(5848): unsure at all n locations
cagggttttgatgaccngctggntgggacagacgttcatcattcgactntgactgctgaaatggcgatggtgatggcggcgcggtccgcggcgaagcggtcgaagaggaactcggatacctcggccgccgcgttccctcatgctggctctgccacgagccaccggcgncctcgcccacccgctctcccgccgccggcagctcccgcccgccggcccccatacctcagccgccggttacaccgccgccggctcccctcgtcctcccactgctgggccgagctcgctgtaccccgccgcgtgtgcctcccgccgctgccgctgtggtctcctccgtcttcgccgtggtggagctcagcccgggtgccgccgccgctcgcaggtcgccgcacctccgtctccgcctgctgcgggagagagagagggaacgacgaggagagagagggaactgagggaggggagagagaagggacatgtgggtcccacaatctattttctgtgtcattgacaaatgggtcccacacatattttttaattctaaatgccagctaaatgccacgtcaacaccacgtgtaaagaagacccggtcaataccgccacgtcagcgaaaccgaccttcaaaaccgctgagggagtcaaattgcaccgatttccatagtttgggggttaagatatccggttttatggtttagggttacggattaaatttcaatcacttttgagggtcaccaagtgaacttattcctaaaaaaaactgtccattttgaattttggaacaagtccacttttactcccttaaaaatgacccgaatctaatccatgatcctaaactgcaaaaccggatatcctgaccctcgaactattgaaaccggtacaatttgactcccttggtggttttggagggtggtttcgctgacgtgacattgttgacctaatctgtggggttgatgtggcgctttggtggcatttgaattaaaaacgtatacgtgggacccgtttatcattcacacataaaaattgtggggcccacatgtcagtgggccccacatgtcatcctctctctctttcttcttcctcccctcttcctttctctcggccggctgcggggagcacaggctggagcggcggcgggcgggggccggagtggtggcagccggcgggagctgaagcggtggccgccccgatcccatcgccgtgctccacctccagccaggaaggcgatgtcgtccgggagcgccaccccgaggaggatttccgactgcgccgccaccgctgttgacgccgacgacgccgttgccggaggttgcaaagcctccccaaaaccgatagcaacggcgtactggtcatggcgcttgaatgcgatagcaacagctcatgagatctctctccaccgattatcttctcctgtatgtgccgctcgtcgattagttcgtttcagagcttcagactactcacgacgacgatcgccttgccgatctgcctcctgagttccgcgtgctgaaaacgactgccattgatgttaatccattttccttggatcattgtgtgtgctactgcaaaaccgatctaattctgtgttcttgcggtagtaattgtcttgtatatataggagcatttgtgaagaccaaacaactgggcattcaggaattcagagttcagattttagtagtgttgtgatttgcagggcggcagttgcgtggcagccgacgaagccaacggctcctgtgacgaggacgaagcgatgtcggcgaggggtggtggtggctcgtgctcgtggcgaggtagaggcggtggaagttgtgaattagtgaaactgcagcttgacctatatttgagggagtccgccgcgccctaatccaagcgccatggacgaaggcggagccctcgacgcccttgaccggtcggccggcgaggaagacccacccactcccctgcatccgcatctctttctcctccctcccctttctcccccggcacggcgttcctcttgtcgcatgggcggccgcggcgcgacgggattgcgtccgctgtcgttgccgcgctactccaccgccggtcgtcgctcaccaagctcaagtcccgcttcgtcgagcccgcctgccgccgctgccgctccggtcattgccggccgccgccgctccagctcccgcccgctgtcgctacccctgcccgtctattgctccacgagagagaaggtggagagaaaagggggagagagggaggaggaagaaagagagagagaggatgacatgtgggcctcacatgtcagtggggaccacaatatatttttgtgtgaatcacagatgggtcccacatatatttttttaattgtaatgccacgtaagcgccacgtgtgacgaaaactaggtcaatatttccacgtcagcaccacatcagcaaaaccactgagggagtcaaattgcactgatttcagtagttcgggagtcatcctatcctatccggttttgcggttgagggttacatattagatttgggtcacttttaagggagtctatgtggacttattccttgaatttttgatcgcatgagcttcagttcgttgcgtgggacagtgggagtggtgggtttgttcgtttggccggcggtccatctgttcagtcaaatcccgaagtgttagtggatttaactttgaaccctattttttttattaaagcacaacgtcgttaaatcttgaaaaatccgctttcacggggagtcgaacctaggacctcagatgctactgagactcttgtaaccactaggttacaggtcctttcgcaactttgaaccctatttgaacttgatttgcagaatttggatatgaaagctttggttttaacttctctttttagagaatggtatttttttacccaacttttgcatcaaaacagatgtatgcggtctttttaaattgggaattttgtccctcaaacaacctaatctaaaattcttttatataaagatttgaactcagtatcttgaggtactacttaggtcacaaccactaaactaacttctcgcacctgcaaatttttttttcaaaatatctagctttctcaagcaattcagaaaactagaagtcaagagctttggattttttttaactttttcaaaattttaaaaactgactaccaaccacctgcatatgtagtgtagtcactccttaaaattttaaaatcaaagatgaatgggaggatcatgagaacaaggtggtcgttgaggcgtcaagctctcgtgcagccgcggaacagcaacaagaacaattcggaagagcaaacatgacctctacttgctttctctctctctctctctctctctctctggataattggagacgacaaatcacgtcgccagaaagcagcctagtacccactgaaatccagaacgacttttctcggagaaacgaagccgttcgtgcctcaacagtgctgccgaaaccgacgccatatcgatcatgcaaaagcatttctgtctcaagatccagacaaacactaccaacacatacacacacactcgcaaacgcttcatcagactttcttttgagtactgcaagtggagataaggagagaaatccgatccgtcctcctcttctccaccaaataaaatgattggcaataagcagcagcagcagtaacaatgcaaaaagagcatgtaatctattggttgcagtgatctgaatagcatcataagattctgagtttaaatcttcataggagtgaatttcagattagattgtttgcgggactaggttcctaatttataggagcgaatttcatatttggttaaacaaagttctcaatttaaatgattgtatatatccagttggatgtaaatgtcgaggaaataatacccttcttaaagaaacatacatcctggccctggtagcgacaagatctgcagaatcttgcaaatttggtggtggccattggcggatcgcagcaaaaggatgggtgcgtgcagtgtgtgcgttcgataataatagtataattaaatggatgggctaacaaatgtaatgcgtcgtaaacaatctgccgcagttggtttataggcagctgccattttgctcagcactgtccgtccttgtcctgtcctgcgagccgacgcggtggccactaaaactaactaatcaaaaaatcaaatcatgattagatgagataaggttgtgagctcatcgatctccggctgtactaaattctggggttcactatcattgccatgaatcatgcatgtcgacgcacaatctatcttgctgctggagcgaccgtccgatcttttttttttctctttctggttaggatatgtgcggcgaacttgctcctctatgtccagcgggaaaaaaaagtctgaaaaaaatatgttcaaaccatttccacaccagtatttttttttgtcttcaaatggttgtcggtgtactgtataatactccctccgtcccaaaatataacaactcttttagaatttatttcaaaatataacaatttatttaccaatattctcttcacaactagtcacaaccctccgctattcaatttttccatctacctcacttcttatctaatcacaaccctcattcatttaattctacatgctttcttaataatcgtttctaactccaaaaatacttatattatgagacgaagggagtatgagatattccatagatgtatggatgggctagtccacatatatcatacccaatatgtgtacgtagagattgacatgtggggcaataggacggtgggatccacgcatcactgtccgtaatggcagtggcattatagtagaggatcctcacccacatacgtataacgaggataggattctgaattaaaaaaaatcaactttggcaaaatcctgatgacctactcgacctcgaccaaaactatatcaaaggattccatgattatttcttcgagtataaatggcctcggaagaaggattaaggatcaaatcatcaagcctaaagcaaactgaacagatagaagagcaattcgctgacccttacaataagccatctcgctagaataaatttgaaatagaattattagaataaaaactcgaaaatgttgccctataatggaagataaatcatggcatttttaataagttataaatttgtatcacagtaaactattcacagtgtcaccttgtatttaccattggactaaaatccgatcattgtgagttgtattctaccttttcttcaactctcctccggcttttatctctcttttttttcactaataacaacaacaccaatgtccccatcattccactttcattacaatgtaaacgttagtatatgatgagaggatgtcggcatcgctagattaggattcgggatgagggttagtgtgagtgtggctatgggccggggagaggggtgttctgaagcttagagggatggtcggggaggggagtggtggttcgggcggtcggtgatgtgtggtagtcgggtggtgcagctaggtggcagcagtacatagttttggtagattagctagtcgcaggggttgagcgaaatggagtgaccatgaggcggagggaggtacctatgtattaggtgaagtgagccgccggagatgaggtaggctagatgacaccggtgagtcatggtttcatggaagttcattcgaagtaagaagatagaaaaaaaatataacatgtctcattggagaagataaaccatgtatatcatgaatttgttaggtgtcgatccaacggctcacggtagatacagggttattaaaattttagttgactgatatatagtcaatcccgtataagatctaagcatgcctgcaggtcgtgatganctacttgcagtagaacgctaatctattggcgctct

SEQ ID NO: 6419 - DNA, 1262 bp, Oryza sativa
  unsure (1)..(1262): unsure at all n locations
acgatcggtagcaggtcatcagaacatgccaacactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgccgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagacccttctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggntaccaggcttggtaagaaggagaccaanagactgtatgcccccaagccagtggcatggnctccaggggaacanaagcaanggcagaagagcaagttcccaaagcccttaagcaatggaggacaagatatgnccggcttcaaaatccctcaagtcaaactgatgagcgagcccttggacagtnccggatcacttgccctcactaccacaggagnctgantggnccgcatatatgttactcccattgcttatccagtgagccaagtacccagctccaaaaaacagtggcaggactgccctgaaaaatttggaccggggcacactccggcttgagagaatcgtaagtacggcaaaccccataccaaaggggaggcagccttnttgtacaaccaccttccaccctcaggacttttccgcgggggagggaggtattaccccccttgggcacctacacaa

SEQ ID NO: 6420 - DNA, 28041 bp, Oryza sativa
  unsure (1)..(28041): unsure at all n locations
cgggtgagaagatggagtcaggctacaaatcatgagtgcataacgacacgatcgtgagacacataacgggcggcgatncgtctactcgntaacgagttaagacgcgatagatgtgaataaacgtcgaattagaagatcatagtaaatatccatcataacactataccaacatacatcatatatatgaatgagataaaccatcaaatatggttaagcataatagaatagagatatcgagattgcaacgtccctagtaagaatatatatttaatagctagtaggacaagtagttacaccaccagcgggcgaaatagaggtgatagagagggcgaaagatattgcgaactattaagtatacataggaaacgtctcatcgctgttagtagattatgcaatgagagggagaggaagtcgcgagggaaggatactatcgattttgggatgagagagtataaaatagattgaatagcagaagaacaaaaagtgggggatagaaggaagtattaagagaagattttttaaaagaagatctgtgagagaaagacgaaatattggtttaataggccgaaaaaaagggattatgaatgtaatattaccaccggttgtaataaaagggagtaagtaggcagacggtgggtttactgctagtaaaaagagcgtgaggtgagcaaggcggataagacccaatatcgaacagaacaacttctccggatagataagagatgtacaatttaagttggtatccacggaggttttaagacggccccctagtggtacgtgtagtgatggtgcaaaaggaccggcaacctcctccccctaaaggtccaggccttgacaacaaaactctcttcgctcccggggggttgtctgtatggcaaacccacatttaaattttgtttcacggggaggaagaaaaaaggaataagatgcgtgtggggcccacatgttagtgggccccacaaatgtgtatgtgaatggcaaatgggtcccacgtataactttttaattgaaatgccacctaagcgccacgtcaacgccacgtgtaaaaaagacccggtcaataccgccacgtcagcgccacatcagcgaaaccgccctctaaaaccgccgagggagtcaaattgtaccgatttccatagtttgggggtcaagatatccggttctgtggtttagggtcacggattagattacaatcacttttgagagtcaccaagtgaacttattccttttttttaagggtgaataactaacatggtcactgaagtttcgctttgggctcagtttagttcttgaggtttcaaatcgtccaaacaagtcctccaaattaatcatttgggttaatatagtcctttgaccaaaaaaaaaaagccatgtgagcatgctaagtcatcctcgcatgcagcggtatgaacaaaatgaccattctacccttatataccatataaaaaagaaagaagataaaagaagataaatgtttcacacgtatatgatcgttttataattatcacttacgattgctgcagcgatcatgtaaattaacaatgttgggactgggctggcctgttattttttctgtttgtctttttttttctatatggtatataagggtagaatagtcattttattcataccgctacatacaaggatgacttgatatgctttcgtggctttttttttctaaggactatattaacccaaataataaatttggaggactttttttggacggtttgaaacatcaacaactaaattgagctcgaagcgaaacttcataggctattcacctttttttttattggaaaatggagtcgtacaacgtatactggtaaaaaaaaagtccaagtatatttggtcccgtcagagccccatcaatcgaaattgttcccaaaataaaacaagatcagcccaacctggtctatccgctcaagatactgagcagattcaatgagatgccaagttggaagggcaggtcaatctagaaatacagatgtggacatactgcgtagttactgatgataccatgttggtgcttagtatgtggtatatcatgtcagcgccaggatctcgaaaggattatgacagttttggaccggaatgacacactttgtcaaattatgagacctgaatagcacaagtttagagaccggccgtgcactttactctataattcaaggaacaagccatacataacaaaaaaaagtgggttcaaaaagttaaaacaaaatgatatatatctcatcaccaaaccaatcttttgaaccatatggtggaagttacgactagaattccatcgatgctatagaacaatcatgacgatagtatgattcatatctggactaaccataggcttcagggcatctaaacgaatttcaatattgtctcctaggtggtttcgattctgctactgtaactcggatctgtctgccatccatgtcctgcacaacaaagaaaataggcttgttttagcacacactaaaagaacaatgatgctgaaagacatatgagaataagaaaccagccagacttagtgaaaactcacagcgccatcaagatttgaaactgcattctcaacctcttcagcggaaccatacgtgacaaaaccaaatccccttgacctgccactctccctgtcatagatgaccttggcttccaagacctccccttccccactgaataggtttgcgagagctgcattgtcaacaccccaagaaaggttacctacatagaccctgttggcctcacccctgggtgctctctgcgatgattgctcccttggtggtggtggccctgagttaaccctcaaagatctcccatcaagtatctgttttaagaaatgaaatcagcaaattagttaagcacaattcaatgatgttgtataggatataacacaacatatgtccagcaacatgccagaaaagagtaaattaaagtttgttttctagtcatgaataagctaaaagcaaacaaggattaaaacaagcaagcaggttcatatcgagcaacctcagctacagttatcttgaaagaatgcaagccacagcatgcaaaccaaagagatgaaataggagcgcactttatgcaatatatttttagccagcccatataccaacatggagcaaaaataatgacttagaagtatggaagcatatactcacatagccattgaattgctcgacagctgcctcaacttcttcaacactagacattgtcacaaacccaaacccacgactccttccagtcagcttatcatagatgacctgcaacaatgcagtttagcatgatacaatataggaaaaatcaaccaaagccgagtactactcttaaaattgagcaattaaccagaaaaatgcaatcctaaatctttcgccagtcacagaattaatagcatgagcgccagcacaccaaatttaacaaccttaaataatggcaaccttatcgcatccttaatcatctccaaatacaacctcacaatgagcacccgaaataagtttttttttcttaaaagaacgagaatatgcccacactaccatatgcaacccaattgtatcgcggtttaagctaaattaacaacagaatgaatttgtcgtgaactgtaatatgaagcaactagacacaatcattcatcaccacttcaccagcgaccagcggtccatttctggtttcacaaagacagggacacaccagcgagcgactcgacgaaggtggtgtgataggagtacttagtaaggcgagacgaatggggtggtgacctcgaccatctcgacggagccggcctgctcgaagaggccggcgagctgggcgctgtcgacgctgaagggcaggttgccgacgaagaccctcaggtcgtcggagaactcctcgcccccggagccctcctcctcctcctcctcgtcctcctccgtctcgacctcctccgacacggccacggccaccggcacgaaggggctggtcctcctccgcggccatcccgcgacggcgagggcggggagcagcggcttggagaggaaggagagggaggatgaggcggggttggaggaggtggaggggagggggaggaggtgcggggagagggcggtggagaagagcgtggccgccatgggtgaggaggaaaggggatgggatcgatagggttttggggataaggcggagtgaggagaggagagagcacaaactgggaaagaggcaacagtagaggagaggagacgggttttatattgtttgtttatacttgtagctaatttgcccgtgcatgaccaccaaatcttaaaggataattttggcattcatttcaaagccttaagaatctacaattccggctgtcttttgccatcaatttttagatgcttactaaattagccagaccaagaaacacaaagcttatgttgtttcaggatgaaacaccaacaccaccaacagcgtgaaagcctacacgctagtaagagtggtggtgacggaagattcactggcatcaccactgcccacatttaatgtagtatagatattggcttcgtttttttgacatggatgagcaaaaaatactatctctgtttttttcgttggttaactaccgtcaaacatttggggaataagatagtatttttaatagcaggtatatatcttctacttaattttactattgcttccatcacaaggtaattttatttttcacacattccgcatataccgatacaaatataaatttgtatgggcctaggaatcagtaggtagtagctttgtatgtgtgtgtgtgtatatatatatatatatatatatatatatatatatatatatatatatatatatatatatatatatatatatgtggcaacatatcctatgcacacaggccctcacgtgtacacacgtgcacaccaactaaaaaatgtcaccaaaaaatctagaaaaaatcatacacatactttcaattgtattacacctagggttaaaatcttaaagtaaaattcattatattttagccgtaacaaaaaaaaacaaaaaatctgacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgttataaaatccattccaatcgaatattgagtaatcaaatccttcaaatcatagtttttgaaatctttttaaaagcggattaatcggacgaggataaagagagagtcccattctacatgtcaatactgacaacaatgaaatttctggtaaaaggaaaatccgtcgactttctaagtcagggttcaagtccctctatccccaaaccctcttttattccctaactctagtatttatatatgccaatgtgtgaatgcaaaaggtgaaggtaaggcccacaagagaaaagaagacctctccatacccccacactgtttattgtacaaataatatagttaatttgcttattactgatagtagttacactttaacaaaccctaatatatttgtccctcacttttataaactctaaaactgggacatgcaagatgatgaaaggtggactataaataagttaccatccctccccgatgggttgactcctccagccaaacaatcccctagcatctgtctagattcgtagtactaggatacgtcacatccctctaaaatcccttacattaggacatccacaatgtgggagaaaagcaggtaataggcattgaatgcttccttccaacctggttatatacactgtgatgtgaaagttggtattagctgttacccaatcatcacgttgctaccggcaacaaacaaataaaaaatgaattgtagttcagtcacaagctaacaaatgtaccttttgtgcatggagccaccttgttttctccatcataggcttatatatattggggtacagatcccctagagttgagtacaactccaccgggtgaattttatcaaatccatggcatctattgcttcctatggctgagatgaagccatctattgcttcctatggtttgaatgggaattactttatttttttattatgttagtaatggttaagtttctgcctaccaaattaacaaagtatacatgttctcttctttcccaaacacaagaagctacattcatgtaaaaaaaaaagtgttaaccgcatagtacatgcaaacacacataaaccatatacatgcaaaactagaggcacgtgctcagtacggtgtttacaccatggattaatcaaagaatttctgggttatgcaagtaaaattagcttgtatattctcaaattgtctaaatatattgtagacggtgatttgttattgttacaagattaggataaattctttttttttcaaaagagactagtgggaagtgggaactaatggcttcatcccaaccgtcgataaaaaagagaccgtagagattctatcaaatccaccgatggagttggagtgactccaggggatccagacccattgcacatgcccttatacaatagagggatcatgttcgtagtaatgtacatatcatatcttactataaagttatctcccactaactcgttaagcttaacatgcaaagatgccacatcatatcatccactaacaagatgtcacattatcatccactaatccactaattaacaagatgccacatcatcatccactaacaatcatcacatttaaacatcatgcaaacatgttatatctttatagtttttataatttaagagcttttcaaatacaaacatgttaaattatcatccaatataattcacataatgtttcaatgtatatctttattatgttttatgatatcctatatacttatatagtttatcctcacttagttggtgcttaaatgattaatctatggtccaaattatctttctcattttttcctctaattaagtcatatcacatcaattattttccgcctttagataattaatctacggtccaaactatctccctacttttcttcttccataaagtcataccaccttactttttacgtttgaatcaccattctacatactatttaaatttaaattatcataaaccacattattttacttaatctgatattatctagctatcttacacgttattttttttattgttatcatactaaatttccgtagcaattcacggggtttcgctaggtataatatatggcagctgccgatgaatctattttccccaccgaaatatgcacagcgcgcacagcgagagaaaaaagtggcaaaatggagatggaacatggaagggaaaaaaagtggcaaaaaaaagtggcccatgcaggtctcgaacctgcgaccttcgcgttattagcacgacgctctaaccagctgagctaataggccttgctgtgcatttgaactttatcctactaatattggtagttccctttattcatttaaatacaattgccacaacactacatttgtctaggaaaatcacaacagcaccggtctatgaaaatcacgtactacaaagtgctcagtagtccatcaccaacaacagtggacatcaatcagtacataagaatgatcggctaattcgaccaaactgttcaaatacaatgttgagagaattgcttttacatgcataaacaaatttggccaaaaaaaagaaatatactgaaagcagcacaatactgtttgccatgttaccgcctacatcgaaaatgtatcatagtctacagcaatacactaacaaatgccctgcatggcatggcaccaacgttctgcaactccagcagtggttccatatagcagtggacaagtctgcagtagcagcacacggcgtatgctcctgcacctccatgagaagggtaaagaagaggaaaagactccaaaacacaaaggaaactcttaactcgataaaatctcaacccagttattaactttgagaggttctctgaaacttacccacactcagattgagcatcagagcacacgtgcacatcaagtcaagatcccatgtatagcatggcttgcacaattgcatgttagggcttttatgatctataaatcagcaaaagcgaaaacttccagctaactgtaaatcgccatagtagtcatatagcttaccagacaggttgatactagaagaccatgctgagattggtttataggtaaacttaagttttatgttagcctattttgagctcactgaggaggtacaattttctctggggaactatgtgcagataggaacgaatgtgaaggatgacacgatccacatccttaaagcaagggcaagtaacttctaggcttttggttggcaaacagggaaccaagttcttccacacgaactactaagatgaagcaggttgcacgagaacacatacaggaagtctcaactgtgaactttcaatacataggtttagaacatgtaagacggggaatcaacatagtcccagaggaaaatataagtaaatgctgtatactagggaaataagatggtctatggcatccaggcaggtccctcttaggcaaagcttccaggttggggccatactcttggtcatctggtttgggaaggggctccaataagcaggctccatacttcattggtcttggcattcttttgtcttggctgtttttagtaagggaggtgggcatggggcaaaggtgaaaagaacaggtccatcagaagatagctgagctgggttaaatgtgtttaaaaggcagaaatgcaataaggagcaagtcttgatcgcatgatcattctgttcatttcaagacaaggtggatgaaccatacctgttgcatttgtcaatctaagtcctaataaccatgtcgctttccataggaaaatgaactagggccagataacctgatgaaaaatgaaatgtgctaagtgagcaaaacatatgatataaagattaatgaaatattaagtagactaggcctaaaaaaaattagtgcacacttaagagtgaatttccatacatagagaaacataaatatttggtattatgacaggtactgtctatactgctgactcataaagtacaggtatgcttacccactgctgccagaacgaccactatatccaccataagccccataacctcctccagagacctggagaaattccagtcgaagttttgataagagtctgttagcatgaagaggaaaggaagggaagtgaaagggaagctatacctgggagctgccataacttgcatagctgtcaatagggccaatatcatctgagccacgatatccacttgaatatggataatcatgcccaagaggcttagtatctctgcctagatactttggcccttcagaaacaccaactggaagaggatggtaagggattacaggtgggaaacctgataaagcaccttctctttcaaagaaattggctttcagcctagtagttatttgcagaagagcatgtcttacaacatcaaggtctccactgatctgttgtgcaagcaaattacattggtgaactcatcgcagtacaaaagaccagtaaaaaaaaattaaaacataagtttaaattgtacctgaaccatctcttcgtcttctgctgctacttttggtacattctccttagaaaggatacgtatgtttgctcttgatgttctccttatctcagtaatgattgaaccaccttttccaatcaagcacccaatacgtgatgtcgacaccaacaagcgtgttgtgtaagacgggatcgctgattccggatcagttttctcactgcatcttggttgtaaatgaactgcagcatttattgttggggagacaggatcttcaaagaactgcatgagaaagagaaagcggaattgatcaggactagaattaaatatccgcatggatgctaaatcagcagaggaccgtaggagaaaagcacctcctttgcagaaacagtaattatgcagtcatcttcagtatttgaactatcaactttgataaaggctccagactcctgcctaatctgtttgataattccaccaccctttccaattacacctcccacatttgatgcagcacaaagaaggcgcaagctaaattcctttgcagagctctcctccctccgtggttgatatatagaaggccaatctccagccacatcacctttgtatcctccataagaactaattaaaggcgtaatccccacaactggtgcagttgaggaactaccaaggtgggagcccactggataaggctgtgtcatgctggatgcaagaagatgctgtgacctagatgggttgtcatggagacgagatgacacttgaagaagagcttttctgacaactgttgagtccccagatatctagtgccaaaagaataaagggttcattagcattattgactattccacagatggcatagcaaaaaaaatcaagtactgtaaatgataaattaaactagtaaaagttattttgctggttgactggaaagtgaaaacagctactattaaatctaagtcactgcaccttaaaaagggtactccgtaaaagagaatgttgcggacgtgtcacaaataacccatgttaccaaacagagccataaatgcctatagtagtaacgcatgtacgacatgtgtaacgcgggaaaaagatggaaacagagatcctccacaaacctgaagaagttcatcaccactgatggcacacgcagggagattttcattgctaagaacacgtatatgagcaccagtgtcactgcggattccctgtataatatgcccaccttttccaataatgcatccaatctggtctgatggcacaagcaaccgaacggtaacttgagctaaaccttcatcactttcttcattcccaatatcatcatctatggatagcttttcatgaactctaaagagagcgtcttgggcagggcaaaccttatcttcagcatctactagggtattagtttccctgcttgagctaaatattgtgataactctctcatcacaaccagatacactctcaccaatccttatcttagcttgagtgtcggccctcatctgcttagcaatttctccacccctcccaatgatgctccctatttttctagaagggcaaagatagcggtagacagtatcatctggaccaggagcatatgtatcatcaccaggattccttctcttgccacctccattttcagcataatcagagtgacgcttcccgtgactgttcctatgcccaggtccaaccattgtctacaatcggagaaagaacggtcaacacagtagagaatattgggtcaaataaatggaaactaaaataacgcgcaagaaggaagctattctaagattattcacatcaaaccctcctgaaattctcatttaccaaataaaatcaactataatcacacgaatcaccctgtcaaattcgtaatgacagcacatattaataatccttacacttgtatggctgcatgatggcatgtttatcatggccaagcgttaaacgaatccacatgaacaaatcaatcccataccacaatgaacaaaagtcatctttcgatcctaccaactagattactataaaagatctaacgagaaaaaataaaaattgtttggtctattcatgataacctctccgactctttttttacagttcaattattattaagttgaagaactaacaaagatatcccgacaaaaaaaaaattctaaccaaaacactccaaccacgcgaatcaggggcggatccaacttgggacgtgggggttcagttgaacccccaaactattggggggaacaaacaaactgttacttgtattaaggttaaggctctgaaatcaaatagaagaacctcttccagatctataagagaagctagggttaacgcaagcaaattccacggaggtgcaatcccggtggaagagagagatagatgaatcagaaagagaatgcagatggatgctcaccaagatcccctcccctcccctgctccgctcgccggatggagatcgccgcccctcccctgttcagccgcgagatggcgcaaggagcggaggagacgacgagacggggagattttcttttacgccaagcctagggaagcggccaagggggagacacccgtgtacaccgccttttatctcaagcttttcactaaagcccgaaaatttgacaaattaaccctttcagaaaacttatctaaaaaataaatcgtgctaaaaactaatcatgcgcttagagccatcgaggttaacaatgacgccgttgattttttttttaacatgtttgaccgtttgtcttgtttaaaacttttgtgaaatatgtaaaactatatgtatacataaaaatatatttaacaataaatcaaatgatatgaaaagaattaataattacttgtttttttaataagacgaacggtaaaacatgttttaaaaagtcagcggtgtcaaatatttaggagcggagggagtatatcctttttaacatctttgacgttggcgtttcatcgaagatgacatgaatttgccaggttatatataaatatcacattaacgctaaagatattgaatattccatcggaagcggcaagaatttaccagattatatataaaaatagtaggtatgaggctatgtctgtcaagcttgaaaccctggttcaaatactagggatgcctcccatttgaaggaatttctttctaccccttattttctttggcgaaattaagaaatagtgacatattttttggtgaaattattttttaatataaaatttaaaatacaaatatattatggataccacataccaaaaagtggttgactaagctcggtagggcacaccatgtaccaagtgttatacggaatcatacctcgtatatagaaggaattccggataaggaatgacgaatagagttctatatgtaaactataaggactacttggattgtatccatattgatctctctagttttacatggacaatgggacacctatggtataaatatatcccataggaggagggaaaaaaagatcaatacacgacacaacaacagatcaacacacgccaagacaagccgctagatatcgacatcagagataagcctagacaaacccaatatgatgtatgcggaggccaataagagagatctagcgctatctctgatctcgtcgagtgcgaattcgaggaggaagactaccccgttgttggctacgtgatggtattttcgggcgccaagtcgataacggctagataggtatatcccaaatattgtactggtctaattataatgaataagagcaacatcggcttcgcccaacatgagtagggctattacctgtcagataaggggcctgagcctgtataaaatttcttgtctccatatcttttacttcaatctcgcatataccttggtaccaacgatccccatactatgcaaaataccgtagtcgcggtatcacccatcgacaatatctattttatagttaatctttaactaaaacactaaatatatataattcttaagagaacactaagctcgaactaaagcaaatgctggtgtcctcgggagctttttatttcttttaaattcctaaaatccttatattattggctaaactaagaaattgtgatatatattttggtgaaaatgtttttattaaaattattgacttcataattaatactttaattaaaacacttattctacataattcttagttttaaaattcctaaaatatttcattattttcttcgtgtatgatttatttaaacaaaatgtgtcatttcccaataaaatacgaaaaataattaacaagtgtagaattggtaaaaaaggtaaagatccttaaaaggagtagaaggaaggactcaaaccagggtcttcaggatgagagcaccagacccagtagcaactcacgtgtgtattacatatacaagcatgtatttatatattttcttataacttagtaccgagcaccagatccagtagcaactcacatgtgcattacatatacaagcatgcatttatatattttcttataacttagtaccaaacaccatgaagctaattctatatgactagttaaatttttgtcttctcgaataggatgtgagtgtcaatattcttgacactaaagcattatatatcaccactaatcttaatagcgttgagctgacgatttatttatgcaaataagtttttagcacggtcgttgcaaaaagttttctggaagggtcagtttgtagagagatctatgctgcgcacaggcacaacctttaggcagccacacgctggtctcctcgaactcgaaccctagccttttgctgctccctccggcctccacacgcgcgagatcccttcccctctcctcccctcccggcgagatgtcgtcgtcggtcggcggcggcggcgggcagcagttccggtacacgcagacgccgtccaaggtgctgcacctgcggaacctgccgtgggagtgcgcggaggaggagctcgtcgagctctgcaaccccttcggccgcatcgtcaacaccaagtgcggcgtcggcgccaaccgcaaccaggccttcgtcgagttcgtaagccctccccccgttctccctccccttccccacccgcctggcccgcctccatctcccccctcttgtcgctcgatctcattcgagatccgttcggatgaatcggccaccggatgatctgccatgttcaatccacgatctatcgattcggccgtataggtatagcgcagtcctgtaattaggggattttgtctcggatagtatagcgcagtccgtaattaggggacagtgggggtcactggctcacatgccgtcctcacatctgcttggttttagctttttttttttttttttttgctatgccaacacatcgcgaagatggaattgatatgagcttcggtcatcgtaaaggatttgataagatgcggctgcaggatacacgcgggactggatatttgatactagtagtaaagttgtttaacaatgttagtattttggatgggttttcaggtggattgttgggtttgtgattggagttgaccgaggttagtttatgatactggaatgctatatgttgtatcaatctgtctgtcaggaatcgatctgtagcatactcggtaaccgctatctatatggatggctgggcctatgtggttttgtggttttaaaagttccacatgtcactgtttggtttgtgataggatacagttacagggatgtgatttgtggctcttggatatatggtggcgggagctgggagctttgaaatgacagcaaagctgtattctgtgtcattagtaactttagagtatgattctatttgtgagattgattatctaataaaatgtggtgtatctttagacttctaggaaaggctttcagaaactttatcttcctacaaattctattattgtttatacttatgttttatttgtaataaatgctgcgcattacttatgcaaagccattccttctttgcagactgacattaatcaagctatttcgatggtttcttactttgcatcatcttcggaaccagcgcaaatccgaggcaaaactgtttacattcagtattcaaacagacaagaaatagttaacaacaagagccctggagagactgctggaaatgtgttgctagttactatagaaggtgttcaagcaaacgatgtcaccatcgatgtgatccatctggtgagttctaaattttagtttcttttccaacatgaaagtatttcaatgggtgaattagtaagatcatgaaaaatttaagtgtgactgttgctatatcggttgccattgactgaagggatccaagggagtctacctgacctgatccttgtaaatcaaagattttacatagctcttcatctcgtagtaacgtattctgcatgaatcagcaggcccatgttaacacggagaaaatgtcgttatcaacatctgcaattggagagatatcatgtttgttttgctgcctctgtcttctaactattacatctgaagtttttatgaactcttggggatgccattttctaattatctttcatcatcacgcttttccacggtgtagggcacctccctgtttatccaagttattgatgaaaggttaaattcccaacctttagaaaattagtacatctatggtgcttcttttgtgatcattttgtggttcttttatccatctattagcaatacaatatagttccattcgtccctggttcatctgtctaagatcttctgtcctctttgtctttttggtggacaaaaggataacctttaagagtttcctgccagatagaatatttaataattgattttatgtactacaactacaagatttttatatgtgctgccagttcctggattaattttctcttttactcctatatatgacccttctattatatttcaggttttctcagcttttggatttgttcacaaaatagccacttttgagaaggctgcaggttttcaggttacttgaaatttcaaattctgttaatatacttgattgtttacaaaggcgatcttcccaccttattttcttcccccgcaggcactgattcaatacacagatgcagccacagcttctgcagcaagagaagccttagatggaagaagcatcccaaggtgacatctttgttctctgtacattgcatcttttaatattgttcacactttgctcctcctataaactgaattcctctgagactttaatttaatgtaggtacttgcttccagagcatgtaacatcttgttgtttgcgtatttcgttctctgcgcataaggatctgaatatcaagttccagtcacatcgcagcaggtatcacttatatcttttttgccttgagttaatttacaaagatcaaatttcgcggttgttaagatggatctctatatgtctaggaggattgtaatatcaacatactacctggtaccatattttaatgtctacattaagatttatgcctaggcattgcaagatcatacctcatattttccctgcaaattcaaaaatacgtgttctgccacatcatgggcattttacctttattcatctttcctgttcatcctgctgcctccttatatactgacacatgattactttgaaaacctggtaaaatagactatcaaccactggattccagatttgaatttgcaacctaatcgttggctaaaacaaagtagcttttttcatgggttaagggcatattcatccatagtagcacttggcttccatttttttagcctcttgctttttgtatggaacttccatatttgtatgagtatattactgcaaaatctttatttgtcagtggattcgtcttctccatctttgttccttatcttatttgccttgtgttattatagatcaaaatgcttcttactatgtatcttgttaaacatgttttcttttttattttgcagggattacaccaacccttaccttccggttaattcatctgcaatagatacgttacaggtactactattggatatcaccaacatttgaataatttaattgtctttttttttccatttatatgaacctgcctttcatataaactgccttttgatgttccttcacagcctgctgttggtgccgatggaaggaaagtggaagctgaaggcaatgttcttctcgcatcaattgaaaatatgcaatatgcagtcacggtggatgttctccatactgtaagttaaattggaaagcacttattcaaagattttgttgttttgtagttactatatgctgactaagattaatcaattccaggtgttctctgcatttggtacagtccagaaaatagctatttttgagaagaacggtggaacacaagctttgattcagtaccctggtatgaaccttggaacatatcatcttagtagaattacagaataattatgttttgtgttgaattagtgctttcattttcaacatttgacctagcagaccacacctccaacaaagcttgatattgttatttcgtttacagaaattattttcctatttttgtaattgaagtgaatgtgcagaagttgtgcagaactaaccaatgtaaacatgctttcctttacatcgtaacaaacatgtgcttgttctgtttatgatttcatgtgctttaaattcagacattttttcatgatctgacttcattacattaccattcagatgtaactacagcttcagttgcgaaggaagcattggaagggcattgcatctacgatggtggctactgtaagctccacctgtcatattctcgtcatactgatctcaatgtaaaggtataataggtgtgcattttctttagtgtattatgggcatgaaacctgtttagacgatatgatttactgccatcatagaacccttcatcttgtattcaagcacagactttcctatcatatgaattatgaaccatgtatctgtctgttctttcaggcacacagtgacaagagcagggattacacaatccctcaaggtgcgatgcaagcagtaccacaaccgcctggtgtaccaacaacatctgctgggtggcaaggtaatccacaagccggtggtgcatatgcaccacctggagctgctgctccaaaccacggcacaacagggcaagtgccaaattggaatcccgggaactctgggtatgctccagctccaggagcatatccaggtcaaatgtactcgtcaccaatgcagtatggcgcatcagggggcttctctgctcctgctgccccaccacaagagttgcatacttcgcagcagatgccgccgcctcaatatggaaatcagcctggaccagcaggtgcaccaggaaccgggcaaccacatccatattatcgctaaatttagattcctattcacaactggtactatgccctttctaattagtaactttgtgtacctttgcaatagggcaaaaccagttccttttccctgtctttcttctcatggaaccttttttataaataaactcttcatccagttgttctcatccgcggcacaaaatgaagggttttcatcgaaactcatcatagttttctcccaaaggtaactttgtatattcctaatatgtttatcgtcagctcgttggtctgtatcttggaatttagtattccctcgttttttacttgtcactgttgtgacaaaaaaaatcactgctttaactttgatcaccaatcatttttttaagttgaacaaatccacatggttacatttatatcagacgcactttgattaatatggtactatttttttacaagtaaagtgcacaagcggttattaaacttataaggttatgtcatttagggtcctaaactcttaaaatatagatccaagttttagaacttgtcaaagtgtcatttaggtcttaaaacgtcacaacctctttaggatcttacgtgacgtgtgacgttgatgtggcatgccacacgaacatgacgtgacatcatcttgaccggcaaatgagacctagatgagatattttgacaagttttggaaattggatttgtatttgagagtttgggaatctagatgatacacccttacaagtttaagtatcacccatgcactttactcattttttaagtactaggaataatgcccgtgcgttgcaacggtaaagtcgtttgttccagtggtacaacaaaagccaaagccattttctccaatggcacaacaatcattaggagctgagcgataaattaaaacattggtaccgctatacattatattgaataagttaattaaaatccatacttggctttgggtcgaaagcccattctttcctttctttttagccgcagcccggttgtaagatttccataataccgttgggccaaaatagagtgaaatggcatgattgaaataaaatatattaattgtgcacataaataaaaatctattccttaatatcgtagacatatatggaacaataaaatattaaaacataacgtgacaattaacacgcataatttcataggattttaattgtatctcactttggggctataaataaagctaagtgtcaaaatgtcataaaaaacatataatggtttggccaaaatgaagctaaattaacattatatatgaataatggaaataaattaaattttgttgccaaatttattgttggttccatttagctacatatatgatcttaattgcacaagaaagtttataatgcaactttatgtcatcaaataattgcttaaacggattaaaatgctcttatgtaaagaggaaatcattaattcggtccgataataacggaaaatcaatttggcccgaagaccggcaacggctcggaggctagagctggcacgtgatcgtgcggcccatgaggcacgcgaagcccaagcgcggcccgttagcgtgagctgtccgatcctgatggatggctacaatctctgatgggtggctgatgcagtgtgggagagtcgtgggtcctctaatgctgatcggacggtttagattgatcaacccggataaaattgccaccagccgaaaccctaaccctattaccctctctccctggccctattttctggtgctaggcgaggggtagtggtcacggcgacgccgacggagcggcggcgatgttgaggcgccagtgtgtggcgaacctgatgtcgagcatggctccggcgaggccagggcggcggcgcgcagtgggatgccatggccaaggcgacggttcatgtgagctgaggccgtcggcatcgagcgaaatggcggcgatggtggtaaacggcgtgctgcgagctgataccatgcgtcgatccctctctcccacctcagttctcctcctcgacacggcgcaagactacaacaaggcgagcctcgacctcgagcggcaaactgaggcggcgctcaagttcgagttctcctcctcaacatgacggctaagggatgcacggcggtgcgtgtagctgtacaccagtcgcacgaagatggttgagagttcggaggtgcgcacacaggcggagctcatgccgtgcgccacgaagtccgacgaactaaccctaatcccggtgagtcttagggttttccattgagctggtgatttgcctgttcggggttaactgttcttaattttgggaatttcttaggttagggttcgtatttttcggaaaaatcaaaataagggtttcgaatttgggggatattcttactcttataccgatctgattcgcctcctcgtaacaatctcttattgtacttttaggatcggtaggacttaaggtttaggtagtgacaaacgaacaaagattaagtttccttatatatgagctaggggattgggggcgagtccatggcgtaatcggatgtgctcgtatacgaacgaaagattaccgcggaatcgacggatgaaagcttgtatatacgaacgaaagattaccgcggaatcgacggacgaaaacgcggtgacgatcggaaagttacccattttcttttccctttgtttttatttctttttcctgataataggagagcatgcatatttatatttgaccattaggatgggtcaattatttgactgggccaaaaatagaaagatgcacacacgcgcgcaggccatctccatctgaccttcccaggcgcattgtgcacctctctcatcgctacgttgccaagcccatctcttgattgctggatcgcggaaaaaaaggagaactgaatcggaggaggcgatgtgatgcgctacgggctgagaaaaaaaaaaggaaacacatgcgagcgccgagaaaaaaaaaacgatgacgagggaagtgattaggattcgaaggcaacggaccaaactatccggcaaaaatatttttaattttataatagtagagatttaataacttgttattaaaataagagtggtaaaagattgaacatgaatagtgttagcgacatgtaattggaaatggaggcagtgccacattcgtctgtcctgcccccctttgcttctgctgagcaacgcataattttcttgtctgttgtcttacggcccacatctcaaagtaaaaacatcaatttggaggaggcagggcaacgcgtttgggaggccattgtggtgccagcactgctgcagcgatcttggcagtaccagcaacaacagtcagccggttactaatatatactttccttggattcgatcggatgtcattatgaacgattatgggcatgttcactttgatgcaatttttaaccttaccaaattttgataaagttgccaaaaaaaagtggctacatttagtttgctgctaaattttggtaactatataggaaatccagcaaaattttggtaatataatgacaaaatttggtaaggttttttttgacatcaaagtgaacatgccctgtatatgtcaggagcaattaatcacatggcatatgccacgctgcaaagaaaaagctcaagtgactgtgcacttgtcaacctgtccacgcatctctctttgatttttcagtacggagtacccagcaatgacaatgcacgagccaaggttttacaagacatctccattatgtattcactgtgaaagtgtgaattatactcaccacattatttatttattttatttttgttttttttcttgtgaaatcccctggaaaccgcacttgggattgggagacaacaaccagcctactgccatggagtagcaagccactacttagcactagtgccgcgtagttacactggacaaaatcttgtgacactaaccatatggatcaaccaaattgatgtggacgctctacttgtcaccaaacttagattcagttaatgaccagagcttagtgacaatgcagtgtttcttgttcttatctctgttctctgcactcggattgccagggttggagtcatgatatggacaagcccaataaaatctcagcgtgagagctactcctaggaaaggttgtaagcaaatctttcttgtcactttggatatgcctttgtcagtagagagatttttcatcagtgaaaagaataagctctctcacggagaacattttgcagcgaattactgtacaatacaatgtgctctcctttctcggaatctccggctctcgcaaacagagctttaaatttcgctcctacttgtcttacgtcgtaccaaagaaacaggtgatcaatgaaaggaaatctgaaaaaacacacaccatgatttggaacaatggccggcttctttaatagacattagatgaaataaaaggtcaaaggactggaaaggactcaaagctgaggtggttaggcattggcatctaaagtaacaataaagtgaaaatgtcggtcacctacggttgcacctgtgccgtgctctagaaactgttaactgtccagtgtttacctgctgaattactagggttataactactgatggttccttgaaaatcacaggattgaaaaaacgtagaaataagaaacacatagaaatagtaaagaaaatcatatgcaaaacagaggattaaaaacataggaaaactatagaaatgatcgtttgattggtgcataggaaaaacatagtaaagttaagtattaataagttaatagtaatcagagtttgaatgattttgctaggataaaccatatctttcaatagtgctttgccttgatcctacgtgtagcaaaagaaaaatgagctcacggtggatgttaattttcctatgattttttcttgaaatcatggtcgtaggaaaattttacatgcttttcctttgttcagttcctattaatcaaagggatgaatagtaccaattcccctggtattcttgttcctatgtttttcctccagttttttcccatgaatcaaaggaggcctaaactcttatagtagtattgagaaaattcttaacaaaaaggaattgctttactgaaagatacttcttcgatagatgcatctaagacacatggaaatgataaagatttgttatctgcatacggcaatttttacaggctagcttgtaattttggttcctctaacggtaaatctgtttggttgaacttctctgacatatgagtgtgctaccgacaagaaaaaaaatgtctgaaaaatatgggcctcagttttctgtttgttctgacatgacagcgaagatgtcaacactgaaacagcgtcccaattactgagccaccataattagcatcgtaaaatctccgtggagaattctaagatctcgcagtgcacagaggctcttttactgaagatgctgtgtgcatcagtgcaatgtacccagccctgagatgctgttctttcctatctttcctggatctgcatagtttgatgccaacaggcagcaggacatcatgatctgaaattgggagacttccataactgatatccatggcctatctctgttcataaatatgcctacacagtcttcagtctcacgcacagatcttgttggtttcatctccaccgtacgtaccaaatactagttggttactggttacaacttacaaccaaacaggagcaacttgcaggctggagagatctattagcatccatatcatcacctacctacctctggcactggcaatggcaaaagagccaagaatggttttatacttgtatgcacaatgcaattggaaggagaaggtaaagaaaaggggatgtagtttgagaagaacacacagaggcagttccccaattggttgtggaggcttaaaggcttgtcttgcctgcacatttagtgcccccacatgtatgcagattgcagccactctttgcaatcttgttggagatggtctagggatcttgacatcatgggatatgtcatggttgctgctggtcctgcttggcttatgcaatgcaggtagcattcaatttagcctcaggcatgcaaaccacaagcatgcaccgtacatgaaactgatgagcggatacagactacaaaaggggccatggatgtgctgttctgctgtagatttggtccctcgaagggaaatgcacaacatggttgtcgcatctagtcatttactacttcatataagaattaaaggtgtgaaacacactttgaagcaaaatgtagacccatttcatggttctgcattaatattttgcatgtggttttggctttgcaagccatctctgattacataactgaaggctgaatagcaggcggcctaaatttgaaacgatacatttgacttgcttttttctcataaatattcgggatgtaaactttttagcagaaatatatcgtcaatctcgcacaaccgttacacgaaaataacgacgcgagcagtctcgcccgacgaaacaacgagaccgaacggcgaaaacaaggacatgcgcggtggcgacgcgagaccgtgcggccaaaccgcgagaccgagcagtctcgctgaaccagccagcgataccgactgacatgccgattgaaaattgttaattagtgattaagtaccctaattatccattaattaattaaagaaacaatacatgtagtgtacaatatgaggtaaaatttagaacagaaactaaaatgatttctgaaaattggaaaaatgaaataaaagttcaagtagtaatataatttataaataaaaaatgagaatgaaaaatgttgaatgttgaaagttctatcagtataaaacacaaatagtagtaaatgaaaataaagtgggtaggagcaacttgctcttgggtgacattggttgatgggatatataaaactataaataaaaccttaaaaaatattatatttgatttttaaaattcctattacgattaaaaggagaataacaagcatatcgttaagcaactcagcctcaacggttggtgggacttttagccattaattaatcaattaataattactaattatgattaattaattattaattagggtaattactcactaattaagcggcaccgttggacaagacgttcggtctcgctgattccttatgcaagaccattccgcgcgtgtcgtcacgccaacatcattttcacacaacagttgtgcaagatcgatgatatatttctgctaaaaaattacatcccaaaatttctgagaaaaaagcaaatcattatgttttcaaatttaattctcgtagcaggccagccctgacctttttatcggcagatcagaactgtacagtgtctgtactgtagcaattaaccacatgaaaatatgcatgctacctagctttatattcttatcacccaaaaactatttgaactccttgcattttggagaaaagttgtagagtactacttcctccgttttatattataagactttctagtattgctcacgttcgtatatatgttaatgaatctaaacatatatatatgtttagatttattaacatctatataaatatgtgtaatgctataaagtctaataatatgaaacggagggagtatttattaaggcccttgtcgaggagtgatcctctctagcgggagatcgtgagatccccttttatgagttcggccaggggaaaagggttcacctctcgaaatcgtgtatccgccctaagtgtttcctaaccgcgtatgggcgacaagattatacaggttcgggccgctatggagcgtaataccctactcctgtgtgtgggatttatggttgaatgttacaagggttcctcaactccggagaacgttcttgctcttcgcttcctggagtttaggcctactgagtgtcgtcctctttttcggcggggaaggtcctccttttatagttcaaggggataccacatgtgctgcttctacctcttctctcacgggagaggaaccctccttaccttgatcggaccacgatccgtgccttcgcccggaagctaagcagcagtccgtccttgagtgggacccggcgccgccccccgcctgacacgggggacagccctgtcattccctcttaaatgagcgaaggcttgtggcggtcctcctcacgtggagggaactccggataacgctccgatgggacaggacatacctacctccactccgccggatacagaggcgacgtgggggcacgaccgcccgtccaatcggcaataggccggtcacagattggtcacacccgattgacgtgggtccatcgggcggcaccgcacgtctgcccttaccgcattaaacgcggtgagggacagttgggacgccgcgcgcactgatggctgttcagcctgggtctcctccccgctcgcttcccccgccacatggcagttgggcgagggcctcggggcgaggcagcgcgagggcccgaggggtgtgacgtggaaccccgaggccccctggctgcttctgcgactcgcgagacgcggggggagggccaggctgtagagccacgtggctggatgggaaggtgacttcccctcactttgcattcccccgggcctatatctccgatagccctgtttcttttagcttgggattattataatctagattattgagtcagattactataagctagattgttataatctgtagtagaataagcggttagttgtttcttttctagattattagagcctagattattgggtttgcaagtctaaagagggagtggggtggcatggtgggtaatttttcacctaataatctggaaaaagctcaccaaaatgagcttatcatattataataagctgggctccagattataataagctactttaataagttatctgtttctttcaacttactcccaataatctggattataataatcccaagctaaaagaaacagggcctaatatacttagaaaaaatgcccgtgcgttgcaacgggtgaaaactattttaatcttattattgttatacggtttagttaaggtgaaattcactatgagaattcgtttggatatataattttctagaaaatcattagctacaattaggagtccgatcatctcaagttagcatgcgagttttttttgaaaagatttcttatacgactccttctgtatttctaaaaacggacaaacttaaaacacgacccaaatacggtttccaaaagagaatgaacttaaaaaccgactcatacacggatgacgtgttaaagtaccagcaaaaacatcttcaattttataatagtagagatattgaaagttgtn

SEQ ID NO: 6421 - DNA, 2990 bp, Oryza sativa
  unsure (1)..(2990): unsure at all n locations
tttattctccnccacccaagtcggttgaactgctctctactgcaagccgnncatcaacatcttcaatttttataatagtagagatattgaaagttgttagtcatagagcagtgacgatgccataaatttttaaagactagaggtaaggtaaggcacagctaataaagtattggttttctataaaatttacgtagtatatttaatacaatttaaacaagattttggaagcctgcctctgccccaagtcacaggatcgatgcccatgaacaaccttgttcatggacagcctgaagcctaaactctgaatgacggtgagatcgacgaggttctgggacgattcaattgtataaaaatttcgggctccaccacaatgaatgaagttcggaaatttcggatgtcaaattcaaactaaataggatataagagcacccgcaatggtaagtaagatgctctctataaaatatgtacatctcagcaatagactagattaatagtaaaccatctcaatagtatgtctacatgggtatctatagctctttaatacattgcctcgtttttctctatatactatcttcaggttagtagatagctttgctctctctcttcatttaatctcttccaagtagaaaaatatgctaatatagatatcttgtagagagcctatagataaccattgcgggtgccctaatgttgtgtaggttctcactgaaatcaaaatggatgaaatttgcccgattttcgatacacacttacgtatgagagaaaaggcatgcattcgtgctgtcggaggaacaaggacgggtccccgggcctctgcggtcttggggacaacaaatgtgacgtacttccttcgttttataacgtaagtctttataggattatccatatttacatagatgttaatatacatatacatatatatatatatatatatatatatatatatatatatatatatatatatatatatatatatatatatatataggacactcatatggggcaccatggtgcccgggcaccatggtttcaaatgcacaaaatcacttaaatttttcaaaattttcaaattgtgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccgggcaccatggagcaccaaacaaatttactatatatatatatatatatatatatatatatatatatgtgtgtgtgtgtttagattcattaacatttacatgaatatgaacaatgctagaaagtcttacattatgaaacggagggagtatttctttaaaagacgtactccctccgttaaaaaaaacaaaaagacaaccgagagggatagtataactaatttggacaaccctccatccaaattcgttgtacaagatctatatgttcaaattgccgaagagacaactggcaacttagtacaccccatcctccatgggcggagtacttgttcatcatcgacatcttcaaaaagctcgttcatactaacaagaaaacctgtaaatatattagttttgtaagttgtaatattaaatatattttgataatatgtttattttgggttaacaatattactatatattttttcacaaatttagtcaaacttaaaaatgtttaactaagaaaaaaaagttaaagtaacttataatatgaagccgaatgagtaaattacaaactcatacgcacggtttgaaattttgattcgaaatttctaaaatttcggtaatttcaccctcgccggcatgctcaaatcttgcccgaaatttttggttttttgcatttttttataaatttggtcaaattttcaaataatttcggtcagagattcccgaaatttccaatatttcgttcacctccggcataacacctaatttcgaaattgaaaacctgctcgtagtcatatgtgttttcttctatgttttagctagccagctatggcgcctatataaatcccccacacgaacgaacaaaacgatcgatgtgtcgaagtggacaagctgcttaactaatcagctttccctttcgcttgcgcacgtacgtacgatacgacaatggcgccgccgtcgctaccgattctcctcgtcttgctctcgctgtcgtcgtcgctgtcctcctcctcggcggcggcggccggccgctggaccgacgcccacgccaccttctacggcggcgccgacgcctccggcaccatgggtacgtaaccaatgcacgccgatacatatacatctatctcagctcagaattgatcgaagtggcggcaatggcgccgccggttgtgtgcaggtggcgcgtgcgggtacgggaacacgtacgggcaggggtacggcacggacacggcggcgctgagcgcggtgatgttcggggacgggctgagctgcggcgcctgcttcgagctgcggtgcggctgtgctactacttaaagggattggttcaactatgcctgcatttgcagacatatgacagactgctgcagacacctcatacactcgccggaagtgaatgatagtgaccagaggtctgcccccattctatggcacataccttggttcatttttatgataacgaggatctggcctatcggacgctgatggagaccctgatgagccccaatctggacacgccgttggatattgacattgctggggatccagaatatgagcgctnaacctggcgccggagcatgctgtggggtgggtgtggtggtggggaacacccgcacttgtcaaaggaaacggcggtgggggggccaaaatactcaactgat

SEQ ID NO: 6422 - DNA, 41900 bp, Oryza sativa
  unsure (1)..(41900): unsure at all n locations
cgtggcatgactttgaccacgttatggnacactcttcatcatgtgcccggccaaccacgcgctccccggagaccgcggcggctggtgcaacccgccgctccaccacttcgacctctcccagcccgccttcctccgcatcgcccgcttccagtccggcatcgtccccgtctcctaccgccggtcagcaaccgccgccgccgccatcgattgatcaactcgtcgtactagctgataattaatccgccattgatttacccgtcttgtttagctcccaaaataaaaaattaaatatagaaaaaaacaattatgtgtaaatgacgagatgaattttttaagcctaattacgtcatgatttaacaatatggtgctataataaacatttactaatgatagattaattaggcttaattaataaattcgtctcgcagattcgtagcggaatctgtaatttattttgttattatacttcaaatgtgtgtccgtatattctatgtgacatgttaaaacaaaatttttcgctgactaaacaaggtctaaatgtgtgtgtagggtggcgtgccggaggaagggagggatgaggttcaccatcaacgggcactcctacttcaacctggtgctggtgagcaacgtgggcggcgccggcgacgtgcacgcggtggcggtgaaggccggcgggggaaggaaggcgcggtggcaggccatggcgaggaactggggccagaactggcagagcggcgcgctgctcgacgggcaggcgctgtcgttcacggtgaccaccggcgaccgccgatccgtcgtgtcgtacaacgtcgcgccggcgggatgggcgttcggccagaccttcaccggacgccagttcacctgagaagatcgatgagatgactcgtacgtatagtagcgcgcctagaacgatgatgtatgttgtccattgataggtcggataaaaaaaacaagatttcgaggaagagacatcccttaaacttcagattgaaatcgcataccccttgccacttattgcataccccttgccacttattaagtggatctccatcgatcgatcaatcattaggttcgattgacacgtaggaattccactgtattgcaatagtatgttgttagtagtgcgatggatgtaatatgtgaaactgacgtaatccagacaacactaatgtaatatattccccgtcttaaattagttgtcttactggattttaaattttgtttcaaaataattattattaaagtactacttatctcatcaatgaccccatataaatttctttccattttaccccaaccaccttctcactacaatacaaataagggcactataatttttccttccttactaaaccttaatttatgctaaataacctagaacgataaatattgtaggatgaaggtagtatgtaataggagaattgatccatgtgtcagttgcatgttgttggtgtactgctcatatgtttttggtggtgcgctattttctgtgcttgttaggtactatatatggatttcgcaagacatatcgagaagacatgtttaaatatagtgttataataaaacttacaacattcttctactgagcaatactaccacttcgtgttgccaatatgcttccaattccaattagacttgttaaacctagcccttcccattgttctcgttgactacccctctacctagcttgatctttgatcctctatcctccatctcccatccttcaaatttcattatactcctattactaatctcgcccaacactaactaccaacccaattgcttcactgttgttgccgcaacatcaacgtccctatttttcaccacccatcacagggtccaccctgtccgttagctttatgagcccgggatactcttcttttttctcatcgcactccaattacaattgtttggtgtgttcaggagagattgttgtagttgcagcttctttgcagcaacagtggcagctacagctagaatgttgatagatattattggtgctaagcagctgctgccgcaaataactaaagtgaacagattgttatctgtatcgttcctaccatcaaatctcatcgaaatggcgaagatagataatgtcactacaaaaacatagagtatattcagggagttaaagaagtttgcaacattttatccttattttttaatcggatttaccacctaattttaccatctttttcaggttggaccaggtttatggcatgggttgtgcttcggcctaatccacacgagcagctggtgtttgctcatggtggcgatggtgcgcgataccaggagcgtgcgcgacgcgtcggggtggtcatcagtgagggctagcatgtcgtcgtccagtggacgcctgacacggaccctgtggtgatcatgctcggccctatcgcactcaaaacaatactacgacacatctgattatgttgacaggatctaagactataccagaactatcccattcagatcatgcatgagaagcaaaaaaggccaactattacatttagcagtaatcaagatccgatcttctcttttcatgagaaaattcaacatgtttccgattaccaagcgaggaacacggattaattactctagttttttgaagagcataagaggaatattgattgccccacaaaacccaaatctcctaggaattactgaatacattgctttgtttcactctcccagatctcagggtcaactttcctccatggattgctccatgatcgaatagcagacgcatacctgtgtacctcataaacccaaaacaagcatgatagcaacgagccagccgacgaccccaatgattccatcttcaggaagccatcgatcgaggtggcatgggcgtccaccaggcagaggcccttcgccctgacgctagcgacatggccggatgacgagactttctccaccttggcaccgacgacctccagccgtatgcaacaagggtcttcagccggtggccggtggacctagatggtagcgtttgtgtgttgactgttgagtttgatcatgctgctgcatagcagttgcgtgtgaagggagacttttttaggttgggagggaagtactcgtaccagagaggcaggcggaaccgccgtcgagggatccctcgccggagcctggagaaggggactgccgaccgctagtaaatgcataccaagtgacccaatcagtaaacatggttcaacttgcaaaggatggtaaaaataggtggtgtaaaaatcgtcttttacccctatgccattaaaaaagttgcagcttacctgtgtgccacaaaaaagtttggagtcacctgtatgccatgagaaaaactttcgttgacccgtgtgacattccgtccaccttctgttagaacttaacggttccatagctctgacatgtgggacccatgtatgaaaatgactaatttgcccctaaggattttcagctctattctcctctcctgctatctcccgtgagtgcatgctctctcccagttgcgctgcaagccgccgcaccctaaccctagccgcacgccgccgccgcctcgcctcgccggagccgtcgccgcctcgcctcgctggagccggagccgtcgccgtgcgcccaggccgtcgtgcctcctcctctcctcctccagggcccacgcgttcccgcgtcctccctcgtcgcgcggcacgtgggcggcacgcgcggcgggtggtggttggtccgggagggcggcatcgtcgtcggtcaccgggtggtgcagcgccgtcgcgccctccgtcgatggccgccaccgcaggtgagcgagtgagatatttgcggtggtcacgtgagattcgaatcacgatgtgctagctgtggctactgctctcgtgctatctcttgatctctcgctctcgctctctcgtgtggggtttcaagatgcatctgtatatggtttggagttctcgtcttttgcgagaaacggaatttggaattatgcgattgcttttggaaattggtgccctttggaagctctatgtgtatgcttgattcgaagcattaaataaaaaaaagggcatatgcttgtttttatgtattggacaataatacctgcccacatgaatttctgtcactcacactaaactataatatttgattacccgttatttgtcggtatgcaatggtcatgcacctgttttttcctttttacaaaatttatttccaatttttccttattttttccaccattttctaatatttcccacattttccttttttcccggatttttaaacacttttaaaatttattctcactttttctgatttttaccttttttaaatattatttttcattttttctgatttttaacgcttttcctaaattatttttcacttttctaattttttaaacccattattgtacataagggcaaaaccgtctttacacagcccctaacaacccctaacacctctgttatgtctccatccatccaaaatagcacacgggtcaacgaaagttgggctcatggtatacatgtaactctaaacttttttttggcatacaggtaaccagcaactttattaatgacatagggtaaaggactccaaatttgaaggcgcagacagtagggtttttggtaatagaagggggtgttttgtgattttgtgaaaggttgagggggtaaagcagagagttttccccgaacagtcagaaaaaaaaaagggaaattcgaagtccgcagccggaggcccccacggcggcggcgctatggcgatctctccgcctccgccgagccctagctccggcgacccgatcgaggccgcgagacacgccgccgcggccgccctggcagtgcccgcacgcctatggggctccctcctcgcccgcctcccttcgctctcggaccgccgcccccgccgccgccgacgccctgctcttccgctccccttccgcacagccgccgcccattccgcccggtgagaaaccactgcttggattttagtgtgcctcctgtgcttcttatgcttgtgctgcaagctctcgcttgctagtgttatgctagtgcattcgtggactggacagaccgagtaaatttgggcaaattttggggttttaggttggtagctggtggtatgtgaggaattcgtacaatgcgtttggaattagtgactaggtgcaatataggcaaaatctaccgattacaaatgcgaatatctgataggaatgttgtgtaagcgtgtggctaatgcctaatgttctggtattttctttgcgtcgtcgatgaccgtgatgactgatgacacataattgcatgaagtttgttttttaaatcatttgttactttcagggctaccggtgagacgcccaaagcttttggcatcctagaagatattgtacaacacacgctgtgtagtttgcatggtattcagaaaagcttactcttttggcagtccaaagctgaggtctcaagttaattcataaatcttttattttttttacgctgcaattaattaaaagagtgcatcttatacttcatgctatttacctatttttggttctgttatatttattcagggaacaaattcacagaaaatgtattttatgatctttgaaaggggaccaagggcctttgttaaagcaacatatcagacattgactagactaaggagcaatgagagtccaacccagtacattttgcactctgcatctgatatggtctcaacaaaacttgctgtcctgacaaacatgcaacactgcttggctgcttttcttgctgaggtttgtttagtcagatgtttatcattacaaatgcttatgtctagtagaataaaactcgtgtcagcagttctttcaaagctaactttgtagttgctcgcttccaaaaattgctgtactactctagtcagatcattcaaacccaattttctaactctttgataacattgtttgttttacatgacacagttccacatttataaatccaaatcataccttgcttgttctataggtttattgcgaagttgacaaattcaaagaaggattaactgaaaattcagataaatcgcttcacacactgtttgctgttttgaatactgtcttctccaaattggaggtatcactccaaaatgtttgtgaggtatgcattgtttgcttttcttgcatttggatgttatatgtataatatacttttgtgtttggcattatgtaatatattttcttcaggggcatactctactgttcgcactcgatggaagcccatctgaacttctctttgaaagattaccagaaattgattatgataactcagagtggacagaggcctcctcaacagatgctatatgttttatctaccaaaacctccagaagctagataaccttgtttgctctcaggtaagcaactttctctttcaacaacagcaacttgtctcgcatttgctacttctattaatgttacctgagttgtagatggggtatggttggatcaatgttatactattggaggttctatgattgggcctgttcggctgcctgttctgcagttgtggcacagccggcaccaacagtgccacatgcacacgcgcagccgcagccgccgctgccagcttgctgaacaggcccactacctgtttgtgcttgctgtataaaatgtttatatagctatatgcatatgcattgtttcagactataaatgagtggtattgtcatacctatagttctgaacaggcgccccattagcatgcatataatggagcaacatgctgattatcaaaaccatgagatttgagatgtgagaattaatcatgtggatgaactagtgaaaatgtgttcaatgccaaacttgtatctcaatacagagtaaatgtgtaaatgtatagcattctccaggtagtattttattttttgtgatttctccatttatcatatttttacttttataaactatgtaagttgcagttatgtagaaataagtgggtttgttcactgtacaacaataaatcttacatttcttatcagatgattatatgttgcttaattgcctgaagcaaatattttctgcaattatagctctcaaggcataaaaaaccaagacatatgaccatatactggttgccctacacatgtggagcgttgggtctctcggcatgttctctgtggcttttgcgacacagtagcttgatgggaagttctgacatcgacaactgggttcaaagtgccaaagagtcaatagctggattttgggatgtgcatgttgagaaacctgtaggatactttctatttatgtccttctattatttatcttatgcatttttaaatgatgctagtgtaagttaactgagggtgaatcaaggcattctagttaaagtcttttctcgttattccgacattgacatatatgagatgttctctgaggtacaggaggataagattttgttaatctattcatgcaaatatttgtctaacaaaaaggaaaaccagataaagggaaagaaaagcatgctgccttgtgcatactagccgtactgttttcttatagtataagcatatatgatagagtatagaaacaatttcatgtgtttgtttactgcagcacttgcacttattaccatgaacatccttaagtttacatgtgtatataaggcatataactaactactatctttgttgacaattataaggcacacacgtagtttcaaaattttggacattgtaattttttaccaataaataagtaatgtaagatgcaacattatatagttgtgtgatacaaaaatggtaattttgaatttttgtttgcaataacttatgatcatgattttgtagttacacacgctatattgcaaaagattcacagtcataaattcattttggcagaccacaccaagtcaaatcgcacacaatattatataaaaatcaacagatagtagagtaatatgcaccaacatctgcaccgaaatagtctaaatactattccttgtggaaccattgaatgcaacatgatataacttcagagagcattagtgtaggagatcaagtgtcaagttttagtggggaacttctagttggatttaatatagctgcaatttttttccacacctttgttgtggctgaattttgatattgttcttaaaatttggaaatcaattatgttattgtgattgcatcatgattgttttattctcatttgatgatcattagatcatttccatcagaggtgagctttttgagacattcaaaaacagaggtaaacatgtaatggatacacaagaggtccaactgaatgaagaagtattgcgcaggttattccctgatactacatctctaatatgcaaatttaatggtaatcatatcacatagttttttctgccactcgacaaattagtaccatattgcatatctaatattgcattttcatcatgttcatctgtttactcagatatgaatactttagatgatatttacctgtggtttcaagaattttaagtcgagtatgccagtatgggggtttcaataatgcagcagatatgcttgtaattttgatttgggatacccaccaccatattttgaagtgctttccaattattttaggcataaatagtggggtagtcactatgagtatttgtcttgtgtgacatgaagtagatgtggtggcacaagagcacagtggtaccagcttagaatttctgtttcctttttgttatcttttgtttactactgttaggattctgtcctcgtcctcaagataccaagtaagtagctgctatgctgagataagatatgttaggtcctttctctgtataaagggtcagacaaactgcacctgctttgaggaatcaatcaatggaaaaaaaatcctaaaatatctctcactccttgcttccctcgccatgcaacagctacactacagctagtcagtcatgcagtaggtgtctagggacatgtcctgaaaacttcccactacttccattcccgttttaacccacagtaaacaatatgaaagtattgtacaggtgtgatgattgatgaagccattgatgacatagtaaatactgtacaaaagagtggtgacgcctaaacaaaaagattccccaacccagcaccaagattttcttcgtttatctacttttttgttgatattattggttttgactaatgttttttcatcctggagtgctgtaactttttcagtaaaaaatttgcaatttcttttgtcttgaacaaaaaattacaaactttaattttcttgaatatgcaaaacttcagctttgcagccatttttttctgagtccattagaggagcataaattatattttgcattttttaagcccactggttacatattggatttgtaggatgatgcttgaattttgtcagcaaacttcaaatgagaagctgccacaagatatatcagatcaagcacttatggagaatttcatggagaggtaagtctgtttgaaaactataaactgatgtggtgttgacttgtttgcatttatgcgttacagtgttaggccaaatgttgcaagttcaaaaggcacctgtaatatttttttctcaagaattttactgtattttccttatgctgaagaaagtaattcttcatcttgatctttctctgctaccttttaagagcaaatattatagaggtaattccatatgaggagcttttgattcagggttggaacttgggatcatttgatcacaaaggaaaacatggcatgtgcttcatatacttcatttgagtttcagttgcttttttgaaactaaagtgattatatttgcacgtggggtaaaccttgcaccgtaaggctcttccaacttcagggttcatttgtttcctagtatgtttggatgaaagcaatgagccatctgaatttcttgggaactctatttcatgtctcagtaaaattctgcaaggtggtgatagaagttaaaagttcaagatgaatgtaattctatgctcgaaacccagcatttgacgttaaaacagatttgacattacttttcaataatggaaattaacttattagcttcttagtttccaatagcatctggaagattcgtgttacacatgctttatagctattttacatagtagtaggttctacatatttacatacttcttgtatagctagctgttccaaaatttctgtttaggatgaccagttaatcacttaatgctcagattgtgcttctgtagtggaaagctaaattgacagtagacatatcctttatcttgtttatttgtgcattgaactatatgcatgtatttgcgcagatatgagaaggaatggacccatcctgttaagaatcttttcggtggagagttagcatatgccatgcttatccaggttagttcacttgactctattttggatgcatcgaatattccacttcatgatatttcctattctcaccttcaactttgaacattcagcttcagaagcgcacagtggatatcaagcagtaagttatactatttctgtctgacaataataactaaaatgcataaagatatatttttcttgtctaatattcatcaacagatgtaattggattcttcttacacagggcaatgctggaactggatcagattcttaaaggaaatgcgataaacttcgctattcttgcagctttacctgcatttggtgtttcgcttttgctcctcactgtggtgcaagcatggattatgaatgtatgttaatagagttccgtgattctatcattctctctttgaaatatcatcatctgtcagaagtatctgtaggtctgtggggccttgttgtgtttccctgtaacctatttgtgccacagatctttgcagtatgtggacatgcgtgtagaaaagcaaaaaaatatggtgactaatgtcttaattataaattaggaccaaggcgccgagggaagaggcaggattgcacggcgccaaagaaggctgctgcttcttgatgcagagagaaaacttatggagtttaaaaattgcatgattaatggaatggtaatgttatctacatctatatgagttgctctttaggattcattctctcaatctttaaagagcttttcggcctaaatttgttgactgagaatgcttcttttgtatcgatgacaaagccactttgatgagtgctccctcttattattattaacttttggattataaatttaataatattggaatgaggggcaccctttacaaatgatgcctctgaatttcttcctttacaggaggaagaggcatgctgtaagttcggattaacactgtacaaccttgatagattatacagagctgttgaatcacatgcagaagaaacaggcgagtggtcaaggtcagtatcaactcatattctttaccatttgattcctggttactctggatgacctttccacaaaatcgtttgtgttgcagattaagagaagacattttggatctggcgaaacctaagatgagtatgacagacaagctggtggttctttcacgactgaagggaacgtatgactgctttccatagccattagggggtgtttgatgcatctgaaatttttcatcatcctttttttttcctcgggtgatgattggtgaacttactgtggttcattttgagacgatgaatgcgcaaatcctgcctaggcattcagtctgatgcacctgctggtaggatttccatgaagattttgataccgaaaatacgatagagaaatggccttgtgccgctcctaatgtctagtacttatttcttatgatgtgaatggatgatctttttgatgagccactggaaataacagtttttactctcatgagctataaagaacaaacggttcgaggtgataagaaaacagaagcagattgtgttgttttgaaacttcattttctgatcatccagatcaaagacatcgttacaggatcagcggaaaatggcattatgtttttttttttgcctgaacatatctaaagtattgaaagaaataaagtttcttgcaatctggttgggccacgtcatccataaaacagggaccgtccgatacaactgctggtaaacgaccaccgtcggatctgataagagaagatttcagaaacaacccttcaagaaacttctctcagcttctagtcctcctatgcctgtgtattttcattttccccctccctctcctgtgtatcgctgcgactcctcgcacgcgtcgcttcgccacctccgcctcttctccttccaccgccaccgctgtcttctcctcccggccctcactgccatcgctgcctcctcctcgtccccagtgccccacagcctccgcctcctcctcctctccctctcctctcctctcatctccgtgtaacactactagatcatagcagaggaagaactagagtaggagaggtgaagaacagaggaggaggagacagagtcgaggaagaaaggggcagagcagagttgagaggagagattcgtttttcctttcttcatttcacacctctctcattacagggttccttacttataaaggtcatacatgccatcctggccgcttggccgaatcacacaacacacatgcgcacacacctacccgacacgttactgtaaacgtcatcctggcgttgtagctcgtcacgcgtgtggcacaggcgtgacagtaccgcccgccggagaaacagcttgtccccaagctggtgctgatggaaagcgggtcttgagcacttcataatcctcccaggtagcctgatgcgccggtaaagaagaccacttaatcaacacctgaacatgtgttgcattgccctttttcacaagccgacgatcgagtatttcttcaggccaaacgtcagcggcatccaaaaccacagggtgaggaagagaagtaaagaccggtgtatgatcaggaacatgtgctttcaactgagagacatgaaagacgggatgaatcaaacttgagtctggtaactgtaaccgataagccgactgaccaattttctccagaatttcaaatgggccaaagaacttgaaagctagtttggggtatggacgattcaccaccgaagattgagtatatggctgcaacttcagaaacacatgatccccaactgcaaaggatcgttcagaccggcctttgtctgcttgatgcttcatgcgcaactgagcccgttgcagttgttgttgtaagaaagcagatagctgattgcgttcagaaacaagatcaaccactgactgatggaccgaggagagaagtactagcacttgactgacatgaggatcagctccaaacaaagctttatgaggagaacaacccaatgcagtgtgaaaagaggtattgtaccagtactctgccaagtgcagccatttgttccacttagttggtgttgcttgagtcatacaacgcaagtacatttcaagacattgattaacacgctcggtctagccgtccgtttgaggatgataagcgaagctcatactcagagtagtgtcccacactttgaacaaatcactccaaaatcggctggtgaaaattttatcccgatctgagatagaatgagggatgccatgtgtcttgaaaactgttttgtcaactgcattggccacttgggaagcagtaaatggatgacgcaagggaataaaatgggcaaacttagtgaatctatccactaccacaagaatgacagtgaatccatcagacttgggaagaccttcgataaaatccattgatatgtccacccaggcttccttaggaattggtaatggtgttaacaagccagggagcttgcagtgttcagacttggcctgctgacaaatctgacactgcttaacaaagttagccacatctgatttcagacctacccaagaaaataacttcttcatcctttgataggtagcagtagtgccagaatgacccccaacaggagaagaatgaaaagcagtaatcaatttcgtttgtaatccaatgttagctccaatccatactcggccatgatgtctgatcaatctatcatgcagagaaaaaccttgtgtattagtagattgaacagccaattcagtcagcaaagtttgagcagcaggatccactgaataagaatttaacacctcctggagccagaggggagaagccactgacagtgcagcacaatgaggtataacaggcatcctggacagcgcatcagcaactatattgtcaactccttttttgtattgaaaagtatattgaaaacccatcaatttagtcatagccttctattgcaaatcagttccaagaacttgatcattcaagtgacatagacttttgtgatcagtgcgaatagtaaaagggcagcgctacaaataacatctccatttgtcaacagccatcattatagccaaaaactctttttcatagatagaaaatttctgattagctggtcccaaagctttgctatagtaagcaatagggtgattcaactggctgagcacagcactaactccataagcacaggcatctgtctccaaaacaaagggaagactgaaattaggtaatgctagcaccggggtagaactcatggctagtttgagctgttgaaaagcttgttgagcagcatctgaccagaggaatgctttcttttttaataacactgtcaaaggtttggctataatgctgtaattcggaacaaatttgcgatagtaacctgtgaggcccagaaaacctctcaactcagttgcagtttgtggaacaggccaagctaacatcgctgcagttttggcaggatcagtactgacacctttagcagaaattatgtggcccaaatactctaattgagcacaagcaaaagagcacttagacattttggcatataactgattctgtcgcaacaacataaacacttgtctcagatgatgtaggtgagaatccaagttagggttgtacactaaaatgtcatccatgaaaaccaatacacatttgcaaataagagatgcaaatactgaattcatcaggcattgaaatgtagatggagcatttattaaaccaaagggcataacgctgaattgaaactgcccatgatgagttttgaaagcggttttaaactcatcctgttccaccatacggatttgatgataaccggctctcaagtccagtttagagaagtattgtgtgcccgctaactcatccaataactcatcaaccactggcattggaaacttactcttaacagtgacagagttgagtttgcgataatccacacaaaaacgccatgtcccatctttctttttgaccaacaagactggggaggcaaaagggctcatgctgggagtaataagaccagaatcaatcatgtccttgacttggcgttcaatctcatccttttgtaaaggagaatacctgtaaggtttactgttgacaggagcagcatcagggtacaaggagatagcataatcaaaagtgcgatgaggaggtaaacacttgggctcttgaaaaacatcagcaaactcagacagtaatggagctactacttctgaaatggactgagaatctgcattgtcagtaggttcaagcaaaacagcatcccaaatatcacaacccttctgccatttcaatatttgagggtaagaaatagcacataattcagtctgggaatcagactcttgaacaccttgcagtgcaatccactgatcttggtagaaaaacttcagagttttagttgcccagttacaagacatatcaccccattgagccaaccaatccatccccaatattgcatcatggccccccaactgaaccactttcagatcataagagaatgtctgaccttggatccaccatgtgaaattaggaaccacatattgacaagagagaaagtcaccattagctacctgaaccaaggaaggggaaatagggcacaactacaaacccaacagctgagcaaaattgagatcaatgaaactatgagagctgccggaatccaccaacatcaacaatactttattctgaaccaatgctctcaaacgaatagcattatggcgagatgcaccagataatgcattcaaagaaatatgatactgctcctcagcatcagaatcttcttcggcaaccactgcattcaaaagatcatctggaataacttcagtgatttgcatagcttttaattaaccagtgatcacacactgatgatcaggtgaatatttatccccacatttaaaacagattccattcgctcttctatattccttcaactgtttagctttccataattcagctctttcaggtttaatggccgatggctcagagataggaacagatgtatccactttagtgccaacccctttgtatgtcaatttcttaagaggtttctgtccactgtctagtaacacactttcttgcactaaagcaattgcagcagcctgctgaacagtgtcaggtaactggaccagcagaactgagcggatttcttcctttagacccagaataaaacgatacagcagcatcatccctcccacagatggatcaaacacacgcacctggtacactagtgaatcaaactgggacttataatcggcaactgaaccagtttgccgtaaggtttgcagcgcctgaactttttcacactgtgcagtactttcaaactcgagagcaaccgcataacaaaattgagaccagtcacaaatctcttctactaacttaaaggattggtaccactatgctgcatttccagacatatgcaagactgctgcagaaaccttaaacatagccggaatctggtacatgtcaaaataggtctcgcacatatctagccaaatacagacatcagagccatcaaaacgaggaaaatccatcttaggcaagcaactcttagcacgaacaccctaatcaaaaccctggctagactccgcttcgttgcgagtaaacacaggatgagtatggaaccttggcggcggcggcggcggcggcggtggtggtggtggtggggaaacacccgcactgccaagagaaaccgcagatggggagcccaaaatactcacttgattggaagacgccaaactcttttgcaactgcgccgcctgaagctgatcttgctgcagcttcccgaccgcctccagagcgagatccaccttgacgacggcgtgatcgagccgccctccgtgtttcgtcatcttgtcgtccatagcctccatcttctgagtgagtaactccaacttctccaacaatttcccctccatcgactcgagcgattggcgtaatggagcgctgagcttgatgggcgtcgtggtgagcgttcgctccaaatccaaccaaacctgaactggacttacagcagccgcacccgagggtagccgtctaccggagcacagggattttaccagtcggatcgagagaatttgaacgcatcaaccacagaaaacccgaatctgataccactgtaacactactagatcatagcaaagggagaactagagcaggagaggtgaacaacagagtaggaggagtcatagtcgagaaagaaaggggcaaaccagagttgttgagaggagagattcgtttttcctttattcatttcacacctctcttcattacagggttccttacttataaagatcatacatgccagcctggccgcttggccgaatcacacaacacacatgcgcacacacccacccgacacgttactgtaaacgtcatcctggcattgtagctcgtcacgcgtgtggcacaggcgtgacatcccgccaccgaaaaaaaaaatgccgccaccccctcctcttcctcatccctatccccaacacaaccacctcctatcagggctggattcggcaattgtggggataatctggattcgagaggcatggctcgacccgacagcgacgcactggtggatcgctgccacctcatcttgcgcatttttccacctgagcgcctttggttccccaggacctcctttgtagcgcctcttctcatcgtcctccaatgacgatggccaagggaaatacaaaaggtccgaggaactgcaccattatgtaagtatctaaaaacctctagcttctcacggtgtttatgttggtgaagcctgtacgatgtgtcctaccacgggcttcacctagcgttaagaagttgaatccatgcatgccctaactgctaaattggaaataacagtacatatcaattaagttttgtaataataatgtaagtagtaaatttagactaaagggtgatcaataagttctataatggagttcttaattaagcctctcatgtaatttcagtttttgagtgtgcaaatttcaattaagagcactataaaaaagaatgcatcctatcaaatgtatgtattgatagttcaggttcattataattataaatatttacacacacaattgtttcaatagctatcaaagatatgtgtgataactaatggatttcaaactagcagaaaaatgatttacaaatggattgaaatagtattttgctccggatgcccgaggtccgactcgctgaatcaagccgacggcagtggctcaccgggagataactaatactaataatcccccccccccaaaaaaaaaaagaagtaatactaactattcatgtatttagaaaaaaaagaaaaggttgcccctaacattatataaatgaatggtgtatttctagatgtgtgtatctatatatgtgtgtctaacgagcaaaagttgtagcaagcagaggagtggaaacctagaaaagatagttctacaaggtgatttgcttaactgtaaataaagtactattaacgatcagatgtatttgactctaagctagcctctggtttgctgtgaagggtgtattcactgattcaataatgatttctgtgaatttatgaagcaaataataaagcaatcaaatatggtattattaagtatctcttgatgttacaagttttaaagcagcaattaaaatgactgcaatattgatttgcattattcgttttcacctgaagtgacattaatgaattaaatggcctttccaaacttgtggtttcactttttgttcgatttactgccgtgcatctaaggcctctatatgaatcatgaacattagtacattttgaatggtaaaaactggataggagttgttgaggaataatgttgtttcatagaacaataaatttatttttgctgactgtgtcataaatcaagtcctttttagttttgctgattgaagttttctatttaacataattgaaattttctactctttcaccacttccgtggtaattattgaacaggaaacagaaagcagcaggaagaacatctcagatggaaagcttcaatgtgttcttaattatgctttcgtttggtcaagagctttattccctgagcctcttaatacattacaaccagttctcaactggaaattaaactgttacaaacggataaagatggtctgttcatgctccagttaaattcatatcaaatcattgttagcatacagtgacgtttcaagtggatttacaatttagtgaggtggcgtgaatgcatggccttaaaatgtcttgatttgtgggaaatactttcatgaggcaaagttactgatcttgcaatctatagaagctttaaagtttgcatccaacctgttttgactggatggaagaaaaactaaaagtgtaatggcccctctatatttgaattggtttcagatttaataaatgccaatatatttgtagaagaatgtgtttgtttttattgtgagaatttctgctaatgaaaaacatttaaagttggctctgtatgcaaataatgatcatatatatttcagttgttttcacttttatctatatggtaggtcagagctggagtacagtataattttgactaaactataccgagtgttaaataatcaatatgatgttatcagctatataaaaatatcaaaataaaattgaatgtacatactgagatatataaaaaggtaaccatagatgtctgctcatggtcacgcaaggcgtgacttaaatggctagtctaaacttgattcatggacccggcacttaatattatgaattttttctctctttgtttaaattctcgttcttcagcttcgaaacaggtaaaataaccagtctctcaactcccagaacggtaaaactcgtccacttcaaaaaaaaaaaaaagggggaacggtaaaactcttaaagccttgaatggtaggacatcgtacgggaaactacaatgaaacaaacaagctaggaagagaaaaatatacttcccgatcaaaagcatactatcacgaattcgaaaacttttggagaaattcaaatttgaaatgaacaaaccataaaaaaaatcctacaaatacgattatattgatagtaaaaattttcaaaaagaaatattgaatttacccatcgtttttgaatggaacagatgggaacaatatgtgaaaatgagaaaaaaatgcctaatgggctgacgactcaataagcccaaaacacacgcgagtccaaagcatcacagcacgagccgtcgcggcgtctccggccgccgccgcagccgccgccgccgtagcacatctcccgctcgctggagtatggctgcttcgccgcctccgcggagccctagctccggcgatccggctgaggccgccgacctggccgcctccgccgccgccgctctagcatctcccgctcgcgtatggagctccctcctcgcccgccttccctcgctctcggactactcccgcctcctctccgtaggccgcggccgcggccgccgacggcgtcgcgccgctctcccgctccccattcggcctgccgccgcccactccgcccggtgaggaatcccctcggctcctatgcttcttatgcttcgcaggcttttcatggagtagtgtagtaactagtaccattaccatgtacttgtgattcgtggattggtggacatgacaggtaaaacaaattggggcgaattctcggttagcaggtggtgtatgtggaactcgtactaatgtgtttcgatgttgatcactgcttgcagtatgtgctaatgtgcatcagtttttcttctactatattcgatgcatcttgttatgtggctggttcatgtaatgcattactgatttttcacatgccattgattattggtgtgcacagagttacttggatatgtttctgactatatgttattcgcaggattgccggtcagatgcccaaagcttttgacatcctacaagatgttgcgcaacacactctgtctaatttgcatgatatccagaagagcttaatattttggcagtccaaagcagaggtataaagttgattcataaaaattgaagtgcttctacacttttaatatgtagagaagtccactacttactcatcttccgttgtcctatgctattttctccagggaacaagttcacagaaactgtattttatgatctttgaaagaggtccaagggcctttgtcgaagcagcatggcaaacactgactagactcaagagcaatgggagtccagtcccgcaccttttgcactctgcttctgatatggtctcaacaaaacttgctgtcctgacaagtatgcaacactgcttggctgcttttcttgctgaggtttgtttaatcaaatgcgattatcaatatcaaatgctgatgtcaagtagaataaattgttctttacaatagtttcaatatcaactttgaagcagctcccctatcaactggtgtactatggtgtccaaattattcaagctcttctttttaatactttggataaatttacttatagaacatggctactgtttctcatacatgaattcgaattctaccttgcctcttctataggtttactttgaagttgataagtgcagaaaaggactaacagaaagttcagataaatcgctacatactctattcattgttctgaattctgtcttctccaaattggaggtatcatttagaaatgctgttgaggtatgcaatgttctttttgcatgttttggatgttacaagtatgacatgctagctatttcacatagtttcatttcttcagggacaaactctattatgcacacatgatgggaagtcgcctgaacttatctttgaaagattgccagaagttgatgttgagagttcagagtggacagaggtgttatcagcaaatgctataacattgatctaccaaaacctccagaagttcgatgattttatttctgatcaggtaatcaactctcctttttacaacaagacacatgccatattgttacttctcagccttgcgggttccacattaatgctaaccgagttggtgaaggcgtattgagggagcatttctatagatcaccctctatggctgtacctgtttgtgcttcctgtagaaaatatttgtgtttacacaacttagcaactaatttctgtccatgcaatgtgaatgctttcagtctagaaactagtggtagaagtatagatataatgcaagacacaacggtagttgattctaactgacaactcttttatcataataaccgtgtggataagaaggttaatctgttgaaacaccaaatattctcaaagtactagtttagcattgtccagtgaatcttttctttttcttttttgcaaaagttagttcccttttcactgaaattacacatgtttaacttcataccactgaaatattgctgttaacttttattttcaccgcgatgttactccattaactgctattatcaccttaaatccttccttttcctcttctcaatttcctttctaccctcgttttctcctgacctgatcttcaccctcctctgttgacgtggtgccaccacctaacgccatctctgcctggtctcggcatgaatctgtgtgtggtgttttagttgtatatgcccatccaccaccatctccaggactccgcatcaattttgcttcgacactggcaatgtggacataccacagaggcatgcgttccttcagctttagcaaggagataccagcaagacattcacctgctcctgctgcaacaaggatatggatgtgggtaatgagagcttgctgattgttaccccttgttgccgtgttgctgtctcttgccagcgagtgaatgagggttcagttcctttatgcttcttccttcttgagcttgacctgggccgtgtcctttatcatgcgtgccatgcctctcgctgactggcatgtgcactgcttgctgccttcttctctactctcacacagggtaaatacgaaagtacacgtgtcttttgcctaaaaaaaagtaaaaacaaattataattgttatatagaagtgaacaatgcaaagttttagtggtatagaagttaacggtgagatttctatagcataactctgagctggtgcggttttggtgatatgaaaccaattcttttggttaaatattttcaacttattctgttattaccgtaataaacaattgagttaatctgtaattcttacttggaataagtgaggattgttcacttttgaaaatataaatttgctactgttcgcagaagttagaagtatgtatatgtgttacagttccattatgtgaagcaatatgttgcataattatctcaagcatattttttttctattgtagttttcgaaccacaaaagaccaagaaatacgaccatatattggttgccctacacatgtggagcattgggcctctctgcatgttctttatggcttttgcgccacagtagcttgatgggaagttctgacattgacaactggattcaagatgcaaaagaatcgatggttggtttttgggatgtgcatgttgggcaaccagtaagatactttctggatatgtccttttattgtgtaccatatgcatgatgctagcattagttaactaaagtcgaattgagttactttagggctcattttgataggtgtagtttatgtccaatcccttcaagttggcaaggaatttgaactaaaatctccaccaagggatgaggtctaatccccctatatgcagtatgtgagggtagagatatcagataatcacattaaccagtatagataattatattggaagacatacaagatgttctatgaaatactgtatcccaatatttatctgttaaaaatgaaaagcagattactgcttaattagcaagtgtggtatgctgttttgtgtactattagctgtgcttttgtgtcaatgttaaaaaatcgacttgcctttaccggatgacttcacttattagttattaccatcaacaatcttaaggcaattagtatatccaggttaagaaacttgttaatatgcaccttcatcagcatgcacatttcatcagtgcactaaattctgctcattcaactcctatgtgtgtccataacattttttacagaactcctgcaattatgcttgatttggctgataacttataattgaccttactatgtcaacaaaaagaatgcatccctctgtgactgtgtccagctaaactcgatgttctttgtacttttcaaatttagaaatcatctatattactaagctctatcatgacctcattcttctctttgagaatcattagatcatttccatcagggatgaactttttgagacattcaaacaaagatctaaacatgaaatggaaaaacaagaggtccaacaaactgaagaatcattgcgcaggttattccaatgatgcccatgctcttttgtaaagcttacacatgcatgcttccttactcaaaacttagtaaagtattgttctgaattaggcttttctccttcaaacctacacgtgcctttctccttaccaaaactttttatagaagtgttctaagttaatatccatttgatatggcctaagtttcacctccttacccaaacaagatgacatgtatctgcagtttcaagattttacaatgactatatatggttcagtaatgtaccagacatccatgccatttgaattatatgcgcccttttactttcttggaagtgttcctgtatgaaattgtgggttaaaattaggttttgcttcttgtgccttttttatatatctcaggtaatatcgatctgttgactgttgagattgactaattttcgttagtaatcaacaaaaagggcttcatctcataacctacatcctgtttcttgcttgcttccttctttttttttctttttttctttttttgccttttctagtcccttgacaatattcatcaccctggagctatgtactttattcccacattttcttggaactatgtaaaatttcaggtttgcattgcatttattttctgaaacacattgagtattataaaatggtcttgcattatctcaccgtacatgttacatgttgcctttgtaggatgttgcttgacttttgtgggaacacttcaaatgaaaaaccgccacaagatatgtcagagctagcaatgatggagattgtcatgaagaggtaagagtgtttgaatatttatggtgtcttggctttgacagtcatagcttatttcaaggggaaaatttgcacgctcaaaagtcacctggaattattttgcttttgtatcggaatctattgacaagaaaaaatttgtgtttgtcaagtaccattttttaatttttgtttgtttcgaaactaaattaattcagttggtactggggacagaccttgtcttttttttttttggtggaatgaccaaaggaggtcattcaatgtaattaagataggaagaaaaagttacagaccttgtaatgaaaaactaaatattagtgattctcataaggctgtacataagtgcatcccttgatacctccgaggggtataagtttcgtttgaaaaaagtagaaacgaaccccacccaacactaacacgtaacaccccttactctatacttttctaacaaactacatatcttattccaaactaaactgataccttcctaactaatagatatgatagcaaataagtactctctattattgcaaactaccgaatttatttgggcaataggcgttattattgtgtaaggtttaccctttcctagtcatactgctgcagtattgcttgctgaaaaactgacgcgcgttccagctgtggtcacaaaaagcttttgaacttccattttattttctctgcctggtttcacagtgtaggctggtagcaactggttacccatagttactggccagtaggtttttctctgctggttactagttaccactcggtggtacttgccagtaactaaagcctgtgagaccaaaaaaggcatagcacatctttggctttccaactgtaattttctcaaggatttctctcttttgtttcagtaaaggtttataacctgttggtgaaataatggtactatttagagttaaaacttcaagatgggtttgactcagttccaaagtgggctgaatcaatattttcttagtcaaaaataaattttaaaatgatttgatcttgatgtgcataacagttaagttcgtgttgtagaattctaatctatgtctcatcttgcattaaaaatgatgaatttttgttaacaatcctaagtttagtatctttgagtttctgccatgatcgatgaattaataactttctaaattctaatattagacacaagcttcaggaagttaagaatcatttgtatagttgcttctatgactccttggagtgacttgttgcatggcttatgtcaatagaatctgaacttctgcaggagactttttgtgtattacatgctttgtatgcacttatgttgcttacataacttaatgggcacttcacattttatccttatttatctgatacctaaatttctatgcttttgacgatcactcaatggactaaattgatggagcttcttttgttaaaaaatgaaaactaaactagctgtttacattttactgactcaagcaatgaacaatgacacttctctaatatgttgatacagatatgagaaggaagcaatgcatccatttaaaggtctttccagtggaaaattaacatgtgcattgtctattcaggttcttccccttctatctctatttaggatgcactcagttcaagttaacctgcattttttctaacattctgatcctaaaaattcagattgagaagcataaactggctcttctggagtaagttatactaatgtattctgacaatactgcttaaaatgcatgatgataaattttttatgtctaatattaaactgcaagagatgattgaattgtttttacacagggcaatgctggagctggaccagatccttagggcaaatgagataaactttgctattcttgcagcactacctgcatttggtgtttcacttctgctgctctttgcagttcgagcatgggctacacatgtatgtataaccatatagacccattgctgtcttattcaggggcatctagcacaaatagggaagattttcactactttctttttgaaaaaaaatacaaattgatccctagcaaaacatttttgcagaaatggaactttctgcactacaccgtgatattaagcactatatattcgtagcatgggatctcaggattcggggctgtgtaaactaccacataggatggtccctagatatgctagagttctacaaaacatcccatgtggtagtatacaccgtgtcatgtacgtaaacaactaatgtcatggctctgatctatttttagcaaagtttcatgaaaggtctatttgtaataatattttctaaaaggggacaaattgtgaaaacactatccgcaactagcaggagatataatcttgatatattatatcccagtggtttgcagttttcaccatggacaagtgtgcatgaaaaagataataggaatactaggttcagatatggttaattattgtcctcactatgaaatagggccgtggtgctgagggaagaggtaggactgcacggcgtcagcgaaggctgcttcttgctgatgtagagaaaaggcttatggagtttcagaattgcatggctaatggaatggtaaccttatcattatcttaaattagactacatgaccttatcttgatcttaaattagactacattgacatttatttggatgagggacaaaatacttgatctggtttcctgttggtggctattcccttctctaagaaatactaccttcgttttttaataaataacaccgttgactttcagaattacgtttgatcatttgtcttattaattaaaaaaactagtgtaaatatactaaagtacaagtcatatttaaagtttctttaatgataaaacatgtcacagcaaaacaaatgacatttgtataaatttttttaataggatgaatggttaaatgtcatgtcataagtcaacaacttgaaaaaacagagggagtatataacgctttcctattgtattttgtctgcaaaaaccttattccttcacctagtatgagaaaacaagaaactgccattttcaagattggacatccccaccttcgtcttgaaaatccaagattgaagtgctttcgtattgatgagaaagtcattttctttcgactttcgaattacaaacttgaaaaatattaggattacaatacgtactaataaatgtctggctgaatttcctaattttacaggaggaagaggcatgctgtaagttcgggttaacactgtacacccttgatagactatacaaagctgttgaatcgcaggcgagagaaacaggagagtggtcaaggtgagtctcaaactcatagctctttttgatacttcccttggctacctaggtttgattgcctgtgaaccaaaaaaatcgttttccgattgcagcttgagagaagacatgtttgatctggcaaagcctggtgtgggcatggaagacaagctggttctgctgtcccggctcaaagggatgtacgactgcttacttccatcaccgtcaggtgtcttgccccgtctgtagtcttctcatcttcctttcctttccttttcttcttttctttttggtcacgtgtgacgattagtgaaccccaatcttagacgacatgaatttgcttggcgttttaagagtcgtcaaattttgaattttttatgccccgggtactttgattgtagccctttcggctccatggagtgatgatggcttttgtgctgctgcaatgtttgcaccagagattactgactgtaaatccaaaatctcttctaactggatgcttaattcatgtgccacacccattttacatttgtttctcatcattgaagcacatcgaaatttagggtggggatcctctaccataatatcactatcattataagtcacttggtatgtgggtctcattctcctattgtcctacacataagtgtctataattggagtgccactatggtagaggatgtaaaccctgaaatttggccctggaaagcgtgaatgtgtccagatactccatgttactagtatttcgtagtatatgttagctgtgatctaaggttgtgttttttcctccaacttcaatgaacgatatgttttttcacaaattttctataggaaagttgtttaaaaaaatcacattaatctatttttcaaaaaaagttaatacttaattaatcatgtgctaataaatcgtttcgttttatgtgcgcgtgagatgggttctcaactcattgggaagaacatagcctaaatccacactgcaacttccatttttagttagtacgcttttcaaactatattaaaatagtatattttttcttaaaaaatgtttctaaaaagctcattttaaagtgagtaataattaatactccatccccaaaatatatgacactgttattttttattttttcataaaaaatatagtataaatatgtaaaagtataagttaagaaattgtagattacagtttcttttgatgataaaacaggtaaaaaaattattcagatggtttttgaaaaaaaagagactaacatccattttcattttccatgacggagataagaaaatactactaataacctttcatcaaaagattagtttatgaaaaaaaaatgctatctgtaaattagcccttaaagaaagaagcacctcgacattccttctatttactttatacttaaacaaagggaaagcattgcatacttacatttgcatgcgagtatatacatagatagcacggcaaaatcctagttaatccagatcaccctttcttaaatttgagaggagttattaattaatccacatcatctatgagcacacgcggaagaggaggaatcggatccgtgccgcgttgctccgggccctcgccgtcatcgtgggcccggcccatgaccagcacgctcagcaccacgcgccttcccctcatcaccaccctctccccatgcaccatcgccaccaccaccttcttcttctccggctccgccgccgtcgccggcggcatctcgtgccggcacagcgggcagctgccgtggatccccagccaccgctccacgcactcgccgtggaaccggtgcccgcacggcatctccttcctcctcccgctcccgcacgtctccctggactcctccccgtcgtcgaggcagatcgcgcagtcggacgcctcctcgccgtcgtcatcctcctcctcgacctccctcagcgccgcgatcgatgccctggacgccggggccacgccgccgccaccgtcggcgctggcgctgccgtcctcgtagaagacgtggtgcaccaggtacgcccgcccccgcagctccggcgccgacgagacggacgccccgacgagcaccggcggcacgcccgccaccgtccgcccgctgtccctgtccgtcaccggcgtcacgatcgacaccatcgacgagggagcattggtgagcgacattacccgatctcttcaatttcctcttaataattcttcgcgatgcttttgctaccatctgcctcgctctcgctatcgttctcgctcgatttgatatagaggaggaaaagacgccttctcgatgatcggtggattgggttgatgatgcgcatggcgccaaagggttcgaggtaggtgagccttttttttcttttttgtctcacaattttgcagctccgacaaagcggtggcgatcgattgggatttgggctccacatgtgcacttcgtcttcttgcagcaacacaaggtccatcacttcaattttggatgcatgctgattttgcttggattcaggctgaatttggtttgtttggacaccagaaatgtccttttttgactaggaaggttgttgctgttcttgacatcccagtgcaaaaggggtttgatgattcacaattttggaatgttcttggaagatctctttgatgattgacaattttggggtgttcttggaagatttctcatggtggagccatgtgcgcagaaactcagcaaaaaggcagacctgtgaatttgttgatatatactggattgttattgacatttttgaccttttgtaactatgcaaaatactacaggtcaacataaactgtgacgtactctacaatttaaaaatgctttctggagaaatttaaacacagaaaagaatcacatatcagattgatgaaacggcagcagatttgacttgatttgtcagaagcagcaatgatcaggtagagtgccaacgcaattcagccccagaagaaagaaggctaatccttggagatagagatttatgtagaagctgttctttccatggaagacaaggttgtaggatgcacaaaagatgaggaacaccgataatccgatctcaggtagattcactctgcagcaaatgacaatgtcaggttaagcatgcatgcagaactccagcacctaccactaccagcttatctaaagattgcagtagcaaattggagaaataaattttacctgtttattaaccttttcctggatttttgaagcaatggagtctcattattctcgtcgaaggcattgttccccactttcttcgtcacaatccattggttgaattcttgcagttgcagcagaccagctacagcagctctcaaccgatgcatggacatgacgctctcgaataaaatccacagtggcactgtgtgcagatttctggagtgaaaagacagttatggcaaatcaaattcatccaaaagggtaaagcgatgaacaaactgtttgagaattgtaacaaagattgtaagagagaactgactctggatttcttatggcagtgacaatcaggagtgctgtaggaatgtaggcaacgccccagattggcaggaagagctctgggatcatgaccgacacagggatgataacattgtagagaataaaggcaacagcaggggcaacaactctcctcaccaggaagaagctatacagtatgtagatcttcttcaaggatgacactttctgacggagcaacagtggcaggttatgttttatgcagatttacttgttctggttcatcaaaaaaggagaagaaatggtaccttggcaaccaagacatcccatatcatctttcggaacaagtttgcaccgccacaagaccaccggaactgttgtcggcagtatgctttataagtggatggaagctcactctttacctgtgacgtatttgctttatcagatgctatcgtcgagtgattgaacagaacaaattaaggattcggtcttcttactctgaggtcccctaaatagatgaatttccatccctttaaggttgctcggacagccaagtccatgtcttcaactgtagttcgatccttccaacctcctgcgtcattgatagcttctgtgcgccatacaccagcggtccctaacaaggtaccagtgtttaggagactatcaccatgttccttttgtgatctacataaaacatgaacagtcgaggtgtgcaccattgaaactgaagaaagcaaatgtagccgatcctgcctcctgctcagctttgaagtggtaatcaaggaatgtcttctgtatccttgtcagtaggcttactctgtcattcactgtaaaattcggtcaactaaaaattggacagatcagaataaataaaattgctatatcagagttcaatgatgtgatattatctacagaaccatttgtttcgatctttgtcttttgtaacaccacaagaatcaagagctaacagaaggccacttcaaatgcaaaattttggtcaccttaccaatatatactgaatacttcccgctagcaagaactgcaaaaggtagtctcaatgacatatcaaaagatgaggtcttaccaaaaacccaccgagcttgtacaagcgcaacattctgattgtgcatgaggaacgggacagttctgagaaggaaatccggttctggctggaaatcagcatcaaatatggcaacatattcgcattgcttggcatagtcccactccattcccttcttcaaggctcctgctttgaaccctttgcggccacttctggtggcatacttaatgtttagacctttgcttgcccaatcctcacattccagctcaaccaaattctgcaaattaagtaaattcttgttcattttcattacattttcacaaggtagatgattaatttattgcccttctgtgttaacaaagtgctagggactgcaaatatatgcacactaaaatgacatgtacagatgtactaaggacgactagaggttgagttgggtaatttataacttttcagcttggataagaaaatatttacacatgccagtcaaaggtgacatcattcagttcaccagatgccaaatgctgagatatcccgaccgcaactgccttttatccaactacaactgcctttttacacaaaaagtaagccacaaaggtaattgatgtaaatagtagtttgtcaaataggatgtctcatgcaagtaaattactatttaagattaagtacttattgtctagacaaggatacttgaatcagctaatacttctttacatgaaactaaccatttatgacagtgatcatgttttttacagctacagggtatgtcgtcatccttttctttaaaaggtaatgatcaatgacgtgcatttcatttttcttagagaagggtttttttttttacctggcctctacatccaaccagatatatgcaaccttacaaattgagaacttagcccctcgaataacccaatctgaaattcgctcttatggagatttaaactcaggactttaggatgctacttaggtcactgtaaccactagactacatgctcttttactgtaatcacgtgcatttcatatggtccaggcacatgacttagctttcagtcctaggacctaagacagttaactacttaaggttaggttcctatgacgaaacttagttgcttttgctcctttttatactgatagtgatatatgaaagtgaaaagcaatgtcatccttatgtacaactaatccaactcattactcttcagtcttcacacaggaacaatgctaactcgttaagctaacatacagaaaaagtgataatctacactaattacagattttcagaggtctaagctcctgacgaaaaaaaaacccggagtttggacatctcaatcatatcattcagccagaaacttgcctaacaataagaaaaaggagagataccttgataaatgcgtccgtggaatcatccaaaacttggattatcaacctctcctttggccacttgagcccacaaactgctccgattgacaacttgtacacctacacccaagaatccaaaacatttgaattcggccgtatttgtgtctaatttgaatcttgttgaattgattggttattacctcgagctcattatacatgggtatctggaccatgaccatgggataagcagcagcagcagcctcccccttctcctcgtcgccggcgccggcgccgccgccgaggggctcccacttgaaccaccgctccggcctccagccgacgagcctggcggcgacgctgacggcggagttgtaggtggcctccaccaccagcatcaccgacatcaccatgcacgcccacaccccgacctgcagcgccggcgccaccgcgcgcgaccgcgcccccacccacgcctcgcgccaccacgcgccgccgccgctccccggcgacgtcgacgatccctcgccgacgactgggaacgtaccacgacaagagctcagctcactgaaagcaagaagctaattaacttggatgggaaaataaaaatggaaagaaaatcttggaacctgtgacgaggtaggtgaagtcgagggcgccggtggagacggcggcgaggagggagacggcggcggcgaggaggaagaggacggcgccggctgcctcgccggcctccattgtttctccgggcggtggcggctgccgtggcctctggagagagagaggagaggagagtgatgtacaacgcaggctgagctgagctgagctgagcagttggatttttatcgctcagctctcggggggcacgtggacgggacagcgacacggcggggccattatattgggtctcaatgccaatattttgcgcttaatagtttagggatatttaccattttcgttaattgcttattaaatcaaaaaccgtcctaaaaaaacgagagaggatgataatagtgatatggtgatggactggtggattcatttgatttgttgcattctgggtaaggacaaggaaagattcatattcagcttaatttgtcaaaatgttgagaattaaagcactatagtttaaattatatctatgagtatattatacacttatgagtgtcctttcaaggattcaaatcgatttccataagattaaacacacaaaattgcgttcccaatagtttagtgcacaatatgttggagatggatttttatccctcgaggaaatatcctcttgttttgtgtctgttatttaaaaaatcatcaaaaatttgaaaataaattatgaagataaatcaatatatgaaatacctttccacaaacatacatgttaaaatttgaaatataagattcgaaacaaaaataataaatttgactgcggttacgcgttctattcatagtcaaatttgttattttgttttttcttgtataagttgaatttgaacgtgcatgtttgtgaagtgacatatcacatattgatctatcttactatttttttctattttttatgacttttaagttacataaaaaaaataaggggatattcccttaagaaatgaatagagtttccccaattgttactagttgtgagtagagcagggtcgcggctctaggctaaggccggttgtgggatcgcctaaggcacaaaccaaagggaacctcagccctcaaatcaaatcgatatcgtgccaaaaaaggcgtgcggacagccatgtttagaagggcaatttaatttgatgatctagggtgtcaagcgtgttgagtattttagatctttcagttgaggcattgagccattgaatatctcgggcatcatgtccgtcggtttgtcctcgatctggcggttgtgacacatgtgtagtttatgttacagttaaaaagaaaagccttacgagcctatagtgtcgaactatcaaatttacctaggccctcgaaattgtagagccgatccgatagtaaatgtgatggttaatataactgtgtgagtgtgggttggttatgtataatattttatccatgctttttttttagggaatccatgctcttttttttttggcattgcacaggtgcaaatatcataataaaaaggaaaataaatcagttcgggtggtatggtgatttggagagagagagcaatgtgctggaaagatggtgagtcaccagtcaaatgtcatatgtggctgtgtcatatgagattgaagcttgcccattgcatgatgagctaagaattaaaatttcctgcgagaaacatcctgagagagaacacctgtcacccggaaagattagtttagatcgcccccatttgcatagtactagtatatagtactatgagccaaaattagtaggtcacgatggaaaacgttacaatatttcagagaaacaacctaactaaagttttacttgtttctcttgccttcttctcagatcgatcaatctattatatctatttaccagagtgttgcacaccggctgaccgatttgctgtgtaattatctatggtactatgcgccacgtggataaattaaatgctgtcgaatttaagctgcaaatcctaacaagttagtggtggcagttgagctctcatccatgcctagaaaatccaggtgtacaactttagcggacagagatttgatagcaggggacgaaagaagaagaagaagaagaacaagttgcaatttgcatcatgcatgtaatcatcatacgtgtgcctgaattttgaacgagatgatgatcgagcttgaagaaccagcctaaaattaaatgaaacctatgcaggattaaccaaataatccaagtggcgagagctagctagcttagggcggaggtggagtggagtatgggagggccgatcgaggggctgcccacgaatccggtcaaacaaaattttgtagccatatcttacttattttcaccatatatacaccctctcaatacaaacttatacatccacatctgcttaaatttgatctaaagtaaattaagcaagtgttactctctatttcgttctagctccgcccttaaatttacagcgcgccaaatctaatggtccaacaataattaactaattaagctggctgatctcggccgtatcatatgtgtgttttgctgggtaaatcatcgatgcatgcgcgcgactgcatatatatgcagggatttggagaaaacaaaaaggaaatgtccagctcgatataaagtgtgcaatttaattgtcctgctctattctatcataaatatttgacaatcagaataaattttgataaatagtttctcaaatgcttagtgtaaaacacaaacaaaatagtatacctacatttgcattgaaaaataatattatatatcatgaacttattggattttataaacttatactgatatataaaattaatggtcaaaaatttgaaaaaaatggatcagacattgcttaaatatttataactgggtaaagtatctgttttcctataaagcgatgacatgtatgatatgtaccgtttcttccttggactcctcgatctattctactacttcacttacatataaatcatcttatcaatcaagttgaatgaaaatatgtcaagttcattttttttggctaaggttaaaatggctgaaatgcatctttataggtggaagtagcaactccttgcgctaggtgtatgtaaaaattgaggttttcctaggcgatcaacacaactgcaagtgaaaaataagatttttgcatgtggcacatcacgatgcttgcctgtaaaaagaatttttagccaaaaagaaaatttttgaaaccctagcttggtagcggtcgtcgttcccatgcccagggtcgttgtcaccgctgcccctaaggtcaccacaatctttagtcaccactcaccgctcctgaggcaggcagcattcgatccgcactcctaaggctaccgtagtcgttagtcgatcctcccatgcatggcggatccaccactcccaaggccagcggcggtaggtccgcactcccgaggccattgcggtcgtcgttgccactcccatgcctggtggcagtaaatctgctattgaggtcggcggcggtagatccgttctcttgaggccgttgcagtcatcattgctgctcccatgccgcccggtggcgacaaatccattctcctaaggcttctacagtcgtcgttgctgctcccatatgcccggtggcggcgacaaatccattctcctgaggctgctacagtcgtcattgctgctcccatatgcccggcgatggcggatccatgcgctaagtatggggagaagcgatggaagggagaggtcaccggtggatccgcttctcctgttgctaccgacggatccacatacctcgagtctaccgtcattgtcgtggtcccacttagccgatgtttcgcccctccccaccgtcgtcgtggtcaccctagcaaccatcacggcatcgccccttcccgcacgaggcaaatctgacgcctccaccaccactcatcccaccccttcgccgctatcggatccggttaccaaccgtcgaggagaggagataaagggaggagaggccgaaaggaggataggtgaagtaatagggaggatggaaaaggaattaacgcatgggaggagagaaaaggagagggagcgggactacgaaaataaaccatgtaggtaggttttttattgggccccctcctattttttctacattttacatactagtaagcatgcacgtgaaatccacgtgactaaatatttaataaattatcataactcaaagattgacaacaattgcatgtacaggttcagaagcaacaaatatcccctttactgatcaatacatatcctcaaatttgacaagcaaaatatgattgttaaagatcatattatgaaattcacatagcacatgccaaaatcaggagataatatagcaaatcttgagactttggatgctcaaacacagccaatgtaagatgcttgtttggttcaaaaaattaaactacaaacactaatgtgcagaatgacaggactaggccatcttgtaaacaactcttctaactcgaacacctcaacataattcaggaagaacacaagaaatagggcaaccaatttagattacaatgctccaatccaacaggattgagccgccgccgccatcgccaccaagttgcccgttctgagttttaattcagttcattacattgcttatgtctgaatctcacccactcactcgttctttcccctcacacacgccaattcacacagctttcaacagcacacttacatggcccaatcaggcccataattacgaggattcgccttggcctgtctagccggacgccgagtctgaattgggtccttcaggctggacggcctcccctgtagcccatccgatacgcctccttgttcagcagtatcatccccttctggtacatcatcagtgctcctggcacatctgcagtttggtaataagctcataaacatcccactacttgaactcacattatgttcatatcaatttgaaacatctttggggatacaataactgacgggtctgcactttaaagttctgaaagaaaacttgatccaagacagaagacatggagatatgtcagtgttaacctgttggtaagatctgtgtagggaagagacctgaaagatggaaaaagacctgaaaggaagtgaattgaagtggcctgtatacaattcgctggtgttttttgcagggataatgcttaccaggctgtgcaaaggcagacgatggtgcaggtccaatggaaggcatgagcgtgggtcagtcggcggcaggagcgcggttgccagcctaggaaaaggcaaggggtcagtcggcggcagcgttcaggcagggcaatggcgaggagaggcgacgccggcgggagcgcgcgcggttgccggtggagagaaggcgaggggtcagtcgatggcagcggtgttcaggcgaagtgatcgcgatggcgagataggctgggtgcaggcggagtgcggttaccggtcgaggtcaagggaaggcggaggcacggagggcaggcgtgttatcgatcgagaggtgaggcggaggcggagcacgtgggctaggggtcgtgggactgaaggaggattgcgtgtttccttcggaaaatccaagacttaatcccgtgcgttaattcgagtggatcggacggataggaaagacctgtggggggtagtccaagttgctcattgtagtatagacggttctttttaaccttgcctaaaaactgagggtgtatgaaaaatcatttctttacattcctctaactgtactacttatgccaacgttaatcaaatacagcctctgcaggtcatgaccttcctgttgttatcctcagaaaaaaactccataaatggggccgcatcagttctacatggatcgccacatcgatcgatcacacaaaccaaacgccgccgagcacgcgcgcgtcgatcgtcaaccgatcgatcggctacttcactgcgcggttaaaaaagaagagggagagcgatcgatctgctcgatggggaaactaattaaccgagctgtatcgatctcggcattgatcggcaaacatgaatgatcagatacgcgtgtggtgagcttgcatttccgtcattaacttcttgttgtctcctgcgaacgaacgaacgggatcccaaattcggcaggggggggcgccgccatggatactgtcgagatatgcatgcggctatagtaaggaaacaaaatcccgtgtcgattatattccggggggcaaattaattctctcgatctctgggttggcaatgcagtttttatgttcgtgagatctttttcacttgggtttgttggcatgtgattatgttcgtgatctctctagctatctgtgtgctagctatagcgaattaagagccgagattcataattaattaatttagctagtagagcatccccataggtttggatgtatttttggagcattgcatgcataggttgtgaatttggtggcggttttgttgtcagatggactcctaaacaggatagagtttaatttatgcgttgtggagattttcagattatagcattaatttgtccccatttatcagttttttttatgaggataacaacgttggctcatgaactgtagaggctgtatttgatttacgttggcatgagtagagagttagcacaatgtaaagaaatgatttttcatacaccctcagttttttggcaaggttaaaaagaaccgtctatactacaatggagcaacttggactaccccccacaggtctttcctatccgtccgatccactcgaattaacgcacgggattaagtcttggattttccgaaggaaacacgcaatcctccttcagtcccacgacccctagcccacgtgctccggctccgcctcacctttcgatcgataacacgcctgccctccgtgccttcgatttcccttgacctggaccggtaaccgcan

SEQ ID NO: 6423 - DNA, 24855 bp, Oryza sativa
  unsure (1)..(24855): unsure at all n locations
ggttactaaaagggcttaagactctcccaagaggaccaaggttccactctatcctctattccacgcgagtcccccaatgccctgggtggcccccaaagtcaaaactcattgggtccttggagaagtgggccctgggtaagttagttctaccaattcagtgattccaccacttcctaccctcccatccgtctcttcctttactgtcctattggacattccttccgtctttttcaaattcattaagagtattaannnntccgccgctgctgccgtctcacgtggccggcgtgcgctacggccaccaacaccaacaacaacagcagcaatacgtacgtgaaaatcaaggaattttttcttacatcatccaatcaaaaccctagctgacgatgatattggtatttatatgtgcaggttggaaatggagcagcagcgcgaacaagagatcaccatttcactccgtattattacggctcatcgccactgcagaagcagcagcattacactactactcctaatgatgctttgaccaggcacgtgcctagcttaattttgccttttgatactgacaaagtcagagcaaaatcttacttcctactcgtcctgacctagcctccattttaccctctgctaatcactaaattttcttaattctgcgtgtttaattgtgttattagcaggctattacttgcatcaaacagcagcagcagcagcagccaagcttatttccaacgtcagatcaatcaggatgcttcaggcaagtgcgtcgtgaacgcgtcccctctcctaagacagcaacagggttcatctgatcaggtatatatatgtgtacttgtgcaattgcgcgagaaattctgctagttaattagttactagatagtagcaatataatataatagttaatttgctgctacagttgttacatatatactgtagcagtatataacgtaaaagttacagttttgtaataatttttcacactattgctgaagcaaactaaaacatatcgctaaaattgcagtaaacgaatagtttttttaaattgcagttttctgaaatttactctataatataattgacactgctctaatgatatatatgcaggagctatacaggatgcagctgcaggattatcgccgccgtcgagcgcagccgcagatggagctgcacggcgagacgactgcggcggcgagtagatctcagagtattattccgtttgtgaacctcgtcgacgacgacgacgacgaggaggctgctgccggcgacggcgccgggaaagaattggacttggagctcaggctctagacaaccacgcgatcaaatcaaccatttgtggatccgcacattgctgtcagattgttgagatttaaactgaaacgaacagattctttgttctttgcatagaaagttcagttgtactagcatttgggggtaacttattaccccggagacgccctctttcttcaatatatatattccaaaatttccaattcagtggtataaatttgcaactcaaaagattggaacgttgagttcagtagtaatttatttatactctgaattcatagtcgctcagaattcagaaacacttctgatttctcatttctgtattgaaaaactctaagcttacgtaattacgtttcggtttaaagtttacgtaaagttggagggcgcctccacccccgccgtccaagtgccagcctgtactataaaaacgcccctccctggaaatttaaaaatccattaataattaataaaaaataaagctcgtcgtcgtcgccgtctccctcgccgccgacgagtcaaagaggcggcggcggtgccggtaccggccgggcgcgccccggccgtgtccccgccatgcccgacctcaccaaacccccttcccctcgcccccgccgccgccgctgccgcctctgcggcatctgcctcggcaccgcgctcctcgccctcctcgtctcctccctcgcccacctcttctccccgccgcagccgcagccgcagctgcagccgccgcggccctccccctcctcctcgccaccgcgcttcgcggtcatcatcgacggggggagcaccggcagccgggcgcacgtcttcgccacggggcccggcgggcggccggatctggcgcggtcggccgtgatgcgcgtcaccccggggctctcctcgttcgccgacgagcccgcgcgggccggggattcgctgcggccgctgattgatttcgccagggagaaggtcgggggcgccgcggcggaagtgcggctcatggccaccgccgggctgcggctgcaggaggggcgcctccaggaggccatcctgtcgtcctgcagggacgtgctcagggcttccggattccggttcgaggactcttgggccgaggtgatcccaggtagtgtcgatttcttcccagttcgtaatgctcaagtgatatagctggttgccttatagatgggggactgggaattcgatttaggtgagacgttagaatttgaatctggtgatgaatctgacatattccatggaaatgctaaggtgtcatgctgagacagccgcggttgtcaattcagtcgttgttgtgatggttgcacattggtgattcctgaaatgaatgattttctgaaaaatgtgtagtggatattaccgttgtttcttctctaggctgtatcgttgcgggttgaagtgtagtactcctgagaaatacggcctcaattcggtttatattctggtttagtgagaggcatcaagaaactgaatccggctattcgaaagggaaagcggtgtataaagtaatttgggtagtgaatcagtaaagggaaaatccattggatggtggatacagatggtttttcatcattagctgaaatattgtcagtatggatgctcattttttggctggttcatttcttataggctctgatgagggtatctatgcttgggttgcggcaaactatgctcttggcacacttggaggggatccacacaaaaccattggaataattgaacttgggggcgcctcagcacaggttctctgataaagacagataaattctttgattcctttcctttcctttgattttgagccatgaatcctctttaaattaaaatccatgctaataagatggtactaataagtaataaagttaagttatttaatctgaaaagactcacttacctgagatggtgttatctagaaccaagctccacatttgaatatcaatgttaacacggtgcttaatgctttggttatattaatgattttctgccaatctaattattgcttattgtttcagctgacatttgtttctgatgaagtacttcctccggaactgtcaagaaatttcacttttggtggaacaacatatactctctatagcaacagctttctaaactttggacaagtgagctatttgtatacattgaatcacccaccacttatgttatggacaatcttgtaatatgatacgatatgctgaccatatgattcaatttcttttgcagaatgctgcacaagaatccttccgtgaaatactgcggtcaaaaggtatctttttacttattctttcaatgtaaaggatagcaaaaaaaatagacatttggcatcccttacaatggtagctaggttgacaagggaacactaagttcccagaaatgagaatatcagaatattattcacagctaacaaatatgatgtgctgatgttagccaatagaacatcaataattagtatactaactatggctattctacttctgatgtgctacagtgacacaaatatgtcaggactatagttcaaagcaacagttgtacattttaagtttgatgagtgctgggttgaatatcaaagctgttatgtacttgcatccatcattgtattgttattcttttatgcattttatgctctgaatgaaaccaatatgaatacacaaattctattttattttcgttaattagcttttagaggaacttggctgcatgtactgaagttcaaagcagtgccttatcatgactcatgtggttgcagactccaaaaatggtacacttgttgatccatgtgctcctaaaggatattctcgcatcaaagaagtaatatcaagaccaagcagtgcttcaaaatcaaaattagagaatcaatttgctgatagtggggatggagactttacagtgtgcagatcttcttctttggcactgctgaaaaaaggcaacggtagaaaatgaatgtgccatgttttttgttaatccctaaaaggctttatttacctggttacttagttgctaacagatttctttcttttactttcactgtttgtgtgcttaagaataccatgaaaatgatctgaagaaaagttttatatgtgatcattagctaaaatatcataccagtaagatgaagataaacaaggttataatggttaaatatcaggttatccttcaattgttcaacatcaacaaagatgggaggttctttgatttcatagacttaatatcttctgtagcttgaatactttgttggagttttttctttgttctgacccaaggtcaatttagcatgatgtgtcagttcattaccacttttatcttctgaaattttatgtcctaagtgcagaagagtgccgatatcaacaatgccaacttggaccaacttttgtacctgagcttcgtggacatttcttagcaactgaaaatttctattttacatcaaaggtcctcaactctacatcctccttgttttccttgtacatgttttccatttcttaggacacctactcacataattatgtgccagttctttggactgaagcaatcttcatcactgtctgattttgtgcttgctggagaacaattttgcaacaaggacttgtctactcttaggaaaatgtatcctaatcggtcagatgatgatttttcacgttattgcttctcatccgcatatattgtagctctactgcacgacagtcttggtgtaccactggatgacaagaggcaagaataccatggcacatcaatcttccgctgaaattcactcttcagcgatcttatatgcttacctacttttaaatttaaatgttcttatatccgcaggattgagtattcaaatcaggttggagacactcaagttgaatgggccctgggggctttcatctcaaacataaaaggcgtaattgtagagccatcagcaactggtagatcagcccatagaagtagaccattgcttgctgtgctgctgggggtgtttcttctaggtggagcactttgcttggcaagatggaggaagcccaagacgaagatcatatacgacttggagaaaggccggtacataatcacacgcatcagctgacgctgacctttgtgcagaggaatcacatatatatacgacaggaatagatgtttgttatgtgtaccatagtgtacgagttcaattctttgtattctttctcctttttaagagctgggtgggagccttagaggagagatcaaggatagcatgtgtgtatgtacaggacttgtagagcattttgccatttacttattctatttatttgatgatggaataacctagctttgctcatgtacgtgatatgtctcagatccacttgttatgcatgcctcccctaattgtgaagcatgcaagaaaatcgttggaaaatggtaatcctcctaagatgtttgaggtgttatattgtcaatgttctgcaagctagtaagagtcaagatggccgagttggtctaaggcgccagtttcaggtactggtccgaaagggcatgggttcgaatcccattcttgacaatttattttttatttttacatccagagtttaactgccattctgataatttgtttttttgggtttatacggagttttaagtggtgtaaggtatttctgccaacatcggtggacaaccttattaacacacacaatttcggttcacttttgttgacaaattattagatccctttttcatgaatttagtgaggaatgttcttcccttttaatttggaaattttatctaagcatagaactagccaataatatgcaaacatttccctcttgcagcgatctggacaaccttataagcacacaatttcggttcactttgttggcaaattatcagatccgttttccatgaatttagtgaggaatgttcttcccttttaatttggaaaattatctaagcatagtactggcctattatacgcaaacatttccctcttacagcgataaaattttccgtatgtgttgtgttgtaaaaggggaaactctctcccttcattactactccgttccatattgtaataagttgtttttgtattgtcataagtcaaacttctttaatttcgattaaatttgagtaaattttacaaaactattagagtaattttttaaaaactgtttgtgtcgacgtttgatgtcgcgattccggtatttgcatagtatggggatcgttggtactaggatatatgcgagacttaggtaaaagagacggggacaaggatttttatacaggttcgggccccttatcttacaggtaatagccctacatcctgtttgccgaagccggtgttgctctttattcaccataatcacaccagtacaatatgtggggtagtctatctaactgttgtcgacttggcggtctgaagtgctgactcgtagtcgacaacagggtagccttcctccttgaatctgcatccagcgaggtcaaagatagtgctatgtctctcctgacagtatccgtagacaccgtaggggactagccatgcttatctctgaagtcgatatccggcgtcttgttttgatgcatgttggcttgtatgttgatctattgttccgtgtcccctctcctcctagggggccttgtatttatacccacagatatccccttgtccaagtagaactagagaaactaatatggatacaatccgagtagttcttgtcgtttccatgtagaactctattcatccttccttatgcggaacttctcctatattcgaaggttgtttccgtataagacatggtatgtggtgggtcctgtctagatttagtcaactactattaggtatgtggtatccataaccctgacagtttgatcgtttgatactttgctcaaactgttgaaaaactatagtaacattttttataacacaactagaatatttataactcaaaaataataataccgtcatgatctaaactgcaaattttggttttatgataacttcactactattgtaatttcatgatactctgctttaaatatgtagtctcatccatgataaagtaggtgctaaaactatattttggtaataaacgtcttaaattggtagctttacgatggtttggtcaagtatttttagttttgcaaatgtacttaaacttttcatgtcaatataattttaaccatttgtaggttttgtcttcaaaggtgattttgtaattccataacttttcttttgaaatacaattcatttcgagtagccacagcatgagcatttcacatatattttggtttgatttttcttaaaatagtattttttttaccagcttgagaaatgacttcttttacttcgatttgattttcattcttaatttacaaaccagttagaaatacgagtattcccccaaacttttagagctacacaaatttaggacttgttttggtttattgcaattcttagccttgccaaattggccattgttaatattttctccatgaattgggaaggacttcaatgccaaaattacattttgacattgaactaaaccaaataatttgacgtgccaatttctctataaacaaaacacacaactgatatttatagagtaaattacattttgggccacatatttttatcaaaattttactttaatctatcctcaaagtgtttttttttactttgggcgtattattgccaaatgttgcactttaaactggttgacccacatatcaatgagactaattacctttattgtacataattcacttatataggccaccctatctaaagggtcacatgtggaaacaatgactagttcaaaatgaaaaaaaatactataagaatatataaagtgaaactttagtcagaagtgcaatctacctatatttatatttgagttaattgcacgattagtacttaaatttccttacattcgcaaaagaagattcacctatgtccacaaatttgcaaacgcgtatcgatgtctctaaacttgatttattatatcacttcgattcacagtcttgtttgacaatgatcttgcatacgtggcatgccacgtgaacttacatggtatatttttattagagtaaattttactttgggtcatatatatttacctgattggcacattggaccagggataaacttatattttcacttgacaacatctttctttaccatgctttgtaggttggaccagggcttatcccttgggccaccaggaaagcctcctcggcccagtccacgtgaagcgcttgtttgtgtggagggggcgagtccaggcgtgtgtatgcgtcgacgcttggtggggagcagcgacggcgtgagatctcctcgatagcgctgctgcctacaggctacagcttccgccccttaaccaagggcatttctgtcgactggtgatcatcggcaaggtggatcccaacgtcatcctgtacaggagcgtaaccaatgttggggccaagggccacgacttccacgccgaatcgccgatgccgtggtgttctgttcatgcatatgacccctgatccacttagaagttgaaaaacttttgctaacatgattaggtcaatagattttgaaatcatatcagacctaaatattggcttccagattatgtgaagcaataagggcccaactattccatttggcattaattaagaaccaaactttctttttaaagttatgttataccaattgaactcaggagtaaggaacacaaattgattactcacaaggtacacaggaataaaatcccgcaagccccaaaacacacctgagttgcagactttaacatcgttttgatttttctctatgatacattccaagaccgaataacagactaatatagcatatatagactgcctccaccaagccaagtagcgatccgggcggttccacagcttctgcccttcggagtccggatgccattgtatgtgatggcgtcgatgtccaccagaatggtccttggctttgacgccaacaacatggtcggaagacgcgccccgccgaacatgatgaggcctttgaagagtctgaagagacgtcgataacagccgatgtctacgtgccgaggccaagctcacgatgcggctttagtggacatggaggggttgacacagagaagcgaagaggttccatacaagcaaacgcttcacatggactagcccgaagctgtcctgatggcccagatgctaaactctggtccaacctgtaaagtatggtaaagaaatgtggtgttaagtgaaaacatacgtttagccctggtccaatgcgccaatctgataaatatacatggccaaagtgaaatttactctttttattatctactctcttccttcttttttctccttagtcctccctccagcaagcggcgccaccattggaggcagcgggcaacgatgataccagtggtggcggcccctttaatgattcctttggcctgccatcgctatcaccattacccgtcgtggtcgtcagtgtcgctgcttatcggagagaggaagaaagaagaaaaaaaagggaaaaaaattaaaaagtgtcacatcatcattcacatggcaataaactaattttaagaatatcgatgcacgttctacaagtttgtagatctagataaaacctcattacaagcttatacgaacaactagtacaatttactttttatattttgagagtgccatttttcttcctttctgctccggcttggcccgtgcgccacaccttctcctccttcggtttctcttctcggcttctcgccttcttttccgccgtcgcgcgcgatccagttcagttcagatccccccccctctccctctcccccggcgcagttgcgctgcttcccctctcctccactccgccgccgccgccgcgaggcgaccaccgcccctcgagcaggcgccaccaatggacgacgagcccatcaacgcgcacaagctcctcaaggagcagtgagtcccaaaatgtcccccaaaccccccctgaaaacctctcgctggtacgcctcctaagaaccgtcctcttcgcctcgcgcaggttcgtcagcaacttgacggggtcttccctgctggagatcgccgcgctctccaccgtggttccggtgagttgcttagttacccccgctgaagtaggttagttggtgctgtggtttgacccctttttttttgggttgtgcaggctgtggtcgttctgaggaaatggagctgcggaggtcagttcgctacagattttgtggaatttttgacccgtttgatctattagtgcgattgtttagctgatcgatttgtacaagaaatagacgagcgagttgttgatatcatttagaagtgtggtataagattaccagtatgctgcattcttgcacatttagcatttggttcagatatgccattgcgagattgaaccagaaagttgacaggttgaattttttgcgtaatctcagcatgtagttttgataaatttaactcgattatgtgaaattttaccatgctctactccagtttttgattatgctgtggtgcccccatctgatgttatggatgttatgttcatggattttcgaattttaacatcattgatcaataacacgagcttcttttactgttcagagtagatctggaaagtgattgcttcttcccttatttttgtcttgttttagataatactaggaagaattcattgaagaaaaatgatgatgcccttcctggtcataaaggttttgtgcattacttctctacactggctatagattacctcagtattgtattgccagttcttctgattttcacagtaagtattctttcataggacttggagattacattgtagcagtgttcaactatagaaatcataaaatatgtagagaaccaagcattggaacacaatgcataaacttttaaccaactattgttatttgcttattgcaaatgttataatgaggtttaacacttcttagagaaaaaaagttaaatagcaatcttttgattattccttggtttgttacaggttttagctgaatgggcttgtgcttgtgcactttctcttgtaatgctgatatctatcctcaccatgtttaagaggtaccatatctgagttcttacacctgtttttcttgccacattctctctaatttctattacaattctagtcgaccaccctatttcctttatgcaacaaaatccatgctgattagaaactaatgcattccctatattctaaggtctcgatctcatctcaaagctggaccaaatgagctgcctttgctccgagcagatatatcatcatacagagtatctgtggtacgtaaaagttgattaattggaaaaatactactcatttaattacttctcagtactatatatccaacagaactattgaagttaatggtgatggggtgttttgaaggttctagtaacatgcctgtgcatattagcagtggacttcaaaatcttccctagacgttatgccaaggctgaaacatatggttgtggcatcgtaagttgtatctttcatctttttcattggttgtattttagttctttactgtctcaaagcatttttaatgaatcatgaacttgtttttgcaaaagtagacactggctgcaaattgtgcatccactctgttacctattctgcatgcttgtgatttggattatttgtgtttcccatcatgtttgaaacttaaaaagtttctgtgttttcttccccattcaatgacatgatactaaggtatctgcctcattgtccaacagatggatctcggagtagggtcttttgtagtggctaatgcactggtatctagacaagcacgaaactttactgcaatgtaagtccttaactacatatgatctcatatggctaagaaatctagggttttggttttcatcacagtgactttcagttctgaagttggccaaatataggcggagaaagtagattccatgtcttacgacagataatcttactcttctttggttataatattaggcaggttagagattgttgtttgttaggaactgtaggtaaaaaggaatatcatggtttagatatatcacatgttatataaatgatataaagaacatatatttattccgctggctttatctattgaaagtaggaacttctagtttagaaacctagaaggtacaggtacaaagcaagtcaacttcaccagttcgagctatctataaaaaaattagcttggtctgctgagttagttcagaattggcacactgaagataaattatgctgatctccacaattcttatatttgtatatctggagacaagtcagaaaagtaataacgtcaagttgaagctaagattgacttgatcacttttcacccacaaaagctttattatccatcaaatttctgcacctgctctgttttattgtaggacgatatcttttttaaatccttcccatttatttctctctccaaataataaaccatcctgagaaagtgacatgttgacaattcatcccacctttgtctaatataatcactaaaaccttatttagactctattttaatgtttgactttcgcagacatcattgtttgaatatttgaattttctctggatagtaagagtatattctgattgagaggtctgcaaatagtcactagtatgctgtgtcttacaatgcaacttcatgtgtgtccttaggacctggaataaagcactgatgtctataagccctctaatatttcttggttttgctcgtctcatatcgacatcaggtgttgattatcaggtatttttattcataaccatgtcaattacctaaattatgccttcgccacaatttgccatatgcattgacattaaatttacttcgtaattatgcacaatcctcaaactttgctttccttatccagcattttcaattaccatgtgattattttctcttgttgacttgttctagataccgtatatgtactgcacaaaacaaaaatgtactgctgtcttcctaaagatgcatattctatttctcattttctaggttcatgtaggagaatatggcgtgcactggaacttctttttcacccttgcagcaatttcgatccttacgtccgttatcaggatccatcctaagtattgtggattagctggtctgcttgtgcttacaggtactaaagattcatttgaatagtttattttcaaatgtgctacagcctccttttcatgtaccagatatttcatttgttttcaggattccaaacgtggctctcttttgggttgaatgagtatctcatttctaatgaaagaaacggtggtatcatcagtcagaataaggaaggtgtttatagcatatttggtaagtatactaatgcaacaaaacctctttcgtattaccaggaacactcacctctaatgtaacacttaaacaacccaattgtactactcacatcaacttgagttcacaaaattttccaatgctatttgtcatgaaaagttttgatgtcagtctgttatttatctgttatttctttgcttaaggtgccaataaataatcagcctccaacttgttggtggataattcaggcatacatgaaggtgtctgcacagcatatttctagccctttttctttgtttctattcacttatggatttcttaatatccatgcttattatatacatcctttgtattgccttgctgacctttatatgctgattgcatgtaactttttgatcctttttatacccaaatgttataaacttgcatgcacctgattcttttttgaaaaagttgtggtgatgtgatgcaatctgattgattcatcccttttaacaggttactggggtatgtacctgattggtgtttccttgggttacaatctattcttcgacaatagttcaaaaggcaagagtaggagcagtcaagtggtaaaagtttgggttcttgctgcatctttttggtaagaaacaattttttcatgcattattcccaggtataacctttcttcatttttaacaattcctcccatgccatgttacaggattatggcaatcattcttgacagctatgttgaaagagtttctcgacgaatggtaggatattaattgattacatgctttcttaagaaacaaaaaatctagactagcattagattgacaaatataagaaaccagatagttgtgcattttaatagtagtttatagtatattgagcagagtttattctattgaactgagtacccttgttatgatagttaaagagtatgctgtgatgaaatggaccagcatagcttagaaaattaaccgcatctaaagtgcatagttcctgatccgattactttgctgaccctgaggcaaatacctgacctctttggttcattggttcatactggtgaaccaaactaaatatgggtagttccaacggaaatttcctgttgttttgtttgcctccattatctggaaccagctacaaaaatttggtagcaccaaccaaatctaacataatacttccttcgtcccaaaatataggcctttttgaggtaggcaccgatattaagaaagtaggtagagatgattggagtgttgtgattggtggagaagagaaaataagtgaaaagaatggttgtgattggttgagaggagagggtaggtgaagaaatagcttcattttggaacaagttactgtgctagaaataactacattttgggacggaggtagatgtggttatttaaggctgaggaaatctcttgccaaaatattggttctgatacatttcaaacattctttttaacaaattctggccttgtccaggttgtttgttccccttatatattcaatataacttgatcctagaagccttgacacctgtgtacaaatgtggttcctttcaaaaaaaatgaaagggaaaacataccgttacttagatagtaatgcatatgatgtactacattgaaacattatgtgaattatgttggatgataatttaacatgtttgtatttgaaaaggtcttaaattataaaaactataaagatatagcatgtttgcatgatgtttaaatgtgatgattgttagtggatgatgatgtggcatcttgttaattagtggatgatgatgtggcatcttgttaattagtggatgatgatgtggcatcttgttagtggatgatgatgtggcatctttgcatgttaagcttaaggagttagtgggggataactttatagtaagataggattagtaccattaactcccaatttaatccgtccttagatttgaatttaacttgtacatttcattttgcagtgcaactttgcttatgttatgcttgtatttggacagaattttcaggtattgttcttcgcctttcttgattttatttaatttgcatacattgccagatttaggtatccatatttctcaattagcctctctaccattgggagaattagttacttgtactatttccagcaatggttaatagtaacacactagtacagtagtattacatgagtcaaggatataaataaaactatgcacttgaaatcttaaactgattgtgcatcggagttaacctacactgtgcatctttttttgtctgcatgctttaatattatcaaatgagaatgaaataatttaactcagtctaatgtatagaatatggttgaaaatttcttagtctgttgtattcattgtttcactagctggtttcattctttgatgattgggggctacattttatgtattgtcagaaccatgaaatttggcgaggttcacgaatttgactgacataattctgttacttatggtttagcaaccatatagcctgttagagttttctgattgtatctttgctagatatagccatgttaaaattttctgtccagatttcactgatggcggtggctattttaaaaacaggttatatctattctcacactagctgggtttatttcatatgaaaagaacctggttcttgaagatgcattcaatcaaaatatgcttggttcattccttctggtaagacagtttggtccacaattttagaaaataattttcccaaaacagaaatgttccaactaatagatcctcaatttgagtttctagtatatttggaacttatttttggtaagtctgtatggagtaacatttaacttcatcttacaggcaaacatcctaactggtgtagtaaatctctcagttgacacactctctgcctcttccggcaccgccttcatgattttgttagtatactcctttactctatgcatgattgctgctttagctcagttttgcggtattaggatgaaattttggtgaattcaagagttatctaatacgatgtatgtatattaattactttctcagcaagctttcttggaataaagccaattgttaaaccaattagtctttcctgtcatctattctgcctgttttctgtatcttagacctagatctagatgattgctctagttccgtcccatatgaaaccttcaacgttctgagaagctgcaatagctaagccaataggttatcgtgccgtgtactttaagaagacatatatcacagatatgttggctaaattacgatctatgaacagctcattgttccattaattaggcagtactcaagaatttgacaaaactacctgcttagcattcaacgacccaaccttaatttctttcagaggaatccaacagataaatggtactcattccgatattttttgatgtttagcacaaaaacttataaaacttaatcaccactcatttctcaaataattagttttgggaccacctatacatttgttgacaaattttctcctaaaaatttgaatttgacaggtgtaattatagtacaatcatagtgtaattacactgtaacttgtatgtaattacactgtaacttgcatataactaccgtgaaacttgtatgtaagttccacataattttgaatcgttagatctattacaagatttgttctggtgaggaagaaagaaaataacagtacacacatgtgtgaaaggatttgttcccacagcctcattttaccgaaataagatgttatggagagatttttgaaagttacatacaagttacattatagttagtgtaattacatgcaagttacagtgtaattacactacgattgtactgtaattgtatctgtcaaatttttgggagaaaatttgtcgacaaatatatagcaaaattgttaatttttttagaaactatttagaaattaataagccgaaaatagggccagcttcaattgggccagaatcagacacacatcccgaataggaataagtccactttgactcccttaaaaattgacccgaatctaatccgtgaccctcaaccgtaaaaccggataggatgactccccgaactattcaaactagtgcaatttgactccatcagtggttctggatggcggttttgctgacgtggcgatgttgacctgatctgtgttgttgatgtggcacttatatggcattaaaataaaaaattatatgggctccattcgtcattcaaatgaaaaaaaattgcgaggcccacatgtcatcctttatctatcctccttccccccttcctttctcccttctctgtatgtttctcttcctccagattcggtgcggaatctggagtggcggcggcggcggcagggtgagggccggcacggaggaaggaacttgagcgggtcgttcggcggcgacggcctcagctcgccggagaaggcgggggcgttcggctggtggcctcccccacgatggtgccgcgccaggctgggacgaacgagagggctaatgtagacggcgaagcctgagacgccgctggccccagccgtgcctcttggtctgcgccggcagggggtgccgcctctgtttctttctgcccgaagaacatgcatgtgcatagcgttgcctagcagatgcaagtgcagcgccggtgtggggtagcaaggcgcggccgccatggaatccagtcgaattttggcaggaccagtagctgcaggacgaatccgtcctaccagcgtggtccacctgagtcctgcagatcttgaggtcgtggactggtctgattttattctttgtggtcactgtttgcaaggtcttcaggtcgtagacaatagctacttcattaccgaggacaacgtcggcatgttgaagctcgccaaggaggctaacagcatcttggttcgtcgatcagcgcattgactcatgttaccaattcgcctatgaaaattgctaacatctaaccgtgacatcctgtgattaattggtacaagcagtttgactgccgtatcccgcgccggagacggtgggttgcgcagtggtgcactcaaacggccacaccgcggcggccatgtccatgggcgggctgatgaacaagatgaccgggcgcatcggcaaggccatcatacgctccacgctggcgcgcgacgtcgccgccgtgatgaagtaaggggcgccgggctgcaggaggccatcgactactgcgtcaaggaacggctggacaaagggttcatcgggctcatcgcggtgttcggcaccggcgaggtggcgcacgggttcaactgcaccggcatgttcagcgagtgcggctgcaggagaaaagagagagaagggagggagaggggggaggaataagggttggagagagaaaggatgacatgtgagtcccacaatatattttgtgtgcaaatgacagacgggccctacaaaatatttttaattgtaatgccacataagcgccacgtgggatgaagaccgggtcaacaccgccatgtcagcgccacgtcagcaaaaccgccatccaaaaccgctgagggagtcaaattgcactagtttgaatagttcggggagtcatcatatccggttttacggttgagggtcacggattagattcgggtgacttttaagggagtcaaaatggactttttcctcccgaataaacaggctggaactaccctcctgccatctttaatgggctgtaattagcccacgatacccgtttaatggactgaaactaaatacttggcccactaccttattatctcaaatgtttggcccaccagttacaataaaagggctcaaacagtttttaggccctgggtgatcttaaacaggccaggacaaattaggcctatatatgattttggtaaggcggaattaggagcggaacaaacataaacaggccaggacaaaatttaggcacacaacagtttttggaagagcgaattttgacccataaacacgtaataatcaggctgaattttgtcgatttgtaagtctatatatccaataggcttcgctagcagctgttttctagcctcatcgtttgccctgaaaaaaattagcagctaccaaaaattaaattataaaatttaattttggagttaactttagggtattcaatatagttttgttttcagcattggattttaagtcatcaagtacatgcatataagagctttacctacaaattatttttggtcatgttttgtcatgtactacctccgttttttaatagatgacatcgtcgactttttctcacaggtttgaccattcgtcttattcaaaaattttaagcaaatgtataagatataaatcacacaaagtattatgagtgataaaacaactcataacaaaataaattataattacgtaaattttttgaataagacgaatggtcaaacatgtgaaaaaaagtcaatggcgtcatctattaaaaaatggagggagtaatcaacagtcaaccttggccaaccgatgaatggagagcaaagttttcatatcgacagaaaaccatgaaagtttgtcagttcacaaatttcacaagtacatacttatgtactactactacttccgtatcaaaatataacaatttttagctatgaatatggaaacatgttagatatataattataaatgtttatgagcctgttcaatttgatgccattttcaaccatatcattttttttaaagttaccaaaaaatatctacgtctagtttgttcacaaatttagtcaatacataagaaatcctgccaaaattttgataatattgccatcttgctaaaattttggcattgccaaaacatggtatggtttattttggttacaatttgaataggccctatattttaggataaagggaatataggataaagggagtacttacttaaatactcttacttcataaggttttggcaacaaattggtcagcaagttttcttgaaatgtagccaagttgctaaaccaattggtccatcttgtcatcaattctgcctattttctgctcgagtttctctatgttctatcccatttgaaagcctcctaacgttctaaacagatcgcaactggtcaatcttattaaaactgccgtttacttttgagttttgacgttgaaaaagactctattacagatcagctgaccgaattgaatacaacatgtgaagagctcattgttacattaatttggcgttattgtcagaatttcacattcagtatcacatactgctctccagttctcgcctgtcacgatagggtttaaccatcaaatcagtatgaaaatggcacctcccttgattgttactttctgcaattgctgtcttaagatttttaaactcgatcgatgtcataattttaacctgctacagctaagaataaataaacatgatatataaactcgattcttttagatcgtccctctcaaaataataataataggtggggtcgctatctgtatctggacggtgatttctatgagactgaccaaatattaatctccctgtaattaggtcaacttaagtcaaatatttgctattttactgattcccggtgtaatatcaatttacgccatctttattttgtttcccttttagttaaaagtacatataatttcccagagccgtccccaaaaatcttggggaacaagaccttatgtacttggtgaaaccccgtgcattgttgcgggaatttagtatgataaaaaaaaataaagtgtaatatagctagataacatcagattaagtaaattaacgtggtttatgataatttaaacttgaattgtagaatggcgattcaaacgtaaaaagtaaggtggtatgactttatggaagaagaaaaatagggagatagtttggacagtagattaatcatctaaaggttaaaaacaattaatgtgatacgacttaattagaggaaaaaaaagagaaagataatttggaccatagattaattatttaagcactaactaagtgaggatgaactatataaatatataggatattataaaacataataaagatatatattgaaacattatgtgaattatattggatgataatttaacatgtttgtatttgaaaagctcttaaattataaaaactataaagatatagcatgtttgcatgatgtttaaatgtgggcatcttgttaattagtggatgatgatgtgtcatcttgttagtggatgatgatgggcatctttgcatgttaagcttaaggagttagtgggagataactttatttacagtgagataggataccgtggcgacaactgctataccaaagaacattcacctacttaagtaatggcgatctgatgaagcagaaaaaaaaatcattgcaccaattcagttttgctgactaataggtgcaaaaatggaatccttattgcttggaatgcaggttcacatcatgatgtacatttctttaagataactatgatatcgtcatcgaatatttaccggagccgacgaaaagatctcgttctggtctaatataacggagcagaaagatagaaaataaaaaaaaaggagtgcagaaatcctaaacacatcagaacgtatgggtatggattaaaacatgtacttctggggggcctaaatttttggaggccatgtacggtcgctcatcttgcatgtgtctatggacgggcctgtaaatgccgacctctgcaccgactctttaattatttaacaataattaataatataagttttagtctgtgcatcaagtaaggttacacacatctatatatttatggaatattgatgtacatgagatttacccttttatagggtttgcgtcatgcatgcacccacaactctgtcaacccaccaatggtgcatctctaattaagagaatgaaatataatggccaagggacaagggttacgtgacaatgggagctgatagtacatggtggcaaaagtacgatagagctaagcacggcctaattatcatctaatatctctccttctcaagtcctaaattggccaggcaattaattaatcaaaggacggtcctccgtttcaccaaagtatgccaatattttcttatacttgctataattaatggtatggctaaaaatttgaccaccttatttttattgataaaacattcatagtaaagtgtggctgacaactaaacaaccccttaatattcagatagaaaaaaaattaaagaactataattagcggtggtaactaatgggtaaagaccaatgcatgggttctttcacaattctacctagcccttctatatttttagattaaaaatacataaaattttaatccacactattttagattcagccctcaaattttgtatgctaaaaacttgttggatcatttaaaatcccttgctatagtatttgcagtgataactgggcttacaatgttgatgaagattagttgaaaaatgattttaattacaattctttttctctgggttctttagctcgtcacttcattttaaaatataagcatttattgctataaatcaaaatataagtatattcatacccatcacttatatttttgaatccgagaaagtgccatattttctaatgtaaatatggtcttgtatatatatatctcgaatattttggccatgccaatgcaaatattgggtatttggatgcattgaatcctcggcaactgtacgtaggacaagtccatcgttttgccggtagttattaggcatttaggctacaactgcaaggatcagacgcgtcaattaatagtaagaaggaagccaatcacgcaaacaacgaaattaaatttgaaaatatactgtgattcgtttttttcttagaaatattcatgatgtaatttttttagcagaaatataccgtcgatcttgcgcaatcgttgcgcgaaagtgacgagagcgtgacgatgcacgcggtgtcgcgcgagaccgcgtggtatcgcgagataaaacagcgagagcgaacggtcccgcacaaggaatcagcgagaccgaacgtcttgtccatcagtgctgcttaattagtgattaattactctaattaactattaattatcctaattagcgattaattaatattaattaattgctaattaggataatcaatcactactctctccgtttcgcaatgtaagttattctagcatttcctatatcatattggtgttaaagaatctagacatatatatctatctaaattcattaacattaatatgaatatgaaaaatactagaataacttgtattgtgaaacggagaaagtaactaacaattttcaaccgttgctatcgctcattgggtgagcgagattgctcggtctcgcggtttggccgtgcgagaccgcgtggtctgacgccgccaccacacacgtcctcgatttcgccgttcggtgtcgtagtttcatcgtgcgagaccgtgcggtctcacgctaccaccacgtgacatcgtgcggtctcgcgctgtcattgtgcgagaccgtttgcgtcgtcacatccacgtcactttcgcggaactgttgtgcgagatcgacgatatatttatgctaataaatttacattccaaatatttgtgagaaaaaaacgagtcaacaacagtgtattttcaaatttatttccaaacaacgcggaacgctctatatatcttcatattcgtgatgcctttaatttggcttaaatttgaaggaatgtaaacaagacaacaactatatatatagctttggattctttaatttgcatgtcattaattatagctacagctagtagctactagcttagtttgtgacacgttttaatacattttttatatgattaattgtcggtcatgattgataaattacatacgtaactcttggcgagattaggaattgaagctggccacagcttatatgattaaatgtcggtcatgcttttatttctgcttaccgtttcggcgtaactggaatatatccgggaagaaattgaatggtcttcttcttggctgtttctcaaacgcatgcaagaataagcctcaatataattactatcttttacttcatgccactgttgttagtctattactgccattattgtctaacaattaataattgatgaataatttttacggatgtccctactactaattgaaatgatagtgatctagagcttcctgaaaacattgctttgttattgcaggttagccgatttgtgtgaaccgatttggtttctcagcgatttgattaaaaatgctgaattgcacataaatcagtccattttctccgtgtagattaagatcaacagaacgtttttcaccattctaaatagggccttgaataactcttttgtatttttctactgaatctccgctcataataaggattgccggtcnnnnnnnnnnnnnnnnnnnnnnnnnnnnnnnnnnnnnnnnnnng

SEQ ID NO: 6424 - DNA, 783 bp, Oryza sativa
  unsure (1)..(783): unsure at all n locations
cgatgtgcaatgcgcctacnagatggtacagtagttcatcaatcacccccagctcattcagtgccatgtactgatgtacagactcacagcggaagacatttccaaagggtttaacctgctcatcgggagcacgcagtccacattctttttgcagatgcagaagcattgcttaacttcatacaatgaacaatctaagttctaagacctaccatcagtaactcctagctcaactagaacattggcagcaagagtcatcgttttctcttgccatgagtctttgacttgttctcaaggtcatttcctggtggcgccttaagagacttggatgcaactgctgagctccacagcgctctctcaacatcagaagtagtgaaaacttcttctcctgagctcaattcctaccagagaaacaaaaaatatgaaataaatgtcaatcaagcaccgcatgtgttcatcttcagacttcagctaacagtccaaatgttcaacaatctataattttgatatggaatttgcagtttactcggtgttattctagcaatgcggacgttacatgcttgcattttgcaaatataaaagcataacgttcaagtactaatcagcttatcagtatattaccctattgttgcagctgctgtctggaataaaaaggcaagcagctgaaaaattggcatacgatttttgtaatgcatactctgtaaattatgagcctggcatccttgagcctattgggacgttatgatttagagaagcatcagccaacaagaaaaaaggtgtatcttt

SEQ ID NO: 6425 - DNA, 751 bp, Oryza sativa
  unsure (1)..(751): unsure at all n locations
taggtcctttgattactagagtggcagtagttcatcaaatcggcggtgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataagccagccgtgtaggcggaggcaccaatcggcggcgacggaagcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtatgtggaggcacccaatcgcggcgacngaggcaggccngcggtgaagatgacgatgcccaatcacggtggtgtgaccaaccgaccgtataggcggngacaccagtcggcggcgacggaagcaggccggcggtgaagtcttagatccccacagcggctgataataggctaggcgtgtaggcagaacaaccatcg

SEQ ID NO: 6426 - DNA, 726 bp, Oryza sativa
  unsure (1)..(726): unsure at all n locations
ccgcaataaaataaatgataattacataattttattgaataaacaaaaaggtcaaacgtttattaaaaagtcaccaatattatacattaaagtacggagggagtaataattttgaccaaaatctattgaaatttgaagaaaaccatcgtaccaccgaggatcaggatctgacgctcaattgataaggtgaacttaaccctgcgctgcatacgtgcaagaggacacgggatgagctagccttgtgaaagaccgtgcgatgtcgagccttgtaccaggaggctactcgtagccacctactcctacctgggtttccgcggcgccgtcgtggcttagacgcaatccaccctgatccggtgacgagaccactccccatgcaccgcgccggccggccggcgccaccgtcgcggacgtacgtacgttacgccttgggggctgggcgtgtggtttgaacgcacccgcgacccccctggccggccaggcttacgcctacccgcgccaaaaaatcccccggatccgctcgccttccatcattcgaacgaaaaggcgtggccgcacgtacatgatcgcgcttgtaggcagcaccctcccctcacgagctgatactcaggcgcattaatgccctcaagctcataacatttagaacaggtaaccggatcaaaagcggcgctagaatggaccaaaaagtagtgtgatgnnctnctgcagcaagagtatcaaacacagtcg

SEQ ID NO: 6427 - DNA, 760 bp, Oryza sativa
  unsure (1)..(760): unsure at all n locations
acggcccatgacnacttgatggtccagtagttcatcacggcaaaaagggctgctagtttgcaaattcctactgttgctgttcaatcatatgtttaaccgactgatttttctgttatagccgccggcaaaaatgatggtgaggcagagatcttaaaagaatagctgtggatgtagtacacagtactgcagacggtgagattcatgccggggggggagggtttctaacacctttattgcgaacacacccgtatcgttgcatagaaaagtaagctcaagagctacttgtttgaacttcaaaaattgggctgttgctgataacctcccagtggaatctatggaccttctctttccgtgtagatagatctacttgtatagctaaaccgaaaccaccattttgtcctatagatcaaccaggacaagcgttgtgtttgtgcaagagatgaactgatagatgtaaccggtagttgacaatagcaacaagagcaactaacaccaacatttggtgggttcgatcgttctcctccctacacattgaacggcaggtacgtagcatagtgacactgtgtgatatgccgatagcttcatatcacttatctagagcttataattggtgttagattcagttttagaaaatgaaaattggagaaagagacgtctctaaaaaaaattatagaaaaaaatgtgaatgtatggggaacgggtatgtaccctggaagtagaatcacacatctcttatcaatgcactatggaggatattgta

SEQ ID NO: 6428 - DNA, 766 bp, Oryza sativa
cacggaggtgagactacatactgctgcaagtgttcatcattcacatgaccacctcattgacgaaaccgattgtgaccatttcctgccttacattcaaaagctaaacctatgactacactgagggcgtggcattcaaggtggagatatgctcctacgtccattcttatgtctgctatttattcaccatcgatgctacagttggcactattcaaagatctacatatacgctattgctcatcatctacggtacactgaccacagctgtcgtctaaattgatcacacggggatggaagctacctgctgggataactcgcgagttgggacaaggatgaaaacatttggagcagattttcggatacgcccttctgcagacaacttcaatagctcatgcagcatagggagaaggtaagcaaaggtctttccggagccagtcttggccttagcgaccacatccttcccttcctgaaatcacagtattacactattcgtcagttgcacaaattattgaaaacctgaatgtctgctggaattgctaaaaaaacgtcgcaagttttttgggaaaaaaacatgcaaatgtaactatatcagaattatattacaattatactataattagatttggaaagttttttttctaaataacttaaacttaacatgtctgcccctgacaaacaggagaaatatagcaaaacttatcgaaaaggttcaccaagacaaagcagacaacccaaatatgcaaagcgaacaacaattttgcacattggc

SEQ ID NO: 6429 - DNA, 747 bp, Oryza sativa
gccgtgaatgagaccactgttcggcagtagttcatcaaacgatcttatttactacattgtgctggtgatgtatactgcaaagtttacatatatatgatcctttacggtatattatacagaagctttagatcatggcaactgatgcaaacgtgacatgctgcgcacgcgccacattgatataataaccgcgcaattggacaagaataggacgtgcaacggacacgtacatggaccgatgactacccacgccgatcggattggaactcgcccgtctttataacacccatgcatcctactatgcatacggcaagggcaacgcaaggctaccgattcatcatgcccaaatcaagcttttacgaacgcaaaaaaaaaaaatcaatacacgggaaattcaatacagtagtactccactacacactactagtgctagtgtgctactactactattttccgtgtattgatattcaccggtaaagtcgcaagggaagagagaggcaagaggggcccggagtgccggacccggagaaagcatgaccagaaagcgacggagggggcaaaactgccatcctgtgctactgtaaaaatactcgtagtactcctcctacttctactagtcagatactaccttttgagtttttcttatattgtttgaccactcgtcttatttaaaaaatttgtgcaaatataaaaaagaaaaattttgcttaaaatactttaaataataaagcacgtcaaaaaaataaatat

SEQ ID NO: 6430 - DNA, 749 bp, Oryza sativa
  unsure (1)..(749): unsure at all n locations
ccctgtagtagaccacacattactgcagtagttcatcactatcatgattgactttagccctcaaaaggaaaaccataccgctttccacaacacaacccgtctattacaacgacccatgcttcattccaccggcaacgcgacgctacattagatcacgctcgcgctcgatcggcacgccaccacaacctgcacacactagagagggggcgaagcactacgttgcttcgcaaactcagggtgtggtggcacagccgcggacatcgatttggcagcatgagcaggctgggcttgcacatgctttcttgaacggtggcgtccccggttcatgtgtcgctcacagtacttctggtcggcgaccgcatccctcgagcaccgccatttcttgccgtccgtccggcggcaccggccgggctccggatccgcgctgccggagtagcccagctggaaagatccccatcccactgcaaagcaaaaacccaaccaagggcaatgcaaccaagatcagggaatggaacagcttttatcataaatatcagtccatgatgaaaggaactaaagccaagaaagcattcggttgatctgctttctttcccatttcttggcttacatgtgcttgagccaaagtaggcaggtgagtagggcgatgtgaggctcctcctgatggggatgaggaggctgtgtggtacagggctattcgcagccaagtacttgtatatcagcgcctggtgcttcagctcgatccactgagn

SEQ ID NO: 6431 - DNA, 723 bp, Oryza sativa
  unsure (1)..(723): unsure at all n locations
agatganntccgtaaaccnatgcgnctnncnnatnannnggnccccatccccgtggtgatcgaagcttatgggagaggtcaaagccatagccagtatccaacaagggagagaaacggtggggtggcagcggagatgggtctagaataggtccctagctacaggacacgcaggtcaccgcggaagacggggagtggagcaccatgcctgccccaccatccccgatggtgatgagttttgcaccattagattccccgtgaatggcaggtaccatccatccccattccttaggccttgttcggttaatccccttgagggagggattggaggggatttattgcccccggcctatggcttgggaacggtttcgcaaaatgccgtctcattgtttcccgtgttgttgggcagggacctaaactaaattatttcttttcacggagaaatcgactgaaaactcaccgtctgcctaagaacgtgccaggtcctaattaaaccaaaacccacgcgtccggttccactttgattccagccatgcgcttaaggacaaacgttgacaccgtcggctacaatttggtcttgatcagtacccgtttgatcattttggccaagtctcacctatagagaacggtcccctcgtttttttgctactatgctcgttggtgcatccgtttgcttcacattgcgacagagtaaaccgtgtactattgccttcgtccactgcgtcg

SEQ ID NO: 6432 - DNA, 88805 bp, Oryza sativa
  unsure (1)..(88805): unsure at all n locations
nagctcgcgacctacaancctntgnnacnnnacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacaaaactgacctttttgatgattttgatgatgaataatttcatgcaaggactagtttttgccttctgatagttgctctatatagtttcgacttattactctagatcattctgtgtgaggtttaatattttttttcttggggaatcactggatctagattgtaaagttgctaatccaaacaagtcaataaacatgtcacaaaaaaatatattgttttttttttcatatgcaactagagcgaactgtaaaatcttacacgtgcagagaaataggtagtctgtaatgatctactttatgtctcttaagttgttgcatgcagtatgattgtgatcataagtatatctcattgtaatttcaatttgtgataactggtaggttgatgtatacgtagcagtatttcttttcccaagtttgatgggcattgaatttctctggtttcattatatattgtagtttaaagtatcacgcaatagtattactttaagttacatttgtttaagtatttcttaattgaattcctcccttaagaaatacggagtactgcactaaagtaatgttctttgttctagggtggtgaggagccgaagaaacatggtttggttttctattgttcgtttggttaagccaacaaaaaccagatcgggtgttttgactatgtgtacctgcggaaaacgttggctagaagaagaaaatgactgtttgcctgaaaattgggatgaatacatacatttgtcgtgtagtaagaccccccttaaaacgcacgatagaaaaacacaataggttcccggcgaaaaaaaaacacaataggaaaaaaacgtaataattgaagtattatgtttttccaatcctatgaaaattgagaaaaaaatatatataaaaagatgagtaaattacacccgcggtacatgaacttgtgtggtgggtgcaaatagatacaacaacttacaaattgctcactttgatacaataacttggctagttggtgtgaaccgggccaaaatgatccacacaagtaaaattgctctaaattagtgcacactaatgacataacaacatatacatataactgtgatttggagatcttatttcgaatccaaataaaaatgtgcaaaagtttatttttcatgtccatggtacaatatttgtttcattttttggaaaaatttgatcatctatataactcgtctaatgtttatttatctgttcaagaccaagacaatttttatatgtactattaactactaaaagaaaattttaattttcatgttcatgttctgacactttcatcgaaagtgtattttaacaatcaggtatttttaattattttgctttttcgttggtctagatcttaaaagtatcatgcgactaataatatgtgtcagtaaaaaattttgatgtgtaacaataattacacactagtacgtatcatattacatcaattttacttgtgtggattagtttggcccatctttgtatgaactagccaagttattgtaccggaataagcaatttacaagttattgtacctaattgcacccaccatacaagtttgtgtatcgtgaacgcaatttactctaaaaagatggactctttgattgcatcacaggaaacattcaacaatcaacgaagaaaagtttcacaagagatctaacctcttatttattttcatatggaattgaccataggaatggaatcctatggaatcaaaggactctagaaaaaaatccttcaaaatttctttgctaatcctccatttcaaagggtccctaaattaccatttggacaagattttttaacaaagtttcactttgaagtctttgcgctattctaaattctatattttatataataaagctaaaagtatttacatattttactttgaaccactctctaatgagcggattacctttgtaagtaacgtgtgggccaaaagattatcaggcccacatggtagtaagaaaggcaatccctaacgactaagagtaagtataatagtgggctataagaaggctgaatgctgaggtggatgggagaaaagaggagagagatgagaagcaggctgtaagtttgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggcatgagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacagttggcgcgccaggtaggggctgcgtcgagttttccgtcgagaagtgcgatggaactttgtgccggcatcatcggtgctactcttgtctttggccgtgatcctctcaacaaaagggcagggtcttcgtcgccaaaaattctatctggatctggtcaatcaaccaggagattaatcaccgatcgaatcgatctacaaccagcttgttaccgtcaattttacctccgtcagtgagatcaaatccgtcgctacaatgctgccatatctgttggtccgtcggtttcgtcaccagggcatgatttgaagcaatcagcaagcagccgccgccaaaatcatgcgaagatcaccgttggttgagcctgtacatcaccaagtcaatactactcggatacgtacggcaagacacaaagtccaggatacaaattaaatatacctggtcaaatctgtggtcaaggaaattaatccatacacaaatcagctattacatgcacaaagtggtctccaaactaatccgtgcatgtgctaccgacgattacatgtctacacggctgcatgacacggctgcatgctacggttcatccattgacaggcctcgaatcaaagttggatcacaaaccaggtttatcgttctaaattttcttatataaattagaattaattcacagatcactaattattatttgatctattattttatacatgtaccgccggccgccttcgtcgctgccgattggtttcatcgcctccacggttggtgtgcgccgctgccgttgctgatggngatatcgtnttcaccgccggcctgcctccgtcgccgccgactggtgtcctcgcctatacggtcggttggtcacaccaccgttgatgggcatcgtcatctacaccgccggcctacctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttcatgggcgtccacgtcttcaccgaccggctggccttcgccgactggtgtttccgcctgcacggctggcctattatgccgccgctgttgggcgtctacgacttcaccaccggcctgcctccgtcgccgccgactggtgtcctcgcctatacggttggttggtcataccaccgttcatgggcgtccacgtcttcgccgaccggctggccttcgccgccgccgactggtgtttctgcctacacggctagcctattatgccgccgctgttgggcgtctacgacttcaccgccggcctgcctccgtcgccgccgactggtgtccccgcctatacggtcggttggtcacaccaccgttgatgggcatcgtcatcttcaccgccggcctgcctccgtcgccgccgattggtgcctccacctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggacgtctacgtcctcaccgccggcctgcctccgtcgccgccgagtggtgcctccgcctacacggctggcctattatgccgccgttgttggacgtcttcgctttcaccgtcgaccgccttcgtcgccgccgactggtgtcttcattgttattgatggacgactttgttcccacattggccacttctgccatcaccaaggggaatattataaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagaaaattctgatccgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacgtcaccaccggctcgcctcgaccgccgccgactggtgtttccgcctgcacggctggcctattatgctgccgttgttgggcgtctacgtcttcaccgaccggccgcctcgtccgctgccgactggtgtttccgcctgcacggctggcctttatgccgccgttgttgggtgtctacgtcttcaccgaccggccgcctcgaccgccgccgactggtgtttccgcctgcacggctggcctttatgctgccgttgttgggcgtctacgtcttcaccgaccggccgcctcgtccgctgccgactggtgtttccgcctgcacggctggcctttatgctgccgttgttgggcgtctacgtcttcaccgaccggccgcctcgtccgctgccgactggtgtttccgcctgcacggctggcctttatgccgccgttgttgggcgtctacgtcttcaccgaccggccgcctcgaccgccgccgactggtgtttccgcctgcacggctggcctattatgctgccgttattgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgtcatggctgccgactggtttcttcacttccatggctgcatgattctgccagtgttgattggccttaccatcttcatcgctggtcgtctcgtctgctgctgactagtgccctcgcctctacgtctggtttatacagctaccactactgatggacatcatcatcttccgtcgccgactgattatgccgccgccgactggtgcttttatcttcacaactgcgcgtcttcactaccggtttgcttctgttgccgccgacttgtgttcacttcattacggcaatacaactttgtcatcatggtggagcgacttcatctttattatcttcggcaccggcaaactctattgttgctacttcgcaagttttactacttcaccacccacgacgtctttgtgaacctcgacatctcggcatgcaatgccatgttattttactacaacaagtggctctccaatattcaggatttctacttggacatcttcaacacatatcttcaatcaagtgatgactactcgacaacaagaagctataattctcgactctatgttcagttgtttcccaactaatcaaagagtcgggggctacacaaatacatggctcaaaatttgacaagctttatgtcaagatgaagcaatcaattaatcagccaacaagtcaactctgggagtcatcaattttgtcttcgcttcagagcagtaggtcaagattaaatttacatgtctgggagtttggagtcatcaaccaatcaactcatatcagattcaatgagttgaacaacagcatatactttcctccaagtgaagcatctacaacagtttgatggattattgtcactgacatcatcaccagcacatctgcttcatcagctctgacattccgccgttgctaatggatgactaagactttgccaacttgctattccgccttcacggttgacctactatgcaaacgctgatgagcgtcttcgtcattatcatcggctattacaccgctattgactggatcaccgacatcgtcatcttcatcaacatcctgtcaaacctctttatcatagcttactctactgctattgataggcaacttcgtcatcatgtttgatcatctctgttgatgcttatcatcattactgtcggttacgtttgtcgtcgccgactattttcctcatcttcatgattggtggatttcgtcatcgcctttgatctgcctcgtctgtcaccgactgattatttcgctgccatggctacacaactttatcgctgggcgccttcatcttcattgatggctgacctgactgttgccgactggtttcttcgcctccacggctgtgcaacttcatcacttttgattggtatcactatcttcactaccaccaatatttttgccacctctgttgggcaatattatctctatattggtcgtcttgtctctatgccaactgcgtcagctaccatcaatgaacaattgtgactacgtgctcaggggcttactagctcaaatacaagtattatatcttcaatttggacttgctccggatatatgcaacatgaattcatgatcatgggtctattttatatgctcaaagactggactatttattattccccgtaagggttatcaactgaatacttgcgccagtcgggattcaattgttatatctattttggagtatcccataagggataatcactcagatcacatggtctatatcacccgggagcatgttacatgtgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctggcttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttgaaaatttctttattcacaacatacaagcttctttatagctattttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttatttttcagccctccacagtcttcagatttggtaaaaatactcgggagaccatggcaaagatgattgaagtactcggttttggagtaatctagttcgagagaagattatcttttcgactgtgaaggtctcaggggctactgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggcatgagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacaaagtttacagccggcttagacataggaaccaagaaaatctgtaagacagacatgtggatcatatatttatagtgaatagttaaccactatatgagtgagctgatagatagactataactaagcagctggatgtattattatcttgctctaacgagcaccggctgctgggctcctctccccgtcgctcaacggtctattggcccggtctaatagtagggtccgatcttttttggtccaaccgatcgaccgaaccgggtctgctacgataggtggaagtgtgcccatatccactcctcggcaatttcgcattccccccgaaaaatttgaaatccttttcgcatccctctcctctccgcgattccccactcccggctgcagggcggtgcggcgatggccgacgctccgccgccggtgctgacgctgcaggtgaagaagggccgccgcggcggggagacccggcagtggcgggcgggcgccgtgctccgcgtcggccgcgtcgccaccggcaacgacatcgccgtgcgcgacgccggggcgtcgcagcgccacctctccatcgagttcctcccgccgccggcctcgcggtgggccgtctccgacgtgggatcctccaacggcaccctcctcaacggctcccccctcgtgcccaccgtcccctccccgctctccgacggcgatgtcatcaagatcggggagtccagcatgctcgtggtctccatcgcgcccgattcggatcccaaccctggccctaggcgctcctcgcgccaatccgccgcagtggtgggggagcaggagaaaccccctgcggtcacccgccgtggcggacggaagaacgctgcagcggcggcggtggcggttgagccgcccattgcggagaaggaagagccagagccggaggaggctccagtggtgactcgccgcggtgctcggaagaaggccgcgcaaccccccaaagcggaggagcacgaggagggcgaggaggaggtggtcgcggcggtggtgacgcgccgctgtgggcggaagaaggccgcagagccccctaaaccggatgaggaggaggagcaagagaaggggaaggatgaggaacaagaggagaaggaggaggaggaggtcccggtggtgacgcgccgcggcaggtcgaggaaggcggcgccggaggcagccgttgcgccaccgccgccgagggcaaggtcgacgagagctgctgctaggagaggcaaggcagtggacacaagcctggatgagagggagagcgagatggccggaaagggacggggaagggctacaaggtctaatgcaaggaagtgtaggatggccgttcctgaggacgatgacgatgatggggaacagcaagagggggctactgctgtggcagaagagcagataaaggatcaaccgagggcaatggcggtgactgacggtgaggaggaagatgataaggtggaagccatggatggagaagttgaacagaatgacaaggcatcagaggaggaggaggtgccagtggcgcggagaggacgggcacgaagagctccaaaggggaaggctactgcaagtagtaatgctcatgctgcttcggacaacgcggttgaggaggaagacggcggtagaggagagggagcggctgtggaagtggagggggagagttctgggagcagcagcttggaaaccatgacactgagggagtggtttcagaggatgaatgtgtacctccctaggatgatcaatgaggctgctgaagaggcgctttcagccctgcgggagaggcatcggcgtatagatgagtacatttcaacgcttgaggattagcgtgattcatggtatgttcatctctcaagagaaatctttgtccttctgttacttctcttcagcaagttcagttctctttatgaaatttcctactgctgtcagaatgttctattatgttcgaatagctcaatctttcaggtctagcaatgacttttctgcattgcccagtaattgataattcattttaattactagatacagtatatgtataggaactgtacttgaatgcagttggtattggggccgtatctgcataaatttactatgccatgcctaatgccttattgctgactatcaatctggattgcctcaacatttgcttatgttaaagttttctcgcaacaattttgtaggatcatgtttattgagaaagttcttgcataccaaataacttcatcaggtgctcttgtcatatattttatcttcacttcataagtctgatttatgtcctctcccagcaaaaaccagaatgccgagtgcatatctggctaatctccagtgcaaccattacccattattagtctccaacatatgatgggaacaattacgatgtagttgacagttactgtttagatctgaaatgaatgtgtaattgtgaagcaagtgtgatctattcattcttgcatattgaataactgtttactgatcaattctagccattgaggtgtagcaattaacatagacaattactctctccgtttcataatgtaagacattctagcatttcccacattcatattgatgttaatgaatctagatagatatatatctagattcattaacatcaatatgaacgtgggaaatgctagaatgacttacattataaaacggaaggagtagaacatacttatatctgcagtttgttctttgcctgtaatgtttcccttttgcatccataacatatttacatgtaaaagctgcctctgtcaccatatgatgtgcctatttccatactgctagtgctatgacactccacgttcctgatctgctactatgggactgaagtttcatgagtgatctattacacaaccgaacagataattgttcagctgcagttctttgttctgcttgacgttttgccacagccaatgcttgatgccttgaactaaaatgacaatgttgaagaaattttttgcacgactctttcaagatctaaaattgccttttggtgccacaccgtcttattcagcaagctttacaacccagtgacacagaactcgcaaatagtttttcacagtttcagcgtttccgtttgagatgctgaaaaggaagatacatccagtggatcatatttttctgtgtaatccttgctcccatagtctcatgtattgagctgtggcagaagtacggtttattttgctattcatctactaatgcttgtgcttagcttttatccacaatttgcttaacatgccatctgtctgcaggataattaggagctatttggtcaatctgacgtaggggtgatgcctggagataacattaattggaggcaatgctttgctgaagcgccacaaagatttgctgaagcgccacaaagagccattaggtgatatttcactgggatcatctcattatcgattccagttccaccaaatgccgcaaaaatcattgatgcaatacactgtagcactcttcatgtttactctagttatgtagtaccagtactctagtactcatgaagtaggacctgggttcgtaggcctctatgcaaaggcattcaacatgcatcgcagatttcattctgtaaattgcctctctaaggtgatgtttattcatgcctaacctctatctggaatacaacgcgacaatgttttgaatgtatatgtcgtttctaccatggctgctattaggagtcagaactgattattttgcccctcccccgttttttacttttgaataacgtgttcctggatgatcagtatcaactgttgggaatttgttggtgaagatgagttctcatgttttgatactaaatcagaccaccttctagtctcaatgacctctctcatctcacttggaaaatgtacctgatttgttgcagtgatcctcatattgttaaaacccactctttaatgggatccttcgatcctctacatgcaacgctcagtaataatctcaggtgaaaaatgaacgaatgctcaatcttatctttattttcagcgatacgaagcgcacaatgcaatttcacctgcacagcatgaactgttaaatcgaatggcaacacagaagaaaggatcagatgcaattatctaacaaagaacaacacacgcatggcaacatctggtatccatgccattttgtggagaaaaacacacccatcacccccagctcattcagtgccatgtactgatgtacagactcacagcggaagacatttccaaagggtttaacctgctcatcgggagcacgcagtccacattctttttgcagatgcagaagcattgcttaacttcatacaatgaacaatctaagttctaagacctaccatcagtaactcctagctcaactagaacattggcagcaagagtcatcgttttctcttgccatgagtctttgacttgttctcaaggtcatttcctggtggcgccttaagagacttggatgcaactgctgagctccacagcgctctctcaacatcagaagtagtgaaaacttcttctcctgagctcaattcctaccagagaaacaaaaaatatgaaataaatgtcaatcaagcaccgcatgtgttcatcttcagacttcagctaacagtccaaatgttcaacaatctataattttgatatggaatttgcagtttactcggtgttattctagcaatgcggacgttacatgcttgcattttgcaaatataaaagcataacgttcaagtactaatcagcttatcagtatattaccctattgttgcagctgctgtctggaataaaaaggcaagcagctgaaaatttggcatacgatttttgtaatgcatactctgtaaatttatgagcctggcatccttgagcctattggacgttatgatttagagaagcatcagcaaacaagaaaaaggtgttatctttctgcactagttcttgaacagtactataacaaaaaatatgtggtggtatgttctatttcaatttcaaatgtcagctaagatcaattcttctaaaatgactccacacaaccagctaccttttgaagtccctttcagtttatctgcattaaatcaaccacatatttgaagtgtatcaactagaaatctccacacaagggaatacaccgtatttttttcccctttgtctgaactcaagtgatagtcaccgcaaaacaatcctaaagcattaactaggttcagacttgcagctgcctagcaaaccgaaggcttattatacagacacttcgatcagcacaatcaggaaaaacaaatgctatcttaacaacagtttatcacacatcacaaatgcagaagcaataccttcgatttagtttgcaacttttcagcaaaagcaagatactgcttcagagtgtactcctttgcattgcctaaggctgccaccatagcctaaacacagtccatccatgtttacaacatcaaagatgcattcatctcacctggaaatgcagaactgccaaaacaaaattcacaaactcacctcatcagacatgaacggtgcaacatcaggcgcgtaggcagcgagaacagcggatgccgtggcagggccaacgcccttcagcacggtgagctcggtgatggccttgcggaggtcaggcagcgctgcgaacgccttgcacgatgctgattctaccactgcatcctccaagcccttgacgaaatccatcagtctcggcctgcacaaaagaacagagcaacaatatgattattttttcccccaacgagtttgataataacagggtagtgtaggagtatcatcaactaaccaactagggtaatgattgatttgccaagaaaacgagtccctaaatcaatggatcaaatcagtccaagcacccttaagatactagcatcatccaattgatccacacatttcggcacgatttctagggagatttgagcgagaaatactactacaacatcacacgcccctgggaaccagaagttcaagtgctctaaagaggaacaggaaagaaaatctaagagcgggatgagacgacctccacttgccgcgggagagcttccattggaggaggcgcaccagctcgggcttggcgaggaagggctccgggtcgcggcggcgcaggagatcggggaggtcgcggcggtagaaggagtcgacctcgacgaggtcgggcttgcccagggccgcgagccggcggtcgtacgccgccagcgccgctcgccactccgccgcgtcgccgctcgcgaagtccaccgtctcggccatcgtcgttaccggaggcggcggcgcggtggaagaggtcacttcggcgcctcaagagccaggaatttcaaacagactagtatctacccatgtattaatatctctcgataaatacaacttcggcacatatcattggatatctactctattatattatcatcggtcgattggattgattgttcaagttcttctattgtctttatatcattatttatctgagcgttagaatttacctcggacatatagccaattgttcaagaccatatcaaatcggcttattggctgatcggttcttttatcatcaatttatctatcttgtcagttatagtatcaaactgactgacacgtacaaacctgatattttaggacttgcactggagcaaagcacgtatagatgatgtcagcacaagcccatctatagatagatgtttgttcctccttttttttgcaagcgtcctgtgcgttatattcttattagacactctttaggcccattcgtgaatgatcctatgtaaatgtaagcttctctattgcctttatgcgtacaaaaagattattccgtataagccttttctagtcttatttcgataccttagttatcttctagagttaggtataattatgataaataattatttctaaagtgtgaatgatattgtccattcaaatatactccctccgtaaaaaaaaaaagacaaactctaggtttccgtgtccaacatttgaccgtccgtcttatttgaaaaaaatatgaaaaaaattaaaaagacaagtcacgcataaagtattaatcatgttttatcatctaacaacaatgaaaatactaattataaaaaaattcatataagacagacagtcaaacgttggacacggaaacccagggtttgtcattttttgggacagagggagtttgatccaaatgactacaattattctaaaccacaacaaaaataatgatgttggcataatatatatttaatgtggatgttttttattttaccaattttcgtttttcgtgtgctggaacacatcaatttctcccagtggcaacgcacgaacacctacctagtgtaaaaaagaagagagaatctactatatgctactgagtttgtctcagttcaacgatttgctactgataatgtctctttgtgcaatataccgatgggacactgaggagagtacaaagttcaagaagattgcaatatatcgatgggacactgaggagagtacaaagttcaagaagattatttgagccagtgaacatatcattatgatcatgatggtgagcagcgtagtggatatatgtcccacgccataaaagaactagtgtgcttcttggaggagcaactccagcaaccccaaaacacctcagaccacgtatccacccagacatatctacgtaagttcgataagcatatcagtcatggtaactaattattttagtaaacaacaacattgaacaaactctccagattaactcggaataaaaccataaaaaagtgggaacaaactctccaacaaacattaacctgtaggacagaggcttgacataagacatcgggacatagatgataaacattaacctaaaggcaaggatcatcgatgtgatgctcgccacgtgaactacaatcttcaccctcttgatctccatggttttgggttgctcgtcatcgccaatttgaaccaccatacttattttctctaatatctattttgtcatatataagtcaacttaaacgcataccacctatacacgattcttggtagatgagcactacgcgaccatccgcagtagctagtagcgcctcctttatctcactctctcccgcaccgtcgttgcaacagtgcctaagagcgaagtccacgacaggcaataccccacatgcccccctacgctcataaaacaaagggtaccttatagaaatagttgatctccatggttgtgggttgctcgtcgtcaccaatggagcttaagctaaagtggaggggaaacctatagaaataaacatcaatatttgaataaattgatcaaacatttaaaattttaggatgagataatcaatttaccatttattttggttaattacaacactttgagctaacatatatcacttgaaagaaaatagataacaggatgacaaaaacgaatcatccacaataagaattaacagatatcacacctgaaaataaacttacactaataaatataaaaagggtttgttggaaccatgctaaatttgagatatgccacccgcatctcaatgacatgtaggacccacgagtcaatgacatgtgggtcagggtggcatatcacaaattttgcaaaatttgtgtggcatggttcaaattgtcccatataaaaaatgcattatcatttgcagcgtaaggaaatcaaacttaatatgaaatgcattcctcagcacgagacggtagatgtgtacatagtgctaacacaatcagatgtagagtacatatatcatcctaatcctcaagacgaaaaatacgtgtagttttatagatcctcctacttctcggcacgaggaaatcggcatcgaagatccatagcatgcctagtgccttgacaatgctacgatcgtgttgtctagcaagtagggcagtacccaaggctgcaattagccctacctcacgtgcagcacatgagtacctgcatgaacataaatataagttaatcaaattagggggcgtttgagagggaagtgagttgaaagacctcatttacatggcaagcattaaggcccatataaataaaacattaattaactctatccatttccaagatatagttagttttataaataatttctgacactattccaaagccaagtacactcatccactgttgtttaaaaatgtatttgttgtactacaatgatgaggaaagtagtaacattttcaacccaagacaaatttattatgaaaatatattcaattattgatgtgatgaaactaatttagtattataaatattactatatttgcctataaacttagtcaagacatatccgtaaggtcggtaaggataccagtcatggtaactaattattttagtaaacaaaaacactgaacaacaaactctctagattaacttgaacaaaaccacgaaaaagtgggaacaaactctccaatgaacactaacttgtaggacataggcttgacataagacgtcgggatataatgataaacaccctgatgacgaggatcatcgagcacatcctcgccacgtgaacgacaatcttcaccctcttgatctccatggttttgggttgctcgtcgtcgcaattcgaaccatcaaatctcactttctctaatctcgtcatatataagtcagccaaagcgcctaccacctacgcactagataagcatagcgcgaccaaccgtggctaataacacctactttctctaatctcgccatatataagtcagcctaagcgcctaccacctatgcagacaagcatagtgcgaccaaccgtggctaatagcgcctcttctatcttgccctctcttaactagacaagcacaacgcgaccaaccgtggctagtagcacctcctctatcttgccatctccgcaccgtcgttgcaatgttgcaacggagcgaagcccacaaggggccaatgggggcacatgcctttctatgctaatagaacaaagggtaccttatataaatagttgatctccatggttgtgggttgctcgtcgttaccaatggagcttaagctaaaatggaggaggaacctatggaaataaacattaatatttaaataaattgatcaaacatttaaaatattaggatgagataactaatttaccatttattttggttaattacaacactttgagctaacaaatatcacttgaaagaaaatagataataggataacaaaaataaatccaaaataataattaacagatatgacacctgaaaataaacttacacaaataaatataaaaaatatattatcatttgcagtataaggatatcaaacttaatatgaaatgcaatccttagcacgagacgtagatgtgtacatagtcctaacacaatcagatgtagagtacatataccatcctaatcctcaacacgagaaatatgtgtatatataatactgcgtatagttttatagatcatacttcttggcacgaggaaatcaggatccgaggatccataacgtgctagtgccttgacaacgctaagaactccaacaaacaccgctagcacagatccaactaggaaccgtgtgcactcaaccacgctgatgcaaagatcatgctgtctaccaagcagggtagcgctcaagctgcaattcaccctacctcacgtgtaacacatgagcacctacatgaacatagatataacttttactctatataacttaatcaaattagggggcgtttgaggggaagtgagttgtaagacctcatttgcatggccagcattgaggcccatataaacaaaacattaattaactctatccatttccaaaatatagtcagttttataaataatttccatgacactattccaaagccaagtaccatcatccactgtttgtttaaaaatatatttgctcgtactacataacgaggaaagtagaaaaaatgttagtagtgctttactactccattcattgcccagcttattttggtccatcattggggagggatctttcattgcacggcttattttggtccatcattgattggggagggatctgaggaaaagacattgaaagtatttcattttattctcaattttttctaaacaaactattaatacttgtactttgaaactgagagagtagaatttattgattatcgtcatgctctatgcatattaatcatgagattataaagtataaggagattatttgagccagtgaacatatcatattgatcataaccatcatgatgtgcagggtagtggatatgtgtctcacgacacaaaagaactggtgtgctgattggaggagcaactgcaggaacccaaagcacctcaaaccacatatccaccgagacatctccgtaagagcaactccagcaaccccaaagcaccgcaaaccacatattcaccaagacatatctccgtaaggtcggtaagcatatccaccaagacatacctacgcacgattctttgtagacgagcacatcgcaaccaaccgcgaatagtagcgcattttctatcttgccctctccgcaccgtcaatgcaatgatgcaacggagcgaagcccacaaggggcaatggggggcacatgccccttaagctcatagaacaaagggtaccttatagaagaaatagatgatctccatggttatgggttgctcatcgtcactaatagagcttaagctaaagtggagggggaacctacagaaataaacatcaatatttgaagaaatcgatcaaacatttaaaatattaggatgagataagcaatttaccaattattttggttaattacaacactttgagttaacagatatcacttgaaagaaaataggtaacatgatgacaaaagtgaatcatccaaaataagaattaacagatatcacacctgaaaataaacttacactaataaatataaaaaatgcattatcatttgcagtgtaagatatcaaacttagtatgaaatgtaatcctcagcacgagacgtagatgtgtacattgtactaacacaatcagatgtagacgtgcacattacagtacgactgtgtacatataccatcctaatcctcaacatgagaaatacgtgtgtatatatagtactatgtatagttctataaatcctcctactacttgtcacgaggaaatcgggatcagaggatccataacatgtctagtgccttgacaacgctaagaactccaacaaaccccgctagcacagatccaacatgatataaagggcattaagtggaaatcctctatgtttaactttgaaatcaactagttcttgagaggatttacaacatgtagttgaataaatttggaattcttataatgaaaagggttctagtattgacaaatgcgttggagaatgcaaatgataggaaaaaggctaaaaggatagaacatgaactgagatggtgaatacaaatggaaaaaaaggtggcaaatgaagtattcatatcaagattcggatagagatgagccaagagaagtttggagtggagggactgaagtttttgtgtgctcctctttttggcctgatgccgatggatgcaggttttctgccctagcttatttgtagtttttttggtagtcgatttggtcacacctgaaccaacgagaattaggccaacaccttttattttctttcttgaacttaatttctcttaatacaatgatgcataattctttgccgtattccctgaaaatactttcactgaactaaagtatataagaaggagaaatagtgatcaagctaataaatgaaacatggtgtaataaaaaaaaccataaacaaacatgtgagattgtgataaaaagcaattgtaactatatagcagctcatccctcatgcggagagagagataatggggagaggggtgtttataataaggatgagtatgcattcatgataatcttaacaacactaaacaaccttgactaacctggccaacagttcttgtgtgcacaatccagaggaaggcactaaatcactacatgccaatcgatagaagagacaaatacttggatgagcccctacaatatgtccacaggcaaaaaaagttgacagacttgcttaggagcacaccaaaagccagatcaagtaaatacaatcaccaaacatctattttgttttgtattttttatacaaccccctaatgggaataaactaagcatgttcttattgatttagttgattgacatggatgagccattgaaatatttgttaaatataaattactttccattaaaatataataacaaaaacaaggaagaaggtttccgcatgtaaaagtactaaaaagataattcaatatgtattcaaactttagtagtacctcaagaaacatttcatcgagcagttcttgagcaccaaaaacctctaatgcgttcctcctcttccttgttctctttgtatccttctattctctagccatggcagcagtacacggcatcacatacatcatgaggtcagcacagagcagaagcaaatcaacaacaaatcaaaaagagcaatgcggaggcagtaacataatagcagcagcaacaacaacaacaaggatacaaagagaacaaggaagaggaggaacgcattagtggtttttggtgctgcagcggaacagcaaatcgtccctaccaagcaaagcaagagcattgaactcattttttttagcagacggtaggagcaaccgcataggagttggcaagggatgtgaagacctgaaaaaatttcaaagccttggtaaatcagttacttacaacaactgtcaggcgactcaagctcgtgctgccaaccgttgttgctaccatctctccccctttgtccgcaggaaaccgccactattgccgctaccatctctcccctttgtccacaagaaaccatcgctatccccatcctttgcatctgtagtgatacatggatggggataaacggaagacaatggatcattttataagatttcatctcttcctcctcttatggtgacgacgttgcggcctgctacctagtcccgctttgctcgccctagggtcacactcggccctcaacccatgctcactgcgttccttatggcgaagatgcggagtcgaggacgacgacagatcgacagcaccgacagcggtgggcaggcggcgatgtcgagcggagttgatgtgtagcggccacagcgcactgtgttgaggggaggtggcgacatgggacaaggtgacggtgctgggctaaggcgcacggtggcaggcctgttggtgagccggcgacggcattggatgagggatggcagtggcgatgagccacatgggaaggaagaggggtggttcaaggcggcgacgaagtggaggcgtggggtgctcaaagcaaggaggttgtccattggtttcactaatcctactactaatccatctgctaatccaactcacaatgtaggtcgttagatgagaggatccaacggttaggaatgatctgggtatattttgttaattcgttttgactttttccgtagccaaacttaaccaagttttttgataacatatttgttttgtatttaaaatgctatgctaacttgattaaataaagtttgattagtcaaaacaacttataatatgaaacagagagtatatgcctactaattactaattgacttactatactagtaatatgaacgtgctaacgctacggtgatatttcataaaacaatggtgatagacagaaaaatagaatcatgttgagaatcaaacaactaattatacttgttgctcaaagtatattgatttaaaacccattgcatgatcagtttcacttgagcaatcaaagcgtaaggattctttgaaaaataaaatcaaccacatacaacagtagtgggagaccatagtttacagggtcaataatcatgttttctccttttctagcctccaaagataggaacattgattcaattgtttttaaaagagtaaaatacacggccggtccttaaacttgtagggatgtgttatctaggtcctcaaaatacaaatccaggtcctagaacttgtcaaagtgtgtcatgtaggtcccaaatcgtcacagctcctccaggatcttacatggcactgatgtggcaatgacacacagacatgacatggcataatattgaatgacaaatgagacccacttaaaaaattttcatttcccttttttattctcttttttttcctttcttctccttttcttgctctcactgcagctataggccaccgctacacgggttgctcaggtcacagagaaaagagaagagaataaaagaaaaaaaaagagaagaagaaaagaaaaaaaaggaaaaggaaaatttttaaatgccacgtcacgttcgtgtggcacgccacatcagcgccacgtaggattttggaggagttgttgcgatttgggacctatatggcacactttgacaagttctgggagttggatctacattttgagagtttagggacttagatgacacacctctacaagtttaaggaccgcctgtgcactttactctttttctaaactcccaagttactttagaaaggttgattttgaagatcatctgatttctaaccaacattttttaagatgttggagaggtggttgaaaaccaaagacataaaaattacatgatttggtacaagacaatcacttgttaagcatccaaactacccttcatcatgctcagaagtaaaagagagctgaaactcacagattcagaagtttggatcactgaaggctgcaacatggactgttcacttcagaaaagagtcgacacttcaaatttatctacactgatcacacaacctaatagattcaccagacaccaatctaatgacatatattttgacaaaatatgtagcagagaaagtactaatcattcataaattacaccatgaacgttgcttaccacgtagagcaacaatcgacagaaagccaagcttgcactgttgtttccagcttcctatagattttcctgcaaaactataaaactggtgaatttcaacaccaaacatggccaatgatatttaatcatgaaaaatcggtataaatctaacggcctcatcttttcgcttatgcttattagccagaatttaaattttcaaccttaaatttggagttgattttgggttttttttcaccgtagtttattttttagcctttgcttttagatcgttaagaacacgtacataaaattttattcacaaattatttttcgtttgcaaataagccatttggcttattcctcaaataagccaaacaatggggtcgtaaaaggctaacctcaataaatggaaatcttcattgatcatgatgaataaaaaacatgaccagagctactactatacataaattaaaaacaatattttttttataaaaaaacactactaattggtgcatccaactcacattaatagataactcagtacaaaaataggaacattgattcaatagaataagatgctaatagctctcccatccctaatctcccaagttactttaggaaggttgactttgaagatcgtctgatttctaaccaacatcttttaaggtgttggagaggttgttgtaaaacattaaaaattacatgatttagtataatacattcaattgttaagcatcctgtcacgaaccagggggctgctggaacaacagagtcagcttctgctcctaatctcataccatttgtcgtgatctatgaagtaaaaattgtcattcagataattaatatgaagagaggaaaccttataataccttctagtggcaggccacacagttctaatagccttcacctccacttttgcagcaaggtggaagtaattttacaaaaaattaactaggttagtagagcgcagatgttcagtgcaaaattactcaccagttgtcttcccataaaacagaaaaagtagttgagccttataaaataaaaactttgatgcagggtgttcagcattattggtgattaggaaatagttccagttctaaaccagagatctaccgctgtttacaaactgaccagaatcaaatctatgnnnnnnnnnnnnnnnnnnnnnnnntgcatatgttttacacactttttcaagaacacacgaatgtactgcatgcccttcatacaaagaggaagatagggttagacatatcgtattactatatctgaataataagaggatgatatagttaaagcccttcatcatgctcagaagtaaaagagagctgaaactcactgattcagaagtttggatcactgaaggctgcaacatggactgttcacttcagaaaagattcgacacttcaaatttatctacactgatcacacaaccttatttcgctggacaccaatctaatgacatatattttgacaaaatatgtagcagagaaagtactaatcattcataaattacatcatgacctataaaaacaccatgaacgttgcttaccacatagagcaacaatcgacagaaaaccaggcttgcactgttgtttccagcttcctacagattttcctgcaaaactatgaaactggtgaattttcaacaccaaacatggccaatgatatgtaatcatgaaaaatcggtataaatctaaaaggctaacctcaataaatgaaaatcttcattgatcatgatggataaaaaaacatgatcagagctactactatacataaattaaaaacaatactttttgattaaaaaaacagtactaattggtgcatccaactaacattaataggtaactcagtacaattagcccagcagccatttttcctagccacaacctttaccacaatgcattttctacaattggcctcatttttgttttgaaagcaataatgaggacagaaaacattgggagcacaatttaattttatgtctggaacaaattacgacctggaaaaatcagaaatgcatttgccgataaaaaaaagccagtgaagttgcagccaggtatttgccatgccgctgccatagcctagcactctataagtatatggccaacagaaattgtaaagatagcctagcactctgtaagtatatggccaacagaaattgtaaatatcaattaattcaacaagtatatgacagtcaatacttccattgtagcctaaaaacaaacatataagaaaagaatgcatcgacgattatattctctagcgtgttcagactttcgatatacatattgacaaggcctcacataaatttgaaagtgagtattaaactaagttcataagtgatcttaaaacaagtaaaagaagaccatttggagtgcgtcttctggaacccctgattgccaagctttgtagcatgattcttcaaaggagcaatcaacttcaaatgtctggtccaaaatttcccctcctgatattcataatacatagaacttgtgttcatcaagggataaacctagtgaattactgttgaaacacaggaaacaaattatctccagagcataaggccaatctcacagatagaggtacaaaaccttgattaagtctaacattctacagtgcggactcgatatgcacacatgacagtccatttctattttagagagaaatcaaacttcatgtaaattttcattgatgttgaaaatgaaaaataagcaccagtttacaataatgcacatagaatctatgttggcaagaaataaatcattgcaacggagaagaaaccaagcatcattattatttccatacaaaaaaagagttagagaaacatcagaaattcattgagtaggaccacatcaatatctttatatttgatgaataatatctttacattgttaatgaaagtacatcatatatattgtggtaaaagcagttctcaaatgatttctaaaaaaagaaaaagaaaagaaaagaaaagcatatagcaccctcaaactatcaccaacatgacacacttccgatgttcatggaagtataggcaaattatcatggggtgtgcaatataccagcaccctgaagcaccatacatagcccttgcacactctggaaacaattgatcccaataaatcccaaaaggatatgggtgaagtgattccacactaattaacagagttgtattgtataaaaaacaaacaataatcaatattgatgcagaagtacttaatagcaccaattgtggtatacatggttttgagatctgcagttaaattacagcagttacaccaattgagtttcacaaatgaaaacaacagacctagctacagtagtacagtgtacatctagtgtaaactaaaatgcaatcttaaaataaaatcatgtttaccttcaagccagggcagatggattgaaattcaatctttaagattcataaaaatattgcccctcaaataattcctagggtgacaaatacatactgtatacagaactaaaaaactggagtcattgcctcacatcttttttgagaaggttgaaccaacttaggagcaatttaagtacacaatattcattcaaactcattttcttttctgaatctatgaccaaaataaacatggtttgttgaaatttagtgatccagcaacgggaacaatatttatcatataaacgcaccttaatgaggacaaagcttgtgcctttcttatgagcttctcatatcaacctgccataccacaaaaaaattgccatacaaatgataaggccctgagcttatttattgtccaagacataagaaacaaagagtgatagctgatatgcatatatagtttagtatgaaactaaagaatgtagaacccaaaatttcctagcactggtgaggggataaatgtacaggatacttcaaattttatatcacgcatagaaaaacacaatattgataaagatactgaaaaatggcaagaacaggagaagttttatacgatctttaaatattgataaataatacatggttaattgaaagtactaagaatgaattaactcaacattctgatagtcctgatcagatttgtagccttatttagtaaattttaacttctttgctatgagcaagcattgcctggtggttaaagtcacagattgcacacccgtataaaaataaactgcaaaggagcagcttaaatacctcagttcatttggtaagtttactgtatgctatatacaagtgatctccaatatgggacctttcatgatatccaaacctaaacaattaaaaatcagaagcctcccagttagctcctagaaaccacagttcacaatagtacactgaaacaacacagaaaaagttgctctttttttcctaaagtaattatttagtaaaaacttgtaatgcttcttctttacacagtccacaataattggattgtcacatgctacagctaacaaattcaggggagtgtacatcttacaggacagagggtctacgggagcactattcattacatggtacagtcggcatgtaatataacagctgtaatgataatgaccttatgatagtaatgaaaaacagatgcatacttcaatgaaaaatcatgagcaagcaaaataatgaatagcactaagcatggttcctcaatttgtgctggccacaaatgaatatgtccataaaattcctcaatttctctctctcccacagtgaggatgataagcttcgcagcagtccctgaaagtgaattttatggcagaaaaggaaaaaaatcataatttgccctgaaagcaaatgcaaaaaagagccgatgtgtatattatcatgggtaaacatatatgactattcagctgaacccgttgtgtcctggaactagtcttgctgaaagattagctgaaagatggtagtgttggttatgggacctggcattcttcactaaaattccatttaaggttttataacagagtaagaaaactgatgttagacactatactgaaccgatcactgcatttggcaagctgtacaccgagccaaccaaatgaaattatccatgttggccatttcagttagcctttatgtacttgaacaatagcaacaagagctaatgatctactgtcacatgggatccaaaccgctaggcaattcaaccagtcttatcagaaagcttctctttatcatagattatacatgttagcaatttctgttgcatattctcaacttggacgcatgcatcacatgtcaccaacttgaaatgacgataaacaggtcttaccttcacaacagggcatatgaagaggggaatgggatcagtgcggcgtcgtgcgatctggcgcaaagaggaccaccgtggagaggcgacacgccacgtcaccgacggaggcaaacggatccagaagccagacgcctcgtcgattgcagactgccgctgcgcgcggagaaaggggagtcggcgatggaggccgccgccgcggagtggacgtagctgtgaggtgggtggcggagggaggccggcgcgaagaaggtggcggagagtcggcgaccacgggatggaggtggttgtgaggtgcgcgggggcgggagatcggcgaggcggagggacggcagcgtggctacggctcggccgcggtggaggcagcactggcggcgctttgtcgaaggagatcggcggcggcgtgtgagaaggagagaggattagggcgtggaggagagagagaggcgcggatcgggggatgcgccaagggacggaggaggcgagcgtgaggaaggcgtcacgggcggcggggttgggatcacacgcagaaaagtagccgttggattaagatgttaccgttaggtggctgagaatctgagacgtactccatattgtatactagggctgttttgcaagagaaattcccaaccccactccctcgttttctgcacacacgtttttcaaattgctaaatagtatatcttttataaaaggtttttatatgatagttgcttaaaaaattatattgatcctttttgaaaaaaaatacctaatacttaattaatcatgtgttaatggaccgctctgttttccgtaagaattgttccagttgggaactgggagcagcgaacacactcctaggccgtgtttagttcccttcaaacttccaaaaatgctgtcacatcaaatatttggacacatgcatggagcattaaatgtggatgaaaaaaacaattgcacaatttgcatgtaaattgcgagacgaatcttttgagtctaattacgccgtgatttgacaatgtggtgctatagtaaatatttgctaatgatatattaattagacttaatagattcgtctggcagtttacaggcggaatctgtaatttattttgttattagtctacgtttaatactttaaatgtgtcttcgtatgcttaaaaaaaaaattggccaaagaactaaacacgtccctagtactgcttaaccgttggcacgcttgtactccctccgtcccataaaaaaccaacctaataccggatgtgacacattctagtactatgaatctggacatacatttgtccagatttattatactagaatatgtcaaatcccgttctagattcgttttttcgggacagagggagtccttgagaaactatcatattataatgtttatttattcgcacaattatacaaagtgcatgtgtatataataaaagttattttcacccattacaaagaacaagcatctgttggttactcatccgtatctagaaaagaaaaaaccaatagaaatcatctccttttccgttggatgtttctggcctactccttcccttcttatcctcgtgcgtagagatggcaacagagaattcaccatcgggggtcacatccgtgtccccatccccgtggtgatcgaagcttatgggagaggtcaaagccatagccagtagccaacaagggagagaaacggtggggtggcagcggagatgggtctagaataggtccctagctacaggacacgcaggtcaccgcggaagacggggagtggagcaccatgcctgccccaccatccccgatggtgatgagttttgcaccattagattccccgtgaatggcaggtaccatccatccccattccttaggccttgttcggttaatccccttgagggagggattggaggggatttattccacacggactggggtgtggaattatttcccctcaatcccttccaatcattttcaatcccctccaaaccgaacaatgccttaatgtgtgatttcaccatggggaatcggtgatcgagtccccattgccatctctactcgtgcggcccatccggcatgcctccgtttcaggccgtggcctgcctcatgctgacaggtatggccaggatccacctgtcactcattccccaacatctagttgctctccctcccgagccggccacaatgcccacgtcgctgccaaacccgcgtgccctcgctacctccctcattgccacgtgctccacctcttcccccactcgtcccgcggaaaacagcatggattcgagcccccacaacctccgtgaagtctgaagcttcctcaccgccgtcgcgacggctcggcctataaaaagctccccatttccgctattgtccaccacctacggaacataaaaaaaggctggggtagagatgggacgggcagggaaggaagcagatggatagggttgggggtaggaggggaggggatagattcggttgtttttcggaaaagcccttgtgtttttcatatttacaacactacccctaagagcagaatgttctcttcttcgtgtcgcatttctgtaaaaattaggggtgttttctataaaacggaacatgatgttagtcggtgggaggacgtgcgcgctattccgtccaaacacgaggactttttttttgcataaacaccaccacgcggcatttactacgagaaaggttgtgcgtggcgtacatacaggacgagaccggcacaaccggtggaggaaacagcgaaaaaaaaatcatgtcacccaattgaggagcttctgcacctgcaaactatatgggacaactacagaggagccaaaaaaattccaaaaaaaaggagaaaaacgatagctttaggggtttaacatattaaagatttcatccaaattttgtaactaattcaaaacgattttactatatactaagcgattttggttggatggtagtagaagggtttttctaataggactaaagtaacagagataagcgattttgtttggatgaggaaaaaaaagatgtgttccatttaatcgaaatctcttaatatttttgggacggagagagtgtatgttgataaattttctcttcaaacttaacaaatcaaaaacagtgtaattgtaattttaaacaataataattggtaagaaacttttacctaattttaaaccatcagatttatttcaagatccatgcaaagttgtgaaaaatatcatagtacacaaggtgaggagatttggtctcgcagccttcactttaggaaaatagcatgttatccttggatatacaaattatattatagttacatataatttacagtataattacactatgattattttgtttacatctggtaaattttagggaaaaatttactataaaaattttatgtagctaatcttaattcaaaattcttggtgtaggtatgaaccgttctactatttctttttcttgggggtgtaatcctgtacgttgatttctatcggacggcgtagatagcatccgctggaaactttgccgctattaaccgagccgagctgcccattctcccgcggctgcgcttccggcttaaaccctagctctatggccgccgccgccgccgcctcctccatggcgaagcgcaagcaacgcaaggcggcgacggagcaggaggtagagaaccacgacgaggccactgtcgccgcggaggcggggcccgagaatgacgggcacacggcgcacgccgccgaagaggctgcggccgctgaggagggtgtcgagcgcgaaggaggaggcgagggcggcgcggagggggaggagggcccggacgctgcagccaggggaggtgaggagggcaaggaagaggaggagagggaggtgagctttgacgagcttggcttggacgagcaactgaagagggctttgaggaagaagggcttggacaaggccaccccgatccagagagaggccatcccgctcatcctggtgcgtgatttctggcatccatgctttgttttttttttgctttgttttgttgaattactggaaatattcgtcgttaatatccaattattagtgtttcaatgattgattactgcatttgtgatttaagccctctctccgttgtgagaagattaagcatggataatgtgatgccattgtgcaaattgttgtgccgtttgcatatttgggttgtctgctttgtctggtgaaccttttcgattagttttgctatatttctactgtttgtcaggggcagacatgctaagtttaagttatttagaaaaaaaactttcaaatctaattatagtataattgtaatataattctgatatagttacatttgcatgtttttttcccaaaaaacttgcgacgtttttttagcaattccagcagacattcaggttttcaataatttgtgcaactgacgaatagtgtaatactgtgatttcaggaagggaaggatgtggtcgctaaggccaagactggctccggaaagacctttgcttaccttctccctatgctgcatgagctattgaagttgtctgcagaagggcgtatccgaaaatctgctccaaatgttttcatccttgtgccaactcgcgagttatgccagcaggtatcactcatctacttgttatgagatgagatgatttttgtgggcagtttaatatttattattagctatgacgtatgagtagttcaatgatctatgtcaagttgaggattaattctgaattcataggctacataagaatggacatatgagtatatcttttaatttaatggcagaccctcatactagtcctttggtttattttttaatgtactgcattatatggtcataatccataacatctatgtgattgtttatttgaattgcttgtggtaggttcataatgaggcatcatctctccttgaattctgtacatccaaattgaaggttgtgcaagtgaatgcgagcatgtcagacaaagatattgtgagaagtctatcttattctgttgttattttctgtaaataatattcatgtttttcgtatgaatgctggcaaactaacttgtttcttactgttgtttgcagaaagttgcattgtctggcccccctaatatacttgttacaactcctgcttgtgttgcatcatgcatatcaaagggcattatccgtggatcatctatcaaagaatcactatcaatgatgattctagacgaggtgcagtttatttgccttttcatgatttattttagtttgatacatatcatcaatgggtaatttgataagattttatttccacaagggatgataattttctttatacataaaaaatatggctgtttaaactgtgtatgtttctacattttggctgtcgtgcccttcctcaagttaaacaaaatacttttgtgattattttaagtgagtatggagtttattttgtatgatcacataatgctgacattgacatgtgccgctgcaacagtgtgaaatttgctatggtgttgaaaatttcaagaacattttgacaactaatatgctgtcttactctcttagactgttgtatattcaaatttgacaccttttctgtgtaatattatactaagtttcttttgaaggaggtactaatccattaatggttagttctcaggctgacctcctcctatcctatcgttgtgaagatgacataaaagctctcgttccacatatcccaagaagctgccagtccatcctgatgtctgcaacgtcaaggtgaaatttggttccatcttccttccttttcttcaattgttcaattgttttgattttgcagttacacgatttggttgttctgagcatcaacatttcaatcaaatggatggaacctgtaatttaaataaccaaaaattgggatttttctgttttgaatttttaccatactattccagcatgtctgtcattgcatctgttgatgagattttgctagcagtcaacctggaggttgaatccccaatattgctgcccttgagttggtagaacactgttgtagtttgattgtccctccttgcccttgcttccatttagatttcatatatttggtctgatagtaacgttgacttctttttacagcgctgatattgagaaactgactaagctacttctgcacaacccttttattctgacccttacggaggttggtcatgcgaaggatgatttgatcccaaaaaatgtgcagcagttttgggcaagtactttttcctgcatttcagacaatcagcctttcagtcgtatcactgaaacatattaagatccctcttggatatccatagattcccaacaaacatttaaacaacctatggtttcatgttcctttctagtattttttctggtacaattctttagtggtgattatttttgccctgctgatttccccctaagctttcctgtagtagcttgtatatcatgtactcctattcaattttgtccacagatatcatgtgatgctaaggataagatgctttatatccttgtactcctgaagttggagcttattcagaagaaagttctcatatttgtaaactcaattgactcggcattcaaattaaggctgtttctggagaaggtaaaatggaaccactaccttacagtagtcaataattaaacacgtttgatgatttggtttcttaatttgttgtctgtaatttttttccattgttttatttcagtatgttaagtgcagtccaaaccttaattttaggccattgtctgattgctgtctgaacataaatcaaagtgaaaatgttgtgctagtctagaatacttggtacaagagtgtcgagtttttgaagactccatggtaaacagatagttatggggcagcatgtcaggatatgtttctgttgagtctgtagaatgaatctaagtgctagattattggacacttgaaaactttcacaaaatactgaatttggaacgttactttgtttaatcttaattgcatgtactggagtaagagtgtataaagtaccgtggactgaagttaaacaggccagtgccttgtctttgattgtcatattgggcatgttatggctcctcgctatgatatttgttacattatttctttgtgttgcttttttctggcagaattctttgtccaacaattttcttccttggttcttgcatcattttttaaaaataaatatgcttattgatgaataatttatccttatggtgtctatgttgtacttttacagtttgggataagatcttcagtgctaaatgctgaattaccacaaaattcacgcctccatatcattcaggtagcatatccacagtgcacgctcttattgctgctattgtgctttattattacataattgatgataattcccactgaatatatctttctctttcaaatgtttgttgaacaagtaaatctcttacctatgtttccatagtttttcatcttattttggattatcataatctttagggaaactgaatctggttcagttatatttagtttttaagcttaccaacatgtccacatcaaagaatttccagaacaaaaagtgagtgggctccaggaaatgtttaggctctagtgttctaaagaagtctgaaagaatatcttcttgcgttgtcctaccgatttaaactattatctttcttttaggcattcaatgctaggctatttgattatctgatagcaacggatgacaataagtctaaagaggagaggcaagccaataagggaaacaaaaaggattctagggtgtcacgcaagcagttgcagcaaactttagatgctgaattcggtgttgtcagaggaattgacttcaaaaatgtattcacggtaagttaatatattgatatatgcaagcatgccaccagatctcattgtggccagagggtaacttgagcatacaactgtttgacatactttgctatcattttgttttaaaatagtattttatcttgagcctgatggtaaattatttgttatttttatagttcccattcgaccttttgtttctgaaacaggtattcaggttgcaggattgatattcttttatatttggccttttctttaggtagttaattatgacatgcctccagatcctgctgggtatgttcacagagtaggaaggacagggagagcaaataaaactggtgcatccatatcgcttgtaagttcaccattttatgtggctcaataaaaaaaaatcatcgcagagatagctaacttgttttatagatcctatctggtatttatttattcctttggtttggtgttggaccttttcaggtttcaccaaaggagaatggcatttttgaagatattgaaaatatgttgaaagatgttgaaaatagagacaccagttgcatttcacctttcccattacttacaaaaaatgccgttgagtctttacgctatagagctcaagtatggagcatattacaatggataatctattcttttgtattaaaatatgttttcaattggtatttttgcctctattcaatatggtgttagaattgagcattagcattaaaagagaagttaggcatggagaatctctttgtttagtagtactagtatgagtggtaaactggtattccagccagaactccctattttcagagcggtttcttgctagtagatatattgttagttgtcaaaacataaacttttgaaaccaaagactggtccactttctgaaactctggctaggcattggtcgagatatattctatagtcaccactgactagtaaaaggacgaaagctcatctggtactatgtcacctctatccaactgtaggcagcaatggttttattttccatatatggctactgttatctatttatcgccaattccatgcgtcacaatgccccattttatgctttctcggttatttttaccaaattctcctctctttttggcctaatcctgttagtaaacatttaggtgttgtgcacgaatctctcttagcatcgtcgtgagactcttgttgtacagggtcactcccatctaacatgaaatatagccaaagatatttctacttttttttagtcttgggccctcatataccttgtgagggtgtcatctgttttctgtaatacaatgcatgatgtgccttttagcttaagagggttttcatgacctaagctgttgggctaatagtaatctggccatgttttaaccatattattgctcctggagtgcaacattatgttggctactgttcattttgcaactcatatgtttattgagtttatttgttcatgaatcttgataaatcgtactacttggtagctattttttgttctttcttttgttagaacatgcaagagcctcccatttcatcaagacatctggtagctaatgccaattgacacatttacaggatgttgccaggagtgtgacaacccgtgatataaaagaagcacgtcgccaagacataaagaatgaaatcctcaactctgagaagtaagaaagtggttgatcattaagcaaatgcacatgtcatggggataactgaatctcatgcaaaaaaaaaagggaacatgaatatagccttgcttgtttaatgtttagagcttcttagcaactttcttctacactatgggtgccatgtcatcttttccaaaaaaaaatcaaaacaaacatttctttttttacatagaaggaaacacacaagacatcaattgtttatttacttttcatacatttactagtcattttctgcctcatgcttttcttctaatagtgaagctatctcttgtcatcttaggttgaaggctcattttgatgagaatccgagagaccttggttagattcattttgttgagaacttttctactattgaacttgcctaaattaatgtgtgtactgaatctatttcttctttccagatttgctcaaacatgataagttattgagcaacaaggaaatccctgcacacctacgtgatgtccctgagtaccttattgatcccacaacaaaagaagcaagcaatgtagtcaaactttcaagggctgctatggatatcgataagccacggaggaggaaaagaatgggattcaagggaggatctggcagaagtagtgatccccttaagactttctctgctgaggtacatccattcattcaataactaagcaaaaattaggttgaaaagatattgcaagtttgcagcttacaaggtcatagaataatcatacttttatttaactgttacgaaccttttagctctactttatcggtggtgagatattgatgccatggatactagattctgtcacaatttgagagtgcagttaattacgaaaagtcacggttgaactgatttaagatattgtttgtttagctatcttttttcttaatatagttgcaaatgtgtttaaaaatatagttgcaaatggatgcatttttccagctacatatgaggtgaaatgtggtatgacaactctggaaaattaatgagcaaaatttcaaaaacacattgcatttggccaaagtaccacaaaaccttaatttcaagccacagctttagagacttcacataactattttaagcattgtcgtcacatccaaggggcaggtccaataaatcattccacaagcctgtttctttttgttgtgctattttgaaatttcatcatgactagcaagagatagggtgaaacgctttgaatacagtatgaggcggaaatgtgtataatcactcttccattcagtcactctaccacctagtcatgctggtgtttcgatttgtctgtcatggtaattatcctctatgtaaacaaacaaaaatgggataatcttgtgatgtcaggtgtgtgggtctgggcttcaggtcctatggaaacatggcagtgcttaaatgcagtggtttagtgaaatatgcaaatggaagtgctgttcgttgttccttgaaagcgtactatttgtggtaataaaatatttacaaaagtagcatgaattttttagatttactttggatatatttacataaattccatctcttttccatgacaattttaaaaagacgcacaacatagcagcctcaaattgaaccactatactttggatctatgaagcatcaaatatttctaagttcaaatgagcttttgttgattagagatatttgcaatcaatctattatatgtgattactgatcagttattccgtctggctgcaacatgatgcttccacgctattgactcttgttattctgatctcctgtttgcttctaggggaaatcacggaggcgagggaggaaggaaagagacggagaacaggatagaagaaagaggaagaaggtggaaagctaatcttttgtgaagcgttcactgccaagtgcgcacagttttgtaggtttctggtatctcgtcctgtaactttgtagcatctccagatatagggggataacaatgtcaagctttactgaatgctgcgtgtgctatgctatgcacaccattatatagacagacgagtagagagtttgtttagtttcagttcttctagaggacgtgcatattgccattcctctatttattcgaggaatatcagcagaaaactatgtttcaagatttttgttgtataaaaaattgcataaaaaggtgatgttttcaggttaagacggctcaagtaaactctagagagaacactgaagctctagaagaagaaaaccgctgtatagaactctattcagggctataattatattcaaattggaaaagaaaaacaaaataacgaccataggtgagttcatatacagttgactgcagattaatgaaggtcagttgccacttggtaacatactggcatgatcattcgaaggcgattaggagactagacgaggaaagccgttgacaaagcatgattaatatcttaacatcaacttttttgaatggataacatcaacttcttgctcttatttgagatagtactattctattccatttccgaaatgaaatcaagatcctatattgacgtcaacctgtgaccatcaattcagtgaaagtcaacccttgtttacggtcgatcaaatgtaaggtaatgtcgttctctagttcctacgaggatgaacctattcagacagattcaaaccatattcaggccgattcactcataaccgcagattcccatgatgaacatgatcaaacatattcaaacttatattcaggctaattcacactatcttcagtcttcacacataaccgcagattcccattcattggtagctgcaagttctcattccaaatagtgcgcaaatcatgaactttcgacagattcaattccttgaaaatttgtaccaaaagtccatcctactcgtttgcatgcttaagcccatcaatacttggtcccaatcttggagctcatgaacaatacaaggtttcccaatttccacaatctaaaatacagtagcgatttacagtggaatcagctattttgagctccaactgtacaaaatcttcagatgccacatgaaaaccatacactatggggagccaagatatggaaacaggcaacggcaacgaatggttagggggcctccatctatacaaaaattgatactgcgagcgctttatgattcaccaagcaaccgtgcaagctataccagctgctcatttttcaatcttcatggaacctgaagtgtgcaaaaaggaggaacatttccatgagtttgatatatcactagtactaaacataatttttgacaaattttggatcatatataccagaattgttggtgctgccctctgccattgcgccaccagggttgtagttcaagtgaggaatgttctgaagtccttcccacatggcaggtatctagattcaaggttcacatcaacccattgctatgattttgtttattcatgtgtgattttgttatcttaatatgtgacctgaagttacctggttaactgtggagatgtcctgaattgttgtcccctgcaaaacatctgcaggattggaaacattacacagcatttctggctgcatgattccttggttaaaatgagcaacgagggcacttgatcctgggtcgactccgtagaaagcaagatgtctatcttgtgaaagcatcatctgaaaataataatttctgtgaacaaaatttatctataacaaattcttaaaaatcagaatgatctgcagttgtcattacttgtttcgatagaatctgctcaatatcaaagctaagctcagggttgacagttgcgagtttcatcgacaaaaactgcaagttcagattgtgttagattacagagtgatattccaactgtccaagaaataactgaaccaccaccctaatagtacctcaacttgacgttgtagtgactgtacataattgattatctcatcaagcatgactgccttaccagtgatctgtgaggggacaacagtaagttgcacagcacaagatagtctcgaagattttcttgcagataaaagaagaaatttaccttactgcagcctgggacaagatcttgaagcagcttcatcctctcgcttatcttttttctcctcagctgaaaagagttccatcaactcaagaataagtaaaggaagatcacaaagcaaaactgaaccaggagcaagagtcaagagtactactcagaagcttactctttctgcaaggctgtggctattagtggcttggcctcgctttgcccggacatgaacataatcttctttagtaccatcaccatcagaagaatcttccttgctttgcattttggagcaactcttttggttgtcctcctccattgatatcctctcttgctgagatgaaacctctgtctgttgatcaccaacattctaaaccaacaatataatgcatttagctattgacataagagaagaaaccatccacatataattccacacacagattatataacaaagcccagaaagaaagcatacttgtatcctgctacttgctgatgggttcaacaaggcaatgtgatcatctattcctttccttctctttgcaccactgctatgatcatcactcagttggatattttgacagaatgtgcctgtgagagattatcgtcactattaggatttatctacaaaatcattaccttcaaaaacatctcaacaactgcacaatactaagttaagagctactaatacctcatcaactgcataatactaagctaagaactactaaccgttgggtgatctatagagtccctctctatcctctaacaccatggggtaagcttgaaatccaaatgcgccactgttataccccatcttctgatgcagtgcaacagaatcccagttcacctccaagaattctttgccactatttggaccaggacactgatcagattgctggcctgaatacatctccaactgttcaggaaacacctatctttccctgttccctgttcagcagtgcaaaatagagaagacatatgagaaattcagaactgcaacaagattgccccaacagaacatagaaagctaaagaacaccttgaaactaaacatagaaaactttgatcaagcctggaaaacccttccattcaaatgaacagctcaactagtaatcctcacacagtggtgaaatttaaaagcaaaccagtcccttcaagaaccactacatatcccctatctaaagataaaaagaaggccaaaagaaggatcaccatccaggaaaagttctgctgtaacagctggagatatgcttcagagccttaaggaacaaaccaaatctgccaccaaagaagaacacacagtccagaaagtgaaactttaaaccccagagcacacaaagggatgagagacacaggagaaatgaactccatcattaagcaaacagcacccactaacttattcttttggagcaaagtgatgagactggaggagagcctctgcgcttcctaaaagactcaaaatcaccaaagctaattggaaacagcaaaagcctaccaaatcttcaagaaataggcacgtaccacattaccaccgttgtaacttgaagaaaaagagtgtttgtttcactggatgtagagcttccagacaagttaagaaccaaccaagaagtgcgtctccttttggatatggctaggcagctagtcccaagaagctcaaaagagcacctaaaactgccccaaaattgaactaaaagaacctatttggatgatgaaatcatcaagatatcacactcaggggcacacagaaagatgaacgccccctcatggcctcacagaggatttgatcaccctataaaatctcaccattacctaggaaaatcacaaatgtgaagctaaagaaagaacactagtactgcatcagcaaagcttataaaaggaagcagagtgggcaagctactagttcagactgaacttggcgagggcgtgaggccatttgaatgcacagatagctggactaggatctgtgagacattactagggcgttgaagctttccgagagcagaaggaaggaaagcaacaacctttgactactccaccgtggtataaagatcttgaaaggaacagaagcaaaaatgttcaagacaataactgttcgaaaattacctgaccgcgagatcacatgaacccctgcaagagcccaccaccaatttcacctgcaaatggagacatgtgtatactgaaacaattcaagaacgcaaaaaaggaaaaaaaaaaaacagcagcttgatgatctcctccctttcaaaattctctctttttttaatctttctccgcagcatcttacctagtgctagtgcgcatttggacacagctcagttgtcttcttggccgcaatttgaccgcaggggagaatgaatggtgcggtgaaagattatatggacaagaagagggagcaaaagggcaagaagagagctgcaggctaatgtggtgtttgttacctgccactgaggtgaaatgattccttcttgccctctggcaaagggttgttaaccactgcaactgcccccctcctctctctctctctctctctctctctctctctcatctctctaatatttccaaaaccttagcgtaagctaacacctaatcaaaagttacaacagactagtgtaccagtagtagtagtttactgcttgctctactttagtacaaaaagaatagctgtagcaaggagaaaaataaagtagggagtgaaaaaaaaatagtagcatacagttctcacctgcccaacctttgcataccctcaatgtccagtgggccccagcttgggctgaagtagaatgtagataagtattgatgaagaggtgccctactgtgattttctttcacagtgttgtttataatattggctctgtagcagtagaaacactagtgcacaactgcaaagtttgaaataagagggaaattttgaccaagtagcaatagtagtaggttaggtgatcacataaactatatcagacagcaatgcttctactatgttccagtcaagaagattttacacaatgtttagtataccattttgcggccagatacaaatagctcctcaacagctcaaccatttttgcgctcaacttctaatgtcccagcaattgtttccatatgcactatgtttcttattctagactagatataatcttcagtccaattttaccctttattagtaacatgctcatgcattacaatggattcatatgaagttgcagtgcgcaggcctataagttgggatgggatctagcatattttatttttaaccaatagcttagtttttatttgtttcctctttgactgtcgtttgtttttcttttctcgccgacaagatatggttgtgtgtgcaatatgagcgggagggaggttgcaattgtagagatatttgttgttgtagcagcattatattaacccctttgcagtagcataaggtcttttggagagcttgagattccaagtaatagccgataaaaaaagttgattttcctagctttttattaggcttgtagtggattctgtggttactaattcttaaaacttggtgaaaacctggattgtttggggaagttagagaaattgtagctgccacaaactccctaaatagggcctaagatactaagaagtggctgacgagaatgtgaaaagcataaagttttccaacttctaaattctattttattttctaggttctattactacatattcttatattctactatgtgagaattaatgtgagaatttaggttgtttacaggagctgttagaagaagctgccgatgctgtaaactttctagataggaccatgtaatagtcttttagattaaactacggtggctttgtttataaggtgggggagggaaggtgcttctcttccacaccaagctgcaagctttgaatggaggggagatctctttctaactgaaaaattttagttcccacgcaaaaattttatatcatgtcacatcaaacgtttaaacacctacatgaagtattaaatactccctccgtcccaaaaaaaggcaaaccctggatttccgtgtccaactttgactgtccgtcttatatgaaatttttttataattcgtatttttatttttgttagatgataaaacatgattaatattttatgcgtgacttatctttttaatttttttcataattttttttaaataagacggacggtcaaacattgggcacggaaaccagggtttatcttttttaggacggagggagtatagactaaaaaaataactaattacaaagattgcgactaatttacgagacggatcttttaagcctaattgctcaatgatttgacaatgtggtgctatagtaaatatttactaatgacggattaattaggcttaataaattcatctcgcagtttacggacggatcctgtaattagtttttttattagtgtccgaacaccctatacgacaccctatataatacccgatgtgacacgctaaaactttacacccctaaatctatacagcccttgacatactgctatctatttctacacttggtcttttctctccttgccagcctaccttcagcttctctctctctctagttctacgccaggggtgagagggataggaaggaaaaacataaggaatcttgtaatcttttcaccttcttgtcctctacagtctgaaatgcaaggactggctggatatgggggatatggtcaaagaaaacactgtaaggcatcctgctgcttgcttgcttgctgaggtgtctccatctccacaagatctttcttttccctgctttctttatggatacaactagagcccccgaatttgacaaggagattgatgaatgacttcagcagcaacaaatcagcacagctctacaggaaaatgtttaatcagctaataaatcagcacagctctacagaaaaatgtttaatcagctagggcagtagcagcagatgggagagactcactgtcatgagttggggatgacttgggagtacagtatattaccctcacctagacacctaatttgcatcccaataagagaatctggggcttgtattagagcaggtacaatagcaggctattaaccagctgtaaacatattttaatacgataaacgatgagagagaaaagcagcgggctacatatctgtagccagctgcagcacgaacttcaagacgcaatgtgtatataacatgtgggaccatatattaatagtatagtaaacaattattgtataaattggctattgcattggctatagatgatttggagctaatagtgagctatactattaaacttgctcttatgtgtcggtgtgattggctgtttacatgcttgcagtaatctaagcaaagtatatacttaactacggttctgtacagattgactgtttttaatactggaagcattagctgttcctgatcgcctgttccattgatgttcttgcaaagcgatgagagtgaaagaatcatggttagaactactacaattgatttaataatggtttattatgggtgtattttgacgtgacactgagaatcgatcactccgtgccaaatccacagcacaacttttctgaagatttgagagctggaatggaacgactagtcattgtctagttttcacggttaccaagtgagctactagtgcactaggccttgtgacatcacgcttgtactgggtagagctcacaagttttgttgtttaatcgtttctcctgtacccaaggcgtaccgtccctctaacaaaatctctttctttttagagcagaatgcacacggaacagaggagtttagattagtcgctcgacttgattagataaatggaacttgtcacaatagagagtgcgaataagatggcaattggttttgttcggattgagataaggtgcaattggtactgcacctgcacaatgaagactatggcactatttagtttgcaccaaacttctttctaactcctaactttccatcgcatcacatcactttcaaaactttcctacacacataaactctcaactttttttcaaactaccaacttttcccaaatttctttccaatttcagaaagtaatttgagccgtccatattttaatctaacggttcacgttcgctgctatgggatgtacaaaacaatacttttcgctagagttaaatggtattatatcagtgtatagtgtattgatctggctgctttctcatcacggtggtgctaggacaactgcttaattaagttgtagttagactagtaactataccggatcctgactcttgagtaaaaaagcatccaatttttcaattgaaggcccagatcaaatgctacaatagttctatagtgaacaccatggatgaacaattacccatctaatttgactcttggatttgcatctaaaaccctaaggccttgttcggttaatctcttagaggggatttattccacatctattgtggtgtgaaattattcctacttaatcccctccaattctcttcaatcccctctaaaccaaacgaggcctaatgtgatctctcaataagttagtacaatcacactagaaactgcatggaaattagatccgcatcttaatactgctctattagtgcacttctgtccaatcatgcttaatgctaagtctagtgacgctgacctcccatgatttagtaaattctagtcaccttaggccgaaacgccagcgctaatatatattgcaccgatcagctagattgagatcaaatacggttccgtaaggactgcacgtgattttgatcggttcagatttaacgctatcagtatccaagctatggtaaaaagtgcagaattttttcggctgaataatatcttggatgatctaactgttggattttcatcggatggtcctagactgcaggtgaaccgaatcccctaaagctttataccttagcgtcgttgtggttaattagcgccgagttaactgtctacttctgcaattagtagttcttagcacaattcattctcggttttgtaagatcatcatttcgtcaaaatttctctacaacttacgaagtattaccgtaagagataatccggctataatcataaaagaatgggccggccaggtagctgtttgagctgaattagcatccaactcgaaggctccaagctcctcttggattacaaatcgatgaactgaatcagccagccactgaaaccacactctcctaattaagcacgcccagttaattacagggccgcatgtatacggtgaattgtatgatacggcaaggcacgcgtacagggcgcgtaatgatcatatcgtcgcctcccccgatcgatcgatcgcccggtgtgcgctcgctaatcaagtgtgcgcgcgatcgccgcgtcgagagctcgcgtgcatcaatgcctcccatgatggagacctcaccatgcaatggacgagaggatggagaccggccggccattttaattttgcatcagatcgattagtttagttaattaattcccgtggacaatcataatcatccggtcggctttattagcgcgcgaacaacagcacaaattaaagccaaggtttatgttggcgcaaaagttgattaatttattctgatctctgaattctgaatttggattttggaattcagaatgatttggtgttgggcacgaaaatgtacgattacttaggatcctggagagtggagagaccgattcctacggaggaaattaattatttaatgaacaacaaaccaggttaacagtagtaccgattaggcagtacaacaaacaccaaaaattaaccaagaccaaagtgcctcccctgctttaatactactactatatgggttacgtaaagttaacgaagagatcaatgtggtgtgcaggcaacagctagatctgctcgacattattaccactcctaagctacagtagtaagtactttcagaaagaggagtttgcatgcatgcccggacagatttctttggcagagaggatcacaaataaaagcacttcttgcaagttgcaaagtgtacattctgtactagttcattgtacaagcaggcagcagcttctgaaactgtgaaatccaacatctcaggttgctcacacaaggctcctctttttctttgagaggacagaggacactgccggatggtagcaatggtagcggcccaatgaatgttttgggccaaagagaaatatcctgagcaggccattaaatcgagctcgtactcagcctcaaagcccaatcagcccaaaattgtgcagcaagcccatgaaatcgagttcgttctcagcctgaaagcccaattagttcagtctccaggctcaatattgttcagaactagacccaatattgttcagtctccaggctcgccttgcacaagacttaaaaatgctttgggcctgcttgaaacaaagtattcacccagatatagaacaagtagttacacaaagtattttcagaacgtacgtacactcatctctgtaaacatgtataagtctaccctacttttataagcacctcctaaagatacaggtgccttattatcgacaggtacatcgtctataattgaaagaaataattaaccacaaacgcaaacactcatgtaaaatctaagactaaaactcgctcataaaatgtaattttgaatgcgtggtgtaaataatcagcgataataattcagtaaagtagccgaaaagaacaatataagatcttcaaatgcaaaattcgtagaggttagtaagtactagtaatacgtatgatttatgttgttatatacacatacgcgtcgaagcataaacagagtaatcgccctctagctacttgttcgcccactaaagcctactcgcgccgccatggatggagagatcgatcgaggcctcgaggggcgccttagatgccgccgcggaagaatggcgcgccgaggaagtcgctggagtaggtgccgccgccgttggggaagagcgtgaggaggcagacgacggcgagcacgagcccccacgcgtagcgctcgctccccagcggcgtgatctcgtcctgcgccgggatctcctcgccgccgcggacgaacgtcgcgaacagcccccacgccaggcacagcacgctcccgccgatgatggcgcccgcgccgagcgccaccgacgtcgcgaacgacagcaccgccgccgcgccgcgcccgaacagcgcctgcgcgatccgcccgccctccagcctcccgcacggcagcaggttcagcgacgtcaccacgatcccgagcagccccgcgaacgccagcgggtccaccggcacgccgacgccctccaccgcgttcggcagcacgttcccgagctcgtcggcgtacggcccgatcaccgcctgcacgaacgacagcagcgggttgttgtagaagaactccggccggacgaacagcgcgttcttgccgccgttcaggctgccgtcggagacgaacgcggagacggcgagcgccaccgaggtgaggtacgcgctcgccgcgcgcgccaccgggatgtcgaacagggccttcttgttcggcagcagcgactcgtagttgttcatcacgccgaggcaccccgtccagttggacggcaccaggaaagacgggctcagcttcacgccgtacctcgccgccgtcagcctcgtcgcgatctgccatggatcatcggccggattggtccaagaacacgccgagatcagcagcataagtgagcagagctcagcggcagatctttacctcggatacgccgaggatggagaggaagccggcgaagagagggagcacgtcggagacgtagtcgtcgaacgtcgcgccgggcttgaggaagaagccgctcatgatggcgatcgtcccgaacgtcgtgacggccagcgccacggcgctcaggtatccccacggcgtgctcagcttggtgatctccagctgcaggtcgatctctgccttcggctggaccatgcagacctgatcaatccaatcacaagaacacgccaagataaattgctttcaagtttcgacgatccataaatcaaagccacaacaacatcaatcacgagtgatcaaatgcaatcgataacattatgccacaagattataagttggtacctgttttgtgatgtcgtcgttcttctcctccatgaaccagagggtgacgtctgtgccggccgcctcggcgatcttcttctccagcttcggcctcacctcctccacgggcttcctcaggttgccgatgaagatgccgccgtcgccgaacctccggacgtccacggcgaagaacgtgtcgtagccgaagcagctcttgagctgcacacaccaatcgaccaaacgatcaaatcatatatttttttccctcatctactcatcttagcccaattgggaagaccgaagacgtacgtcaagacgccattgatataccttgttgaggtcaagcgccttgaaggtgttctcggcgagctcgagcctctccttctcgcgggcgagctggcccctagcgaggccgcggaggaggccggcgagcgggttggcgtcgggctcgcggtcgagctcgcggagcttccggtcggcgcgcttcttctccagcttgatggcggcctcgatggacgggttccccatgaacctcttgaactcctcgtccgacctccagtccacctcctgctgctcctcctcctccaactcctccttgctcttcttcacgccgccgccgtcggcgtctgcgacaccgttctctccttccacggcgtggtgcgacgccgtggcggcgtcgtcctgtccgccgccggcgtggtgcgactccgccgccggcgccgccttctcctcctgctgctgttgcaaggagcacctgacgaggaggcggctactgcttcgcctgagaggcctaggcttgcagtactggttcttggagaaaagactgaagcttcttcttgagcttgtactagttgcagtgttactgctgctgctactgctgaacaagagagaggtgacgagggaggacgacgccattggcgacgatcgagctagctagcttggtgtgtgtatgcttgcaagtgattgttctagctgttctttcttgcagatctgagaatggaagctcgtaggggagcttaaaaaggttcggaaatggagaggaggaggagggagagttctagaacgtcgagaaggcgcggggaggagtcgtgaagactgcgacggtgaggaggctgagctgctgatcgagtagcggcggaaggcgacgaaggagttgaggcctcggcttatccaactggcaagctgaactgcacggcacctgcacacttggcggcagcagctcgcttgctcgtgtagtagtcgtgtggcccctacattgacggactacttgccacgtttccattgtgggcttaaaaagagttgttctgaagttggctcccgcagtcctgctcgtcctgggaaattagaaaatatgtggtgaaaaatctaaaaactaccgttaaattaaaaaataaacgtataggattcattcacgtgatcacgagtttacttgtaacaaaattttactcgtgatgatgtgaacgaatcttgaacatttatttttcaatccaatgataatttttaagttttcaccacatatttttgctgctcgtcctagctccagcacaaaatatggagtataccaatttgagttcagtactatctccatttttagtactactacttgtcagtgttgagctcaatatgatactaaggccctgtttagatcccactccaaaattttacaccttatcacatcgaacgtttgaacacctgtatgaaatattaaatataggctaaaaaataactaattacacagattacgattaatttgcaagacgaatcttttgagcctaattactccatgattgacaatgtggtgctacaataaacaattgctaatgacggattaattaggcttaataaattcgtctcgcggtttactgatggattctgtaattagtttttttattagtgcccgaacaccccacgcaacaccatatataatattcgatgtgacacgccaaaactttacacccatgaatctaaacatcccctaagggctatattagaggtgcaggaaagtttacaaaatttcatcagaattagttcaattcccacgaaaatcccttgaaatttcacaattccatttctaaatacttatcagtattaaccgatactatttcaaacttaactataataacttttcattggattataatgaacaaaagttgtgtagttcttattttgagagggtaaaattccatcatactttggtaatatgatatattttaaatatttgtgaatttgttaatgaaaagagtggtaatggattgaactaaatagtgtccattgaatagttaactagtgagtagtgaccagtgaaacggggataaaaagaagtaccaacaatctggtacagtgtagaaaaagcgtgtgatgggtgaaatactggcaatcaaattcagtggctctaaggtgattttcctctccttttttttaaaaaaaatattgtaacgtggcaagaggcagagtttattacgagtagtaatcaaaatgattgggccatgctacacaagaaagagatgtcagtgatggatttagtagtacatcttcaagattaacatatgtaacagccttgtgccatcttgttacagaaagcgattatggatgtgcttccaactatgatctagccttctcatcttccctccaaaattgtacttacacgatagaaattagaacctagtgttggatggcaatcatcacctttacacaatatcagatatcaccaccttcgcaccagtgatgtgagcaactgtcaaaacaatagaagcagttagcgcttcttgcaagcagtttcttgagtaaacaattatcagtaagaatgcaaggaaaaaatggctttcgacagaaaccaagaaaccttatcacatgatcactttcagatttttttttaaaaaaaatgcaacagttcagctctcaccattttattaacttacgaattctggctacctcaatgagctcctccagtcatgcatgatgagtttggagccatgatgttacaacttacaaattgattacagtgagatatattcagaaagcaaactcccaagatatattcaggcaagtagccaacttatgaccaaagcaaactcccaatatatataaagaaacataagatccatgctcattgaaaaatttcaaataattgtttgatttcatcatttttgcagttatactgatgtgtgaggattgatagtattgttcggtggctgttagatgacactctatagggttagtcaataaaatgtagagtttctaatcatcgtgagtagcatggtatcatcaggtaataaggcgcaaaagtttaaatggttagatgtggttgtatgcattctttactagttgctccaaatggaaccatttacgtgacaacaaaagtataggcctagaacatcactcttcagcaaactagttgcaggtgtaaaaaaatatgccaataatttgaagaactttcttaacctcaaaaagctcaaaaggacttccccgcctgtagacatcatcttgctggctctgtccagtggaaaatagtagagaaaccagggcacgccatccagtcaacaaaacccaagtacttcccatggctaccaggataaaaggagttggtggaatatgaccagatgacagtgctcgaatggcgaggcccaactaaagaggagagagagaaaacagaataaacataagctatgaaacaccagaaaaaacattaacattaacattaactacatactcatagtcaataaactttagcaaacaatcacacgataaggcagatggacagctgttgtagagttcagaatagaaatagatccagatgctgaaaatactgtccaagatataatagaggaatatatcatcatttatgaagatataatagaggaatatatcatcatttatgaagatattatatactacgttacattcaagagagtatatcttggtagaacaccccaccctcgcacaagcacacatgtacacacagaagacattgtctgtattagtgtacgtaaaagtaggtgtcatgtagtttgcacgacaatctacgagcctatgatgtagcacatggaggatagaacggaaatggtttgggtactggtacaaggtggcatcagtcaattgtcaagcaaacagcatacagcttcattgtaacaaaagaatgggttccattagtccaagttataagtgaagacactcaaagataaaagttcgcaattcccacattatacagtttacttatgtgttgacccatgatagcaaaataacatcacaaattatatgtagatacaaacacattccaattagcagtcacatttgaatttcgaaacagaactgataattaccggtatcccaacagcccaggatttggccgcaacaactacagcgttccccacgccattgcgacctttcgcatcatccccgaatccgccaaggagataggcactgagcaaccatcctgcacaacaccccattctgtaagcaatccttcctccaaaaaatgataagcagggggagaaggctgtcacattttcctgaccagcaatgaagggatcggccgtcttgaacgtctccgcgtcaagaacaggcagcccatggctgaaccttcctatcgcggagaagacgaggaggcagagcacatcgccgctggccagaagccccagcttcctgcggaacgcaagtgcaccgctcagcgaaaccgaatcaaatcagcgagcacgaggaatggatcgaggtgcatcgggggagttattacgtacgcgtaggagacgagcttggactcggcggcggcgtcgccgggcttatcgaactggatgacgccctcgagggggacgccctcgtccgtaacgccgacgaggacggggtcctcggtggcggtggtggtggcgggggatccggaggggccctcccccgcggcggcgagggccccccgccgcgcgtcggcgccggagagcgcgaggcggcggcggcggcggtgcggaagaaggcgcgtggtggcgaagagcgggtacgggttggggacgctgctgctgccgctaccgccgtggcggccgggctgcttggagggcagccgccgcgcggagacggaaccattggcggcctggctcaccagcaacatctctccggtgggcggtggcggtgtcgccggaggcggcggcgggtggagatttttttgggggtggtggaatggaatggaattgggatggcggaggaggaaaggatttgggtgggtggtctaaaaatttgcatttcgcggtggtggtctaaaatggaaggaaacgaaagcgtggatggcgtcagcggtgtggacgagaagcggggggccccgatcgttggatgcggacttgccggtaacaactcacacaagtcacaacacaacacaactcacgagaccgtctacgtcggctcagctcctggcgtgggatgagctccgtccatttgtaagccgtgcgtccgttcattcgtgtccttgatatttaattaactagatgatgagaccccgcacattgctacagaaatttagtatgataacaataaaaaaataacgtataagatagctagataacatcagattaagtaaattaatatggtttatgataatttaaatttaaatagtatgtagaatggtgattcaaacgtaaaaagtaaggtggtatgactttatgaaagaagagaagtagggagatagtttggaccgtggattaatcatctaaagactaaaagcaattgatgtgatatgacttaattagaggaaaaaaggagaaagataatttagaccatagattaatcatttaagcactaactaagtgaggatgaactatataagtatatatgatatcataaaacataataaagatatacattgaaacattatgtgaattatgttggatgataatttaacaagtttgtatttgaaaagctcttaaattataaaaactctaaagatatagcatgtttgcatgatatttaaatgtgatgattgttagtggatgatgatgtggcatcttgttaattagtggatgatgatgtgatatcttcttagtggacgatgatgtggcatctttacatgttaagcttaaggagttagtaggggataactttatagtaagataggattcttgaaaaatgttagccttagagtgctctttggccgttggatcaggggtgtcttcaagctcaagacgaggagagcgttggattaggggtgtcttcaagctcaagacgaggagagtgaggaagcggggtacttaactacgatggcgactttccaataatggcggtaacaacggtgaactactcttcacaacggtgatggttggttgtgatggtaagttatagattagattttaggatgggaagggaagttaggaagagggggggagcttttccgggtttagagagatggtcatgtgagtggttggatcgacagtgagctatagcaacgggtgggtagtgaggcggcggggtggtgttggagttgtggtgatggaggataacaatgagggggctgtcagcggggcagagtggggtggcacaaaaggtcttgctttggaaaggtgagagtggggaggcagggaggagcccaatctaataggcttcgtcggcgccgtttatgccttccatccaacaaatgaggtcagaagtggagtggttgggtgagggaggtggcgtcgaacactcgaacgagtggacacagcacacggaagaaggtgagggaagaggttactcaacactatcttagctataaaaacaattgactgaatttttttatatatttttaggtgactgaactagacaattccttatttcttgttggacttcagaatcaattgtgaaggattagatattgtacaaatcgagaagaagaaatttaaccattcaaatttagaaaggagtcgtgcaagtgcacgacataattttaagatgcggtatagtttgtgtgctaattgacatcaacatgaaacctaggtatcaaaacctatatgtactagaccaaatcctgtattgtagcgatatcacacttagtacgtatcctttgtgtcaacatcagcatataaaagtatactacatattcaatgtatcacgtttcataggttttttttcccattttgaaagcatatcactaactaagcaccattgtcgaatcgtactcggcaattgaaagcaacatagtagatgttacagttgtaggtaactttgaatttatccggctagcagtgggtctgttcggaagaactggctgcagtagcagcagctacagtgccaatagtagccagccagcccgaatgtctacagaacaatgcaaactgctgcagccgaacggctaagctacgcagcgcagcatagacagctgcgaaaacgggctaccaaacaggcccagtaaatactagtccctctgtcccaaaatataagtatttttaatgtagtgacaagttaaatattttaaactttgactattaatagcaaaaaaagaaaaagattaatcatgtaaaattgatgttactatatttactattaaaccaactatcatgctccctccgtttctaaatatttgacgccgttgactttttaaaatatgtttgaccgtttatcttattcaaaaaatttaaataattattaattcttttcctattatttgattcattgttaaatatacttatatgtatgcatatagttttacatatttcacaaaagtttttgaataagacgaacggtcaaatatatgctaaaaatcaacagtgtcaaatatctagaaacggatgaagtaatatgcaacactttttatttaaaatatcttatttttataaatattatttgtccaaatagcatctcggagaacgtgtgagagtctaaaaatgcttatattttgagccggatggagtattagtaaatgcacatagagtggattggtttctgaggccaacaagagtttgtttcggtgaactgttttactggttaaaatatcccaatgttattcacatgggctgcatgttcatggcagtttcttattctcctggaagcaccaaacttgcatttggatgggtgggtggtagcctaaggatttgaccatctgagctccaatgcagttgttgcatcaaaccacccctattagtttttccccttgcgttcaaacatgacgtataccagatgtcatactttggaatttggatatctgaagcactcctcaagaaatataatttaccagctcgtaatctgcgcgttatcgcgggaaaaaaataattcaaataatatagtactacacaaacttaaaggttttgtatcatattgttcaacttataattttgtagaacaaattagaagttaggggcaagaaacataaacatgataccaacccactctaagtcgtactccgtataggcctagcattgcataaaagaatactccactaggctgaaacatagtcaatattgatacttgatagtaatagaaaatcgtaaggatgaataaaatattaatagaaacggatgtttggtttgcaattaaaataatttatgggacacacgtgaatcatacttgatatggatcgtgatttgatgatttaattgtaacaagcccgatacattaaacggatttcagaacagaattactaattagaaaatatggtcattttaaaacatgcaaatcaaaactaaagagtcaaagaccacacgagcccagcgcgggtaaagttcaggtatgctgtgaaggagccgtacttcaccagctttaatactacttannnnnnnnnnnnnnnnnnnnnnnnnnnnacacaaacttattgtacagtgtaagattctcttctataattagtacatttctatgaggaaaaggaaaagaactgctgagcttatggcatgagaaagtcctttggtctgcctacatccctcaagttttcaactgatatattacatatcaacagcatggtagatcagacgtacagacaaagagatactatccttgcagaagccagccttccaaaatcaagagatgcttttctgcatacaactttgggacacgaacagaacctgcacaaaggaaagcatagaacaccacgtgcagcttgttaacagagaaaagagcatgctgatggtaaatgagaattgacgatgaaagtactaagcatggcataacaacggaagtatattctaactttcttttatcgtccttttttgtgaacaggccaccaagttaacacgaagatgaaatttctattttgcaaaagaaaactcaagctactttatatactaagatgcaaaagaaaatgttcgggagaaaaaaaagatgcaaaaggaaagtctgtcctaccaggctatgaaaattctcatgggacattgattacacaatatcatgccgcaggggctttacaacagatgttgaggacatcatccagaggtgcatgatcaccagtgccctcatctttccttgcatatattaattctttccctctgaacacaaacattccaccctagcacacacaagtaatgtaagcatcaaagattcttcctaaaatcctaaagataagttcagatgatggtgaagaagcacagatgtgtgggcatatgatccaacctgttgtagaacactagccctatcatctggggtggcttcaattgtatagttcttcactgcctccttgagggagtcaaatcgtgaaaacacacttgccttcaaggaaatatgtaacatttttcatgacaagacagctatgcaagtgaaatcacaaaatttaatgatgcttacactggctggattgaagaatgtgcgaccaataccaaaatacaaacccaagagatcataggcctgaaggtgaaaaggctcaatgtaagttgtgcaatcagtaacagaagaattaaaatgttttttttatcaacaacaaaatgtccaatgcaaagataattgaacttcatgtgtattatgtccaaactgatgatgcttctgtctaattcagatatcaacatctatgtctggacagggaagaacaataaatacatcatatactgttcaggagaatttcagtatctgaagaccccaattgtaattgaatgcttacttatggaacaaatttgcatactattagtgcacttattatagttgaaaaaatattttaaaaaattaagagaaaaaaagagaggtttagaagatagaaaccactttctacagctgtagaaaccttccatttgtgaatgcaatctaacaccaaaagttttcctgctgtcagttgacatgaatactgcatctatgtgttctgatttcatccaatcaggcgcaacagagacaaaaatttaaaatattttctccaaagtagtaactacacattttatgggacaggtcctgttagtgcagttcaaacaatagaaaggcaaggacactttgcacatggggtactcttaagtaagaaagtgtgacctgtgaagatataaaacagattcataaataggtgggcacaagaatatgcaccttgcgctcaggatctgcgtagaggtagtccaatggaaatggtaactgcaatcagcattttttttggaaaaatgtcatttgggatggaaaaattttacgggcacaataaacaatgtcaaaaattgctttgctctgcaaatccattgtccagcaagttgtgagattagaggggcaaactagacaatcgacatgattgaccagcagctgtaatgatctattgcaataattcatagccaatttttttttcatattataacagataggaggttcaaaaggtcaaattccatagtttgaactagtaaatcaaggtttttcattatgaaagaactgttcatgatgtgtgtgttaaaagctgaagtataaattgaagaacactgcgtacacgctcagcaagaatacgggctttatctggagtgccaacaccaacggctattagcttgacaccagctgaatcaaatctctcttttgtatccctcaacacagaggccaactcccaactacaggaagcacaaataatgtccatgattagcacagaaaagaaattaaacaagtcagcaacaaattcttatgaatgaggtcataaatccgggaaacagatatccacgagaggagcaaatctttctcaccagcaagggcacccaaaatgccttagcagggcaacaacagccattccctgcacaacagagaagttctccagtttatttatgtactacatcgtgttcatacaaaactcctcatagtgaaataacaatgctccaatgttcagatagttttccagtcttcaaaaggactctaaatttgctcaagcagcaacccatcacatcttatattgtcaaaaatcatgtgtgcaaaattttgatcattcatgaaggaaaaatttcctagctcagatctccttgcagtttactagaaagtagatcgagctaattagggggagaccgacgagcatctctacctcgttctggtcccacaggtccctgaacagcacgggctcgccggtggccgcggagtagatggcgacgccaccgagggcatccccgatgcccgacccagcctccggggaagaggaaggcacggaaggggagcccgaggcggcggcggccggtgccgctggtgagccgcggagacggaagcacccacggcgaccggggatgaggagaccgtgccggggagcggcggctgggcgagcggacggcgggagggagacgcgcgggacggggagcgaggtggacgcggccgccgcggccatggctgcgtgagacgtggcgaaaccctagacgcgggagggagacggaggcgagcgagtggaccgttgcggtgtggaggtcgttgcggatggcggggggtgtaaccacgagtttccaggcgtatttctaaaatgggatatgagagatgagactgggatatggaaatggatgaatgactaggattaaatcagttatgaagaatagatgtgtatgatacaatattgtcttttgaagggtgggatattattttccaatcccatttgccaaacaaagatttagagaacacgcaatcagaacacaacaatttgcctttccttcctatagttcgggataacgtatcattaaatattagttaaaaattaaaaataaattaatatatattagtttttaaaacaaattttctgttgaacttaaaataaaaacgtacttgtgaaaagtagagaagtagaagttaagaacatgtagagcataccagttcttcgttaaattgtaagatagatacgtgcgatttttttcttcaagttcttttaacatgtactagtaacaagtacatgctctatgacccatattaaaagggattagttaaagatactccctccgtcccataatataaaggattttgagtttttatttgtactgtttgaccattcgtcttatttaaagaattttagaattattatttattttctttgtgacttactttattatccaaagtattttaagcacaactttttattttttatatttacacaaattttctgaataagacgagtggtcaaacattgcaatcaaaaactcaaaatcccttatattataggacggagggagtattagggataaaacattggatctcgtctttatctacgtattttacacgtgcgagcctgatacgtgtggtagaaggaggggatggaaggaacgcgactctgtttttaattgagtagagatatctaattgattaggtgtaactgtaccttatacatcagaagttcagagttcagactgtagtgtcatgtccattgggtagctaatccaatatcatgctaagtacataagcaaaccaacaatgcataattaatcgaacatctagtactgttgagtctaattgctctctgtttggcatgctgagcatttcatatatttacatacacatcttccgactgctagagacctcaagaagttcgattgcagcaagcgttgaggacatcatccagaggagcatgatcacccgtgcctttgtctttccatgagtacagcaactctttccctctgaacacaagcataccaccctgaacagaaaccagagtacgatgagcagcgaacgacagatcagaaccaagatgcaagagaaactctgaacttcaatacagagccacaaaggatttgtacatgcaaagcacagagttcaacaacctgctgcaagatacccgtcaggtctgctggtgtgcccttgagcgtgtagttcttggttaccttcttgatggaattaagccccgagtacatcttcgccttcatggacgtacatcacatgtttaatacttcaatgccactcgtgcaaatgttcagaattgcattgccacaagcttacagaattacactactagtactgaattttgatgcttacaggactgattaatgtccgacccagaccatggtaaagccccaatacgtcgtaagcctgaaaagatgagtatccatagtaaatacgtgcataagcataatacatcgtcaaaatccaatgcccgttagatttctcttcacgtaccttgcgctcggggtcagcgtacaagctatcaacagggaacggcagctgcagtgcgcaaaatctcagagaaagtcagtgaacagagtgaattgatcatgctaaatgccgtaataacagtaacaatgagcacgctggtacgctctctaaatctcaatttgatgttagagtcatatttgtattgtgttcggtttccctaattctcccccgattttatttctataagtcggttatagaaataaggatgtatcgtccctgtgtgtactcttgcttgggatcaatctattaccgcgttgactccaatacgctttcatttcaaagcaagcgtaaacgcttaccccatcggcgagaatgcgagctttgtcaggagtcccgacgccgatggcgatcagcttggccccggcagcgtcgaatttcgccatggattccttcagaacagaggccagctcccagcttcataaatcataatccatttgattgaccatggacaaaaatgttagtaattaacagccgagaaacacaagaaacggagcgaacatggaagcgtcggctccatctcctcaccagcagaagcacccgaagtgccggagcagcgccaccacggccaccccctacgcgcaacaacgacacaggactccgaaaactatcaccgattcttcgtgtttgagtgcgtgattccgagaaaaacagagatgaagatgacaactacctcggtggggtcccacaggtccctgagctgaacggcttcgccggtgccggcggcgagcacggacacgccgccgagagcgtcccacacgccgggggagccgccatcggggctaggcgacggggagacgggaggggaagcccctgccgccgcggagacggccgtcagcgagcgtcggcagcaaaggcgtcccccgcgcggccgggacgccgcagggaccacggccctgttcacgggcgacgctgtcgcgcgtgtagcggcgggcgcgccggcgagcgcggcgcgcgagagcgaggcgaccgtctccataggtacgacgaggccaaactctgagacgcgtactgatcgagggcgaggtgcagccgccggtgccaacgtgtggccttgagcgcgtggcgcggcgtcaagtggcagcggacgcgtgggttttcgtctaactgagtaactgggccgttcgttgggctggcggtgagttttcagtcgatttctccgtgaaaaggaataagttcactttaggtccctgcaccgcaacaccggatacaacgcacccccaatttacaaaaccgtgcaaaagagatcccttggcagttttagctaatgtgacatctacgtggctcctttgactaggtatttttttctacgaggcattaacgtggcgcttatgtggtagttcgatccaaaaaaaataacaaacactatgagacccacatgtcagttacacacacgaaataataaaaaatggtaggcctatgtggcccaatatgtcatcgtcactcatcacatcttctctctcctttctctctctccttcctcgcccggggataacaagggagacgagggtgtcgcagcctcctaaagagaggagaggggagagagatgaagaggggagatggggaaagagaaggaagaagatgggggtgagagttacattttttaatttagggcatgttcagattatatctaaaataaaccttaacaagttttggcaagatggcaatattgctaaaattttggtagaattttttttgtatttaccaattttggcaacaaactaaacgtagacattttttgacaacttcacaaaaagaatggaatggttgaaaatagcagtaatctgaacagctccttaattattcgatgaagttgatatgtggacccacaatttttatttttttccaaatcaaatttcacataagcgccacgttatatgaagacatagtcaaattagatatgtaggcgtcacgtcagctgaaaccgtcgtccaaatcatcttgggacttattttttaatggttttgactgttgagggacccgctgtatatggtttttcggttgaagaaagaaaatcgaattcgtagacaagttcagggacatcagatgaacttattccccatgaaaaccgcacgtaatcggcctttttttttctcacgtgaaaccgggccaatagcccacgtccacgctaacgccgaaacggccggattcgttgacgcgatagcacgttgcttcaaaaaaaaaaaaaaaaacactggaacttgcgagttgcgagtgctggaagcttgtcggttaatgcccttttgcccaccacattgttattaggggctactctctccgtttcaaaatgtttgacaccgttgactttttagcacatgtttgaccgttcgacttattaaaaaaatttataaaatatgtaaaactatatatgtacatgaaagtatatttaacaatgaatcaaatgatatgaaaagaataaataattacttaaattttttgaataagacgaatgatcatacacgtacttaaaaagtcaacggtgtcaaatattttaaaacggagggagtactaattagttagggttaatttagtattgcgttctcaaggtaggcgatggcgtaaactagtccatattgcgtgcgtggagaggctcgaaggtacattgagagatgttttgcgtgatggtgttacctaggaagatgtctccctaccccatcggtctatggctaattttgcttagccacggtaaccgtgctacactaccactaacacaaaatatttttataaatctgcctttgaggatcctagggctccctccaggttatatatgtgaaagggaaaggcaagttccaaacctgcacaatatactcctactccattcgtctctctcatcatctcatgcgttgcgtacgtgcatggccgtcagattggaagccaacggcagagatctccctagcaccgaccattccccttttgtacaagctgtaataagctgaccatcaaatcgctcttataactggcaatgctacggcatcagtaactccgtagtactaataatcacccaaggaatgtgaattgaattgccatcagctggcctggatggatgattaaccggagtagtacaggcaaagttttctccatcaacagtaggagcagtgcagtacacggtggggtcaattttataattggccacgcactcatggaagggtgtagtcaatttcactttggcacggtcacacaaatcccaaccaccgtggggaccatgcagcaggggaaggaggaagagaagaggaggaggaggagggtgtgtgtttgcacgcggccccatgtaaaaacaaaccaagattcccatcccctccctctcccatgtgagccaagccaaggcatgcatcatccctcggttaacgagaaaacggcctcccaaagtagggttagaaaggggttagttggagtaccacacggaggcacagatgagtataatcatctcctaattctagggtttgcgtggagctagctgatccaaaaggctggccaactgttgtgctgtgttttggtggagccgtttaatttgtgttgtggcactctggtttctgactcgcaatatttgttcacaaaggcaaatgtacaatgagcgaggagagaggtactgtgtaattctgtgaaacgtatagattagattcgagtcgaattttgcattgatccatacaggaaatatgaatggagaaaaagaaacatgtcataaatgtggcttgaatgaaattaagaaagttgatgcaaaaattagttcacacactataaatgcatattaaagaaactcaaacctttttttttactagagtgagccaagatcacatttggttactttgaaggacaaattagtactcctacatcataataaatcaaaaaattactccctccattccaaattgacctacatatttcataggtacaccaagaccaagaaaaactaatactatatttcctagaaaaaactcaatgcatgcaccatccccactatttcctagccaatagcaaataaagatattgcatgtgggttataagagtaagtttaatagtatagccaaccgccggctccaaattatctatagtcaacttaagagccaattcatacaatagttacctataaacatatactacataattaatagccggtcccacctaccatacacatgtaccttggagtctgtgctacagttagctacaaatctgtagcccgctgcccttctctctcatcttttatctcctcgaaatgtgtttatagctggcttatagcctgctattgtacctgctctaaatacatgtgtgcatggatgcatgcatcaatgttcatttactccaatgcacaaataacgaatagacctaataaatgagcacaaatatgtagatcatttaggaataaccttaaaaaaactatatgtagatcaatttggaatggaggaagtatctactagtagcatacaggagtacatagaattaagactgcatataatgaatgtactgctgatattaattttctgttttttaattacattgtatttgcagttctactgcgtcctggcagtttcactgtccaccataatgttgtgcatacagtactgtacaccacattttgagcatcctgggtttcctcagtatctatccccggtgggaaaaaaaattgattctggtcgtcctgtaagaaattctttacactgctgcttcatgcaaagatagctcaaagctagtagatatcttggaattcttccctcgcctagagtaaattaaggccgatatatcatgtactctgatgttattatccctgtagattaagatcggattagttgtggttggcatcttgatgtcttcctcggatggagtaaacaataagcccggcagcatccgttgggttccacccaatctcgctcgcaggacttctcttttgttatcttcttctcaagtcttgtcatatgcatcctagctcatttgtcattcctgtaaatatattctagtactattcgtgttaagatgatcggtggtattaatttggtgtaaagtatgtttcgcgtgaaacctctcaaaaactaaactaaccctaaagtatcaaaagaatcaacctgctggtaaattaaccgtctacacttactcgagatctgcagaattgtactatatggagatgtcctgtgcccaatagaggccaaggtggcccttcatgatagtgtataatttgtaaggttggtgcttgatcacgattggagagctgtaaaatgtttgagtgtaatgtcattttgtgttgatttagtcaaaccatactgtgactaaagcatgtcaagctagctgcgatgcacgtacttaagttgagccttggcacacaacacaaacttgggatttctcttcggatgcaattagtcgtcggatgtttagttttgtacagaaaacgctcccgttttaattaaaaatatacagttaactagtcgccaacctgtgtatttgcacgagctatatattgctgttgatattaattttaagtataaataaaaattaatcacgtgctaaaattgatcattgttttaaaattgtagtgccttaaattaaaagagagtccactacaattacaattcacaaattattatttttaatttaaatttgagttaaattaatacttcttcagtcccatataaatgcaacctaatacatatatgatatatcataggactataaatctgagtagtcagctatccaaatttatagtattataatatgttatatatgtactacgttacacttatattgagacatactagagtatttatgatgccacatctaatctttaccttaccacaaaatgtacagtgtattatgctatttctagcactaccattcgaattcgttgattaccaatagggttgcagtagtactagaatgttttgcttaaggctgagttcttttgttaaagtttctaactcaactcccttattttttacgagaatatttttcaaactaataaatggtgtgtgtttttttttcaaaaaaattctatacgatagttgctttaaaaaattatattaatctatttaaaaaactaatattaatcatgcgctaatgaatcacttcattctatgtataaaggacgagttcctaaccgcaaacaaagaactcagggtgtgtttagttttgggtacagtgtaaagtttttgaagtatacaaatacacatttgaagtattaaaagtagactaataacaaaataaattacagattctgcctgtaaactgcaagacgaatttattaagcctaaataatccatcattagcaaatatttactgtagcatcacattgtcaaatcatggtgtaattaggtttaaaagattcggctcgcaatttacgtgcaaactgtgtaattggtttttttccccatatttaatgcttttatgcatgtgttaaatatttgatgcgatgtttttgctaaaattttttggtatctaaaccatgcctcaatatgaaagacctgggagacacatcggtttaacagcacagaaaacaccaagctgccatttaattaagcctgatgctgctactcccaagctccaacagatgccagagcctgcccgctgcagctgccgctagcttctcttggaaatcttccctggcgtttctcgccgggcagctagctgctccatatagctcctgcatgcccagagctaagctgatcagtctttcgtcacgactgaaagcgtcgccagtcgttgtccgcgccttcgtagtactgcgtacgcacacatcaggttcaggggttcaggagcatgcatcgatagcatgcatgcacgatgcatccaattccatggctgccatggctggccatatcatctgccgctttgggtcttaattgcagccgcgcgcgcgttggcctctgtctcgccgactagcgtacgtaaccgtgcgtgcaaacaaacacaagaaaccaacgacatactagcagtacgtacgagtaccagttttcgccgtgcgtaacgtgcgatcgagacgacgacgcgatatcggcgtacgtcctcacaccggctatcgcgcgtataccgctactagtgctacggcggctggggccatcgtcgtgccagggtcgcagctggggagagcacggggcggacaaaaggcacgaacatgtgcatggggccgcgcgtgtgcgtcggaatgatggaaggcgagcggatcggggggattttttggcgcgggtaggcgtaagcctggccggccaggggggtcgcgggtgcgtccaaaccacacgcccagcccccaaggcgtaacgtacgtacgtccgcgacggtggcgccggccggccggcgcggtgcatggggagtggtctcgtcaccggatcagggtggattgcgtctaagccacgacggcgccgcggaaacccaggtaggagtaggtggctacgagtagcctcctggtacaaggctcgacatcgcacggtctttcacaaggctagctcatcccgtgtcctcttgcacgtatgcagcgcagggttaagttcaccttatcaattgagcgtcagatcctgatcctcggtggtacgatggttttcttcaaatttcaatagattttggtcaaaattattactccctccgtactttaatgtataatattgttgactttttaataaacgtttgaccttttgtcttattcaataaaattatgtaattatcatttattttattgtgacttaatttataatcaaatgttctttaagcatgacataagtatttttgtatttacataaaaaatttgaataagacgaatggttaaacgttggttaaaaagtcaacggtgtcatacattaaaatacggagggagtacttcctaatatgagttctcgaagaccttcaaaaacttcgtcaccggcatatgtactttcgtcgaactaaaattgacatttttcgctggctaagttctttagttgaggtttctcaattcacatctttcgttttcttcacacaagtttccaaaatgctaaacaatactttttttaaaagttataccctaaagttactttcaacagtcatattaatctatttctgatagaaaaagatagtacttaattaattacgctaataaattatttcgttttacgtgtgcgagggataaaaaaggcaatcacagccaaaaatgggaaactaggcactttggcggcgtgtaaaattgtcgcctattactacgtgtgtgaaactgtgaaatggaggaggagatgcaaagaggacccatgttgttgtaggggtactactaattaattttctgaaaacgactggagtcgctggtccgggttggcgagagcatggggacatccatcggccttacgccaagcatattttattccagtcgtaagcgcagatttgaccacgtcccagatcgatgtgaggtgaaggtatggtggtcgcttcaacaccacgctgctggcggatgcgtttgaataggaaacatccactccgtctgtacgtactactgtactccatctacttcggcatctgggaattctcctgttggaacgaaccgatcgaccgccacggagagagagttgaatcatcacgtggtgatcagtactccccgttcataaaaaatcaatatagaattaaagaggttatatcatttttaattctaagttaatttttatggaaccagaagagtagtggtataccttatcaaatccatctcacaattaaaagtcagtggtagaagtagcagcaagctagcaactgtgtacctactggatcgactgaccgagtatgcatatatacattatcaaaaagatgaattaaatttgaaatatattgttttattttcttagaaatatttgggattcaatttttttagcacagatatagatatcgcataatagatgcacgaaaataacgtgggctgacgacgacaacagtatcacatggtaacgatgcgtctcgcataaccaaactacgagaccgcgcggtcttgcatggccaaacatcaacaccgttttgaaaaatgattaattatcatgattaacgagaccgcttgtgacgtcacatccacatcattctcgcgtaatgtttgagcgaaattatattcgtgccaaataatttgaatctcaaatatgtttgagaaaaaaataaactaacattatattttcaaatttaattcgagcgtgccgggccggaaggagttgacaacttgacctcgctttcatacacgcgacagtcgcatactcctactcgcatacatacaaaatcaaaggtttttcaagggtacgcatgtagtcgtctcttgctcctagtattgaccttttctacgacaatgttctgttgagggagagggagaggtcgagatatatagggtcccgtacgtaacgtaacgcaaaggggtcagaagttggcaacccaagcagccgtaccataatgcgcaccgcccacattgatatgatgaccgagaagtggacaagtgaaggagggccgggtgacacgtacatcaccggtttcctacccacgcccatcgcattggaactcgcccgtctttataacacccatgcatcctactatgcatacggcaagggcaacgcaaggctaccgattcatcatgcccaaatcaagcttttacgaacgcaaaaaaaaaaaatcaatacacgggaaattcaatacagtagtactccactacacactactagtgctagtgtgctactactactattttccgtgtattgatattcaccggtaaagtcgcaagggaagagagaggcaagaggggcccggagtgccggacccggagaaagcatgaccagaaagcgacggagggggcaaaactgccatcctgtgctactgtaaaaatactcgtagtactcctcctacttctactagtcagatactaccttttgagtttttcttatattgtttgaccactcgtcttatttaaaaaatttgtgcaaatataaaaaagaaaaattatgcttaaaatactttaaataataaagcaagtcaaaaaaataaataataattctaaatttttttaaataaaacgagtgatcaaatagtacaaacaaaaaatcaaaattccttatattatgtggggagggagtactactactggagaagtagatcgctgatgccaatccagtactagtaactggtccatcacactccatccaactcgcggctggttgcgacgatgcggcggctggttgtgacgatgcggtggagtgtgcgggcagtagtagagatggggtgtccgcggatgggacgggacgccgcgcggcagcggcgagaggcgacgcgatggcgggcaggtgggcgcgctttatccatgtcggccacgaggaagccgaccccgtctccgtcacatctcatatctcttgtcaatgcatatgtaatccatcctttcataatgttttctggagtggggaaatttcattaatgttttctgggacggggaaaattcgccatgcttggaccgtactagctatacatgcagcctaaaatcattagactatgctagcgctatagtagtgcgtgttatccggcgtagataaaacaaactgcgtccgctctttacagcagtagtatgaatcgtgaatttgtgattaggcgtaaaaattttaaagtatacatacgtatatttaacgtattaaacataaactaataataaaacaaattacatatttagcctgtaaactgcgagacgaatctattaagcctaattaatttgtcattagtaaatatttactgtaacaccacattgttaaatcatggcgtaattaggcttaaaagattcatctcgcaatttagatgcaaactgtacaattggtattttttcacatttaatgattcatgtatgtgtccaagcatttgatatgatggaatttttggaagtttgaaggaaactaaacatagccttagagtcgtcttttaggtgcaactcatactttgacttgtgatcagatcgactggttccattaatggaatattgttcatattcctgctagtttgatgggaggagttgttacttcaagaagaaaaaagaagatagtagtagttagttttcgtgtttgatgggagcttacaattggatttcataaagaaaacagtgcattgtgataatctattttgctttcctactttcttagactactacagtataatactccgcactacttttgtgatttaaatcacacccataaatgttaatggacaataaaactagacgtatggtactcgatacgagagaaataaatgaaagctcgtaatgtttaagttgatcaaagatgtaacacattaccaacgccctaaaacattttttttaaaaaaataaacaaacaaaccaataaccgacaacaccaaaaaaaaccttaatcagacaacactacattcaacattcgcacatgaaccaatggaacacctaaagataaacattcaaacaacatcgtgtatgacattgtaaaagatctattacaacacaaaaacacatgcattataacatctagcgataggaggcccccgcctntttgcctccccccccccccccgcccccgcccaacaggtcctcctcgctccttcctcatcaccgttgcatgcacgattctcgcccgacgcgcacatcatcatacgcattactgcactgcagctcatcacatttttaacagttgacctgatccatagcttcactataatagaccaaaaaggatgagggggagggaagatgtggaggagagagaacaaacaaaagggatggaatggaagggttcgtgtgtgcgtaaatgaacatgttgctcgtgagttcatgtgagggaattataacatctgattatttatcgtatgttggacatccaattataagtgttatcaatttatcattaataaatactaccttcgttatagaataattacatttctaggagattagaaacacgttagcagcaatacaaataacgacaataaccatgtttaatgaccacactgcatacacattctatatgtaaacttgattaaaaaggaaggttaggagatgaggatggaaagatggggagctaggaaacaatatatctttatctaataatctgttggatttcatacccttttagaaatgtaggggttgctcagattgatgccatttttaaccatattatttttcagtaaagttgttaaaaagtgtttatgtttagtttgttaccaaatttgataaatacataagaaatcctgccaaaatttggtaagttttattttggctactccctttgtcccataatataagggattttgagtttttgcttgcattgtttgatcgtccgtcttattaaaaaaattgtgcaaatataaaaaacaactttaagttgtgcttaaagtactttggataataaaataagtcacaaaaaataaataataattctaaatttttttgaataagacgagtggccaaacagtaaaaaaaactcaaaatcccttatattatgggacggagggagtacaatctgaacaggcccataatcgttttggataaaatttaaattatagagatacaattaatctagaagatgtatatcagttcatgcatgagtactgtacaacaaatagcgtgtactacttcgtatttgtaactgtcataaataacatagccgtctcaaaataagttttttacccatccaatacatactaataataaaaaatctagaacctctactttatcaaatctaaatgtaattgtttttaaaattattttatagtttcacaaactccaatacaattattactttaaaagtaaatttattttcagaaatgaaagaagcaaaaatgaattaattaccccacagaggaagtaatagaaagttagagtaggagttcctacgaaagtttgagaaaaataaatgttgaaaatcagcccccgaagggattgacgtggtatgttctgccgcatccatgtctcgtacagtatactctcgttgtagcggacatcaaatcaaggatacaaagatttgccctcgtgttcgtcctacgcttttttttttctttccaagaatctcccgatccatttaaattttcgcgtcacgtccatgcactgatgcgttggcggtggaagggagtttaaaatagggaagcatgcatccttatccggccgagaagaaaaggttttgatgatcgatcgatgatggatcgatgccacctgtacgactgtacgtgctcacgttcgtgttccctatcttttctacgcctggaagccggaatggccccgattccgcgatgctacgccgacacgacgccaatcatcgctgcgtgcgtccgtgacccttcccggcggcattgtagtccggatagcacgatatgtgcccgcgccgctctcacttttcgatcggcgtcggtaaaatatactaccccctcgtaccacagtataatagattttaaatttttatttaaactgtttgaccactcgtcttattaaaaaaatttttagaattattatttattttttaacttactttattatctagagtactttaagcacaactttttgttttaaatatttgcataaattttttgaataagacgagtggtcaaacaattcaaccaataacttaaaattctttatattatgagacggagggagtataaaacaagtctcgatcctcggtagacggttagatgtgttacgtgaggtactacctccgtccaaaaaaattacatttctagctccaaggctttgtcccataaaaattgtatttctagccatgtggggcctagcaaaattgattcatctagataaatttccttaagttctcttagccttccatcccacgatatatggttgtaatttaagtatgctaattatatgggttaattctctcaaacttccttttaatcatttgtatatatggaatatgtgcatgcagtggttcattaaataaggtcattgtggtcatttttcaatactactgttttgtcctaaattagctagaaatataatttttatgggaggagggagtatacatcaacgtacggtgagccagattgatcccgcacaccacacaatcttttggtcaagttaaaagaaattacaaagtaaatttaaattttcaacaaaatttgaataattttggtggagagtcaacgggttttaaatatttttttctcaaaaaccacatacctcggtttttagctccgaaatagtttaggtgtatttggttggtgggatataccggataagactaatcagtcattttgttgtagggatgtctggttgatgagcaaaaataggatatggctaccagatagagaatattctatgtagatgctggatatctagctctgggcaaattggcgggatcacgcggtctagaagtgggacgagtcgcgcgactgggtatgagtgcattttccctgccatctgttttatcacggcattttggccaccatctctttcttccattcttgcggcagcacaaggagcaactctcgagggcgccccgcggcacggggcgacacttgataacgctcagtggagcgctgcggtgtaaggggatatgttactatttatggtgagtgacatgtaaaccccaccactctcgagcccatatgttagccaccaagtcagtggaaagttatatcagataatctcgctctgggcatagcacagatagtgtaaagggtgtcgcaggggcggcgtccgagtgtccaacagtttggcggtgaggtagtgatgtcctgctacatcaacattgatttagatatattcgtgtgttcttgctttttttctgtattcgttcaaatctgacgaccgacgaggtagtgacagccgactgcacccctctggactatactctcaaattcttagcatgcatgtgttgttatttttgatgtattagttcagatatgatgttccttacccattgtatggcttttgatttgggtgtctgcaaggtggcatttgtgttcttatcatttgtaaataaatagtggataaaattaatttacacctggagaaatattactcacaaaacatgcaagtcaaggtgagagatagtttatcgactggggtatcaatgcagatcatccatcctagcaaacaaaaaaatatatcatcccattcaacctatcaaacatcaaaaaaaaaaagaaaagaaaagaaagaattactatatccataaaaatatagatggacatgtcctcggtgaactctggttggacctctccctctcttgtggtggcgcaccaccacctccagctgccccggcatatatgctcctcccatgtcctccaatcaacggcgggacgtacgttgattacgttcgttcgatcgcctgcgcgtttcatcaaaaaggcccggccctacatgtacacagcgggctagctagccgctttcgcaacgagtaggtcggtcctcactgtttgctgttgatcgacgtgcaatgatccgatgcgacgatgatacaccgattctcgatcgacaagggcaaaaggagctatagcttatacagcactgttccgtgtgtggtaaatgagctagctaccacaatctgctggcgatgcaccggcacagttaatgtgatatatataatctcgtgcgtctcttatgccattcccaacccaataactaggatgacgtccatagtattaaataagctaccacctaggataaaaaataatgtggcaagtgaataaatgagaaaagagaagaaaaccatatcttgcatgagacatgatttctacacaacatccaagacatcatgtgagataaggagcattacatttaggtatagaataatagtgtttattttggaagaatagtgtctattactagtttcttaataatatggagtttatggaaactatttctaatgttttgagtttggaatgccttaatttgtttcgttgggtggtgagatcaaacgatgattaattcgttccgagatgggcgcgtacggcggcgaacatgcgtgttgccggatcggggacatgcgtatgaatgtaccagcaaacaactatccgcttgccacttctacacggtagatatatgtatgcagggcgtttgcacacgcattgggtcatcatcgatcgatcggccggctaaattgctgtagccacagctatatagctacctttcttccgatgattttcgagtcgagtacaaaacagctagcgacgaccgagatgtggtggtggtacgtacgagccactaattgccaaccactattggcgaactaacctgtcgtccgtcctcactcgcttcaattttttcctaccctaattattgaaccatcgcgatagctacgattggcacgtacggtgttaggtctctctagctacgatctgcctcatttttgccaacacggctctgtgataaatctgtatgcttgttacagctgcaccagaaagtccaaagcgtaccttctacgtctcggtggtacataatcgtttggaaagaagttcaccgaactaaatcaagcaaaatttttcaatatttcacaggaaatggttgagatatgtatgtgcatcattggaaggattgcgatgcccgaggcctctggtcataggcgcatatacacatcgtctgcaacactacatgtattcactaatatataagggctattcagattgtaaccagaataaaccttaccaaaattttagtaaattaataatataatattactaacatttttacaagatttcttatatatttactaaaatttgaaaagaaactaaatgtatgtactacatctttgataactttactttaaaaaatagtatggtttaaaatgacattactgtaaacagtctcatagactttgatcatctattttgatgcgcatgtagtatattacgggcctgttcactttgatgaaaaaaaaaccttacccaattttggcaaattgtcaaaattttagcaggatttcttatatagttactaaaatttgacagtaaactaaatgtagcctttttttttgacaactttaccaaaatttggtaagattgaaaatgacatcaaagtgaacaggccctactacgataatgttgctacaatatgcgtgtgcacgtatatggtgtaaaacggagtaacaagtgcgtgcacgcgcgtgcgactactgttacgggagtacacaccgatttcatgagacaacgggctagaacgacgactcgaaggggccgcgtttcaattcgttcgaattgaaagtcccaagtcgcttccagtaggtactactagtagctcacacagtagtcaataatgctactcatggacctcacaatgcttcgatcattcatttacttcgctggggatattcaaacgcgattttggttcacattttacaagttacacttcacatttaccagatgagggctaaatctagctagcacttgtgtaacgctagctagcagctttatttcgttggcttgtgcgtgtgagagagagagagagagaggagagagagagtaaaagaaatgcagagagtagatggattggctttaatcgtttgtgtgcgcagaggacgacaatgtttgattactccctctaaaactatgtgtagtaaaggttagaaaaatataaatctagaaggtaagaaaaaggcagaataataatcaaggagattgaacaaactttacgataaaaacgatcgatcaagtcgatgaagaagtgagacttttcggggagggagagaaatgatcggccgctctgctgcttcgatttgattgttactcggcacgttttccccctagctaccatgcatgatcggaatcatccgatcgagagattgtgagaaagcgatggagagatgtttgttctacactcgatggaagaaaagcttcagggaccgcaagaaaaagcaggttttggagcgcataattggccggacagccagcccaaaagatcaattaattagagtttgtctgtgtatttttgcatcatccatagccttgaaaacaaagggggttgatcgatcgatgtaggggtccatccttgaacacatttgctgcttgatcttgatagctgcgcgtgaggatgcaacagtgatattgctctgctacagtaagggatatctatcttttcctgttactactactcctaccttttttcgagcttttctttgatcgatgaaacgtgttgcaggaaggaaacctggtctctcatgcatgcatgagtagctagtggagtaattgaccattgacacgcccaaatgatgtttgactagagattaaattaactagtgaaagaggagggtgatgcatggaccgtttttatatgggtggccaaatgtcaacgtatataggacttgcgagctgatgcttttgttgatgtcaacatacagagaactttcttaaatatggcaggtacgtataagtataattaactccaattgatgaaatattttatagcacttattttgttgatgtaaatgagagaggaaagagacataggagctggtctcggccctcttatttaattatctgcttaatgaattaatggattattaataggcacacttttcaaactcataaacaatatttttttaaaaagattatggatatgattttttgaaaaattttattttttatttatttgtactctcaaatttattatcacacatcattcatttattcagccattgaaaaagaacacctcatgtgaagaataaaaaataaatgtaatattaattaaataccatcatatctctcttgtatttgtatataatataaattctaacagtagccatctcaaccattttacttgccttaaaaaatgcatagggaatatccagtgttaaccatcaaatacgtaaaagcatgtgaaattcctggtcatctaaattttatccttttcctctcctaagtaaagttgagtttggacttgagatgtagtcgtagcgtggtagtgtagtttatggttataccaatcacttagtaattttatcatggatttggaaaacttttaggtctggttttatttgttttatttgtttgatatttttaatatatattatctcctctaattgtacaataaggatctttcaggccaagtaattagccttttgtgaagaccataatgcaaacctattccagatttgtaccacaaacaacttgggaccattttattccctcctacaaagcctacctaattaatctatgcgtaaccttaaagttaactctaaacaagtacaatgccacccatatatacatggatcgatcgatctcattgctaatataagctaataagcattatgagaggccccccctagcttgctagaatcttaccatttctttgaccaagatcacgaccgcccaaaaagaaagagctccgtgacaaagctcgattaggcagaggttaattaactatagctatacttatacatttttttcgctattaagaaactaagccgctcgtgatggcttgggggaaggcacgtgagggagccgtgctcttggaccacgcatattgctacttgatggttttgtaatgccctaagtacatcgaggagggctaaacaaatgggcagtagtaaattaatttggatgggaaagggggacatttcaaacaactggcatatgtttgcacgagtatttattttggaagatagtgccattgtgtacgtttttaatgccaagggtgacgattatgtcatgctactggttttttaattccatctgatgttttacctcacggtaataatatagcatagtacttttactccatatatattatatactcttatcaataatacatcatctcttttaaaatataaacatttttaagtgcttattcacctattctccatcataatcaatcgtaactatcttttatttagttttttatctagttttatttaaccaatcataattgtttgtcacctcaaacttatcgaaaaatggttatggagtatgtattgtgttaggggtaaaaataacggagagtaaaaagacaaaaaaaaatcgaaatgccttgggaaaaaaataacaatattatcccatcattgtagaatgatagaggcagtaactctcgtgcgatgagagtgaatatatctgcagtagaaatgggcgttaggtagcccgccaaacacagcgggattaccgttaattgagctgatctagcacggtttacccctactgtttgggtgaacattctctctcgcgtgcagcttgcagcgagcgaacggaggtgatatggtgatatacaaaagctcttctttttacggccttgatttaccgagtctttactgagtccgggcaaaagaaggcaaagatcgagaggttggagaaattgagaacgcacgcaacgtaccggaggcgaaaagcggacagcgtacgggcgtggaaaccgttcggtgttccgatcgggtccctgcaggtccatccctgtcacaccttggcgcccggcaagctaggttctgtaaattaagggcagtttttaacaacggccacttctacttaaaatcttcatcaagaaagatggttcagattcaaacttagattgaaatcaactatagtcgtaaaggttagaaaaataaatagtaaccataagctagaaaacccaatctttataaataaatactgaggctgcattctttgctgagagtttacaactccccactctcgctttccacgcatatgtttttcaaactgctttctatatgaaagttgcttaaaaaaatcatattgatccatttttgaaaaaaattagctattaattaatcacacattaatgcaaacatcgttttgcatgccggggaggaggggttcctaaccctttctcccgaacacagcctaattgtttcttaaaattttaagctcatgacctaaatataggagtttagaaatatgggctctggcggtaaagctgcagttgaaatatatgaagcaactttatatatatatatatatatatatatatatatatatatatatagcactaaatgacaacctgcacaagagactccaatcaggtaggtatataactatatttatctatataactctttatctcaccaaatctacctgcgaccacatgcggttgcatatttttatctttgtctcatgcataaaatgtcaccaacacaaaatgactgttaaacagactcacctttagaacaagacttttgtagagggcatagagatcagtgtggggtcgtgcgatctttatcaaagaggaccaccctagaaaggcgtgacgccatctacacaaccgcggcaaacgtgtccaaaagacagactccttcacacatatacactcnctctgacagagagaaaaggcgagttagatttgtgggtcctcgcgcgcgactggccaacctaacatgattgttgctgaaggaggccggaactgataaagtgggtgggagcgcgcgctcacgtatagatgtagatatatagatttcgggggggtacatcccttgggca

SEQ ID NO: 6433 - DNA, 13718 bp, Oryza sativa
  unsure (1)..(13718): unsure at all n locations
atgcggaatgacttgcttgatggtacagtagttcatcataaatatttttaaaaattaagttttaaaatttaactttttagctatacggttcagacatcaaccagctgagctgcctcgtgatttcctttccttttctttttctttttcttgaaaacatactaattccactacaccgcactattttgtcaaacccttcgtcatagagcatttaggtctttttcggaacgcagaaattttagaggttttttttaacataaaacagtttaactcctccaagattcccgtgcaaaatcttccaaactgaatggcccttcaagttatatatttcctctaaactgcacattaaccttgtttgagatccaggactcgtccgctttgctcgtgtggtctagcgtgctaatcttcaaccatgattgatactcctgcgatcttagcctacggtatttcaggtgcatgtgcgcaacaaatatatatacacagatatggaccgatcgatccatgcatacgtgcgtctcgcgtggctgcgattccatggcctaatatcttaattagcgcaggaagatagtactactacttacttaccagctaattgcctaatttccacgcccagtgagcggctggagctaagcacgcagctagtagctaacaaactcatatatcaatcaaaactgaatctaacacaaatatacactaacatatactccatagtgcaatgataagagatgtgtgattctaactccaaggtaccataccgttcccaatacattcacattttcttcttaattttttttagagacgtctctttctccaaatttcattttctaaaactgaatctaacaccaattataagctctagataagtgatatgaagctatcggcatatcacacagtgtcactatgctacgtacctgccgttcaatgtgtagggaggagaacgatcgaacccaccaaatgttggtgttagttgctcttgttgctattgtcaactaccggttacatctatcagttcatctcttgcacaaacacaacgcttgtcctggttgatctataggacaaaatggtggtttcggcttagctattccagtagtactttcttctcggaaagataatgtcttttgaatcttctgggtaggaatcataatccttcttataaatgttgttgaatctagtagcatttggagcaactttacaatgcaaagataccggcaccctacattaaaggtaaaaaaaaaaatcccccagacaaataaatcttaccagctacagtaccacttactactgccacagctatacagtaagatctctccttaccatcaattttgccggtggttagagcagtaaaatgactcggttaaaaaaaatatggagcagtagcagtaaaaatcttcaaacaagtttccctttttacccctgggtgttgtactactagtacttggggcttgtggctagcctttgcccccaaaaggaaaaccatcccggtttcccgaacacgagccgcccgcgacgacgacgcatccgccattccaccggcgacgcgacgcgacgcgagagcacgcgcgcgctcgcgcggggcgccaccacaacccgcacagtgagagagggggggatgcggtcgcttgctccggtagctgcggctgcggcggatgagcgggggagcaggagggggcagtggtaggaggtggggatggacctgggtggcggggtgggggtggtgatggcggcggtggacgggggtggcggcggggagctcggtgggggagggttgctcggatctaggctgatgaagcacgggaggggcaatgcgggggaccaggagcacgaatggaggccgccggcgaagcaggcgaggggcggggacgcgtcctccgccgcggccgccgtggcggccgcggcggcggtgtccgaggcggtcaaggtggcggcgccgttcctgctcggggcgtcatgtagccccggccatggcggggagcagatgctcagcttctcgtcctccgcctcgtcgtgctcctccggcggcggtggcgccgccgtggccgctgcggcggcggctggcggggcgatgccgctgtactatggcacgcctgcttcttgctcaggtgaggatggtgcaaaaatcttttcgtttcctttatttttttcttctttctgttctgctcgtctgattcgatttggtgattgaaaagctttctgctccttttcaagtattattgctgtttgattcatctctctttgttatagatttattttccattttttatgctacttctctgcctttttattcgttgctatgcatcatgcttgatccttgctcacactgggatgggatggagctgatttagttttagtttttgtttttttcccacttggttcttttactattgtggtttagattcggatttgcatcttgtattttttttgtttcatatttctcatttttttgtctccttttgactagatcactgactgcgaatagctcacttcctctgaaatagaccagtttattatctttagcatagatgagtgtgagtataaactagttcttgattttttcttgatactggagtataagtttcctgttcttttcagtgacatccacaaacgctttcttgtcctcatcggtgcggatcgggcgtattctctttcgtcataccttttgccgaaactaaaggagaaagcacatatatggatgagaaaagtcgtgatctttagcattatatcactactatttctactacgtttttctcactagggaagaaagaaaggttaaagtaggaaaaataaaaacatgcaagaaaggtttcaagtaaacaatgcggcaaacgcgaatcaagctttgctgcaacggatcgaacatgtggttggttggtgactttttatgcacacgccacctacaaatccgtgctgcttctgatccttgcagccactttgcttcagatttttgtgtcttttgcttgcccctatctatgttatatcttgcacaaggatcgtgtttaggaaacacatgcatctggatggtggtcgtcgtctcgtcttctataaagtacatgtgtgttttggctgtgccttgttggcttgcactgcctagcttgttgctcatctccttggtgtatctggctgcaggattgagctcagtgagcttgagcagcagcatgcagggtgcaatggccagggtgaggggtcccttcacgccgtctcagtggatcgagctggagcaccaggcgctgatatacaagtacttggctgcgaatagccctgtaccacacagcctcctcatccccatcaggaggagcctcacatcgccctactcacctgcctactttggctcaagcacatgtaagccaagaaatgggaaaggaagcagatcaaccgaatgctttcttggctttagttcctttcatcatggactgatatttatgataaaagctgttccattccctgatcttggttgcattgcccttggttgggtttttgctttgcagtgggatggggatctttccagctgggctactccggcagcgcggatccggagcccggccggtgccgccggacggacggcaagaaatggcggtgctcgagggatgcggtcgccgaccagaagtactgtgagcgacacatgaaccggggacgccaccgttcaagaaagcatgtggaaggccagcctggccatgccgcgaaagcgatgcccgcggcggtggcagcagccgctgcctctgctacccagcctagtgctccggccgcccacagtggcggagctgttgctggcctcgctatcaaccatcagcaccagcaaatgaagaactacgctgccaacactgccaatccttgctctctgcaatatagcaggtagaatgttggcagcactttcaagctccaaatattgcttttagtcaatcatgtagccaatgcttaagctcaagacgtcaagtttcgcttttgccattttgcatggatattccatttccgtacatatttgcctgccggcatccaccaaataataaagatagaaggtaatttagttacctagtttatttagctaccatgattggagatgagccccaaagataagctattaatcatttaccagcaattaaacaagtccattatttacattgctcatctatgtactctggtagccctaaaggtacttgttttgtgagtagagtggccgttgaagaactgccatactaaaggaacaactgctatatgctgtattaactacttcactaatgaatcacttgttgatcaaacttctacagggatctggcaaacaagcataatgagagtgaacaagtgcaagactcagacagtctctcgatgctgacttccattagcacgagaaatacgggcagcctgtttccgttctcaaaacaacataatccttttgaagtgtccaactcaaggccagattttggcctagtatcacctgattcactgatgagttctcctcatagctccttggagaacgtcaatttgctcacttcgcagagtctgaatgaacaacagagttcagtttcccttcaacactttgtggactggccaaggacacctgcacaaggagctctcgcatggcctgatgctgaagacatgcaagctcagagaagccagctctcaatatctgctccaatggcgtcttctgacctgtcatcagcctcaacatctcccatccatgagaagctgatgttgtcaccacttaaactgagccgtgaatatagtcctattggtctcggttttgcagcaaatagagatgaggttaaccagggagaagcaaactggatgcctatgttccgtgattctttgatgggcggaccattgggagaggttttaaccaagaataacaacatggaagcaaggaattgcctatcggagtctctgaatcttttaaatgatggctgggattcaagctcagggtttgattcatccccagttggtgttctgcagaagaccacctttggatcagtatccagtagcaccggaagcagtcctagactggagaatcatagtgtttatgatggcaacagtaacctgcgggatgatctcggttcagttgttgtaaatcatccgagcatccgcctggtgtgagcttcttgatcaacaaaaaatgcaacaagatgacaggcatgaggaaacgattcaatcagtcttcaccttgttacatatcgttatgacgtcttcaagtgtgagcatttacctcggtgctttgtcattcagactaatcttgtgtttttggtatttctgctctgttatttttcctttgctttgtaaccttcaccttggatcttgacgtgatatgacgtgtggtatggatggatttggtactccattgtggcatatcatcttaaaatatcccatgctgtgacgtcataatcgcggatgaatgtaatccgatccttgtcttgctttctggtagtattcaatggattgtttgtgagctgatataagtattcctcttgacttcttgatgcttgttggtaattttagttggtccatgcggcattcgtgtagtgtttcactggtatttcgtgtacggactgttctgtttgtctcccaattattggaccatatattcggtgtatactagttttgcatagtacttctactttgtttgcagtcactaaactagacaaatgagaactatagttaggtcagtttggacgaggcaattggggtttttttttttttttggggggggggggggtccttgcgattaaatctgtgcaaaattctgaccaaatagtttagcattgctttttggagcctgagggcggtctttcttttcccactattattgacagagtggactagtggtctaatccagttctgattgtactcccaaccaacagcctcaccagaatacaatgatacaaatttcaggaccattcaccaccagccttttcttcctcttttaacagctgccaagccctgcaaaaagagaccagcctccctctagcttgtgtaactacccaatgttcatcactgcatgcatgcatccatggccagcctctactccaccacaggcagcaagcaagcactgtgtggttttctcccttttgatgatttgctctacagtagcctacagtagaatgattcatcatcagcagcaatagcagctagctaggcttgcagttgcactggtgtgcaagatgagagccctgatgccatttgccacctgctttttatgcacccagaagactcaaaagcgatccatgcattgcataccacacacatggatggatagatgatagtagtgttcttcctccaggaatgggctgacctgggtgactccttgattgctcacctgctagacatgtcaatatttttatttttttttcattttcttgtgcttattttactttgtttctcatgcctattctgattatttgaaggagaatgttcactgctggatgcaaattactggttttgtttggaggcacagaaagggaaaatttttgacacagaggggtttccccgtttttcctgcctgcccgtcacgtgtgctcgctagcttgtgtttggacaaaagtcgcgcgcgtgcaatacattactgaaaagcaatgcactcgtgtgtactagcagtacaggtaaagaatgcttccgtgtttatactatccgaatgttttcgtacttgccccagcattagtgtgagcttagccgcactatcaggtacaggttcacaccactgccttgtgtcttccagaaaacgcagtactagtactacgcatgagtcacagtgcggctgcatttcacggacgttcttgtgttcacgagaccgactgcaaacgccattcagaaaacgacctgaaccgacgccgaaatcgccgagccgatcacgcaacgcaacgcatgccaaagcagtagtcgatcgagccgagtcgatcgctcgcgttgtgtgtggcgttgcagagtacgtgtgcgcgctgcaccacgtagcgatctcacgggcggagcagtgggcatcggagtgaagaggcgcgaaaggaacagcaacgacacgtccacgcctccttgctcacatgccaaggtaaagattacgtgccaaggtcggccacggtcgcacgagagctgagtacttgatcgtcgcgtataaaaaacctcgacggcgttagtaaaaaacttaactcgtcgatcgatcgatcggagtgagccggtgaaacgggagaagaacacgagatgagccggaggagcggcgtggcgacgagccgccggaccaggcgggccgccgagcaggaggtgcagccgccgccgctgtttgccgcgaacccgatcttcctgtgcgaggacgacggctcggcggggcggctgatcaaaccgggcggcggcgtacgcggctacgggccgggctcgctgcacgcgctcgtgcgaggccgcggccgcggccgcgacgtggcggcggacgacgacgacgacgacggtggcaacaagatgctgccgttgccgctgccaccgtgcagggcccaccgcgaggggcgtggtgggacccgggttcccacggcgtggcacgttgggcccacgatcgtggtgggcccgcatggcgcggtggtgaggatccgtgcgccgccgccgcctcagcagcatgacccgttcctggccgcctacgtggcgtgcaccaagggccgcgccggcgccggcaacaagaagaagaagaagaaagccaaggcggccgcgcgcggcgggtgcggcatgtggaacgggtgggcgtcgggcgcgaggtacgcacgggtgatgtcgtgcaggcacggcggtgccgtaaccgtgctgcagggcgccactcctcttcccgccgtcgccggctatgccgagtcgccggcgcaccccacgctggacctgtcccgcctgccggcggtgctgccggggaggagacgggtgcacaactgaggacagatcgtgtactcgtacgtggccggtgcatgtgtacattgatactactgccatgacgtcgtgtgcaaagaattaagaaagtagtagtccatatttgcccaaatattgtcagtccaaaaatataatgggccgtatcagccctaaaagtaaaattttagcccaaacagtagtatgggccgggtcacaattgtcaaagctttacaacgcaataaaatctggatgtcaatgtcatatcatatgaagaccgagtcaaattagccacgtatgcgccacgacagctaaaatcaccgtccaaacatattgcaccgttttagacagttgagggacctgttgtatctgattttttggttcaaggaggagaatgttaagttaagggatctcagatgaacttattccataaaatctcgtttatgattcgttgggccacggattgcgtagggcgcaaagtgcaccgccgccgctacatccgagggtgcttcgtgccttcgtctgctcgcttcatctgctgggcggtggctcggctgctccggctccggctccggggagaatccggcgtgagcgattggggagtgggcctgcctcgacggcgttgaagcgggaccgccgggatgtcgccagccgccaccttctcggcgctgctccgcgggctgccgccgccgcggggccggcgcctcctcgtcgccgccgccgcgcgagcgcacagcacggccggcgggagccgcgcgcgcggtggcctgccccgtttccattccccgacgctcccttcgtccaaggcaagcgcgcgcttcattcattgtcccctgctcggctgctcgacacgtccatctgggtcggcgtggtcatttcgtcgagcacctcgtgctcaataggttcagcatgtcgtaagctttcttggtagttggtagactatgaccactagagaaatgttcgtccccgttgtcgtgggaagacattgtctgtcgtgtagactgtagagtgtagagcgctgttccttcacttaccccataggcattttgccgatcaggtggtgtgcgtgggttttctgcgtgatgttccattccttaatatcagctgtatgcctgtatctaatataggtatttcctttcagggtgaagaggttcgaatccaaggagacgaattctggcacatgacaagagtcttgcgccttggcataaatgacaggtctgtcttattgctctgcatgagtgtaaatttgctgcggtgaattccagcttcaattcatcaatgctagattatttagtagaaattctatccaccgctgatcctaagagtccgaagtttggaaataatttgattgctgcatatgttcatatgataagccatatgtgtaaaattttcagcttttacttcgaggcaccaaatttatttatttattatgagtctgattactatttgtgtacatattgaaactttatatgaaaacttggaagggttgaactatttgatggcgcgggtggtttggttgaaggatctatacaaaaagttgacaaaggcggttcagatgtgaagttgcttgaggatgctagactcattgctcctgatggcattcaatggcatgtttatgctgcatttggtgagtcccataaattatgcgcacttactgtgaatacagggtagttttcttctccatagcttaccattttataattccattccccagggacattgaaaggtggacgtgcagattggcttgtagagaaatgtactgtatgttatgtacaattttgggtgtcttgtctcttcacaatctacttctaaacattattttactctttctctgtttaggagcttggagcttgtagtgttacacctcttcttacagagcgatgccatacaatagcagaaaatagagttgacagattgcaaaggcttgtgttagctgcagttaaacaatgtatgtgtctctgttggcaccaagatttcagagcaaaatgaactgaaataaattgacagcattactcttgtttctttaggccagagaatacatggaatgttgctgaatcccccaattcagatagctgaccttcagcctgttgtaagtgttcacatatgctttattatctttgcacataacattgtaactttgttacctagttcatgcattggatagtaagagttttgtatggatccagtaacttgcttttttataaagtgggcaagcatgatattgacctttgttgagcaaatgttctaggtcaaagcgcaataatctttagtactgcattgtggagtgaatggtcatgatgcattgtgcagtgaaaattttgttaagaataaaacataggaataaaattttaatgtatgtactagaatgtagaactaccagagtcattattgcatcttcttttacaccacgatgtgtgattgacaaagtcatattattgtgttatctatcatcaggtatcacagtcaaagctcgctttcgtagcttcagcagaatcacctcctcttttaagcactttgccgaagtcctgcaatgaagaaagtgggcttttgattgttggaccagaaggaggtaagtctaactatagattagattcatgtctaattattaaaataataagatcattggttagggtaaacatgtgattttcagtattcttgtttcttgcttgtatcaaatgtgcacttcacgattttgatgtgatattagttgtctgtgctttatgaagtgaatgctttatgtagggccaaaagaaaaacacacacaataatgtcaaagatatgttcttgcagtagcataatgaacagtagtaaatttatactggtatttattaatgcagttcagtagtgggattacatcgagtttccttaagcatgctagattttaaaacacaaaatataattttgaggattgaactatgcgaataattaatggcttttgaatttggcccgaaaaatctggggtccaaaataaaccaatgtcagtagtattatttcactggaactaatatgctttgttttctcaacctccatttcatcagatttcacggaagaggaggtaaacgttttgaaagcatcaggcgctgttcctgtaggtcttggtccatgcagactacgagttgagacagccacaatttcactgctatctgcgctcatgctgtggtcagatgctcatcgccaggaaacactgaaatgcaggtagtcaatgtagagctgtcacccatgtgctactttatactcgcattatgtccaaaccttttgaggtgatatcctcttaagcaagacattttaaggtgattttctttttgcctttgaaatgtttttcaaaacctagttgggcttatcaaggagcaaaatcaaagagaatcgttccactggatctaagtgagcatctctgtaacagcatgacaattatggactggtcagtggtactaacaaaatcaggcaaaacgttatggaaaagaaacaaagtcgtcaatttgttgatattataggtcatagttgcatcccgttggttagtcgtatgttgtctcgctcgcatgaatgtgacctcgcagcatatttggttagtacaccagcagcagccacccttttcgaagacgatcatagaataaaaatgatgatgaattatggccttgatctcgcagcgtattggtcgaatgtggctgagacagctagaaagttttgtcatgttgtgatggtacactgagacacacgaccatcagtccagataagttgcatatgctacatattccgttcgcggagacgcgaagctgttcaaacagattcgcaagtattttttaagctaggaactcgtttttttgcataatttgcccgtggttttatcactttgtcatgtgccatgtggatgtggaacagtggaagtgcttttgaattttgctgcatataaacaaagaggtaatcatacgcaaaaatacaccttcgcgctcatactgtttcggtagcatactagcatgtgttatgctttttcatggtcattcgatctttcgaatttgtaggtgagtcgtttttaaacttgtattttgtgtagtgatatataatagtgtataatgttattttttttcttcgtaattatttaaatgacatagaaaacaaacaaatttgctacatatttatccataaatttttttcttaaaaatttgacagatgtaattacagtacaatcgtaatgtaattaacttgcatgtaactttaatgtaattttgaaccgttatatttgtttcaagatttgtgcaaatgaggaagggaaaaagtcacagcacgcacacagtgagaggattcgttcccacaacctccatttcaccgaaatactacatccgtcctaaaatataagcatttttttttaccctgacacgatctgtaagatgctactttaaccaacaatatctataaaagtaagatgttttaaataaatatagttacatattatgatagtttgtttaataataaatctagtagcattgattttacatgattggtctttttttattttcttgctattaatagtccaagttgaaaatatttgacttgtcaatgtgctaaaaatgcttatattttaggatggaaggagtagcatgttacatggagatttttgaacgttacatacaagttactccatctgtcccaaaatataaacatttttagcatgtgacaagtcaaacatttttaactttgactattaatagcaaaaaaaaaaattaatcatgtcaaattaatattactagatttatcattaaacaaactatcataatattgtagttatatagatattgttggtcaaagtagcatctcgaagaccgtgtcagagtccataaatgtttatattctaggacggagggagtatattgtagttatatggaagttatagtgtagttacatcacgattatactataattatattgtcaaatttttttaaaaaaatttatctataaatgtatagatgatctaaaaacaaaataatttccctcgcggacaaaatgacttgcccataaatactgggaagagaagaaacccgcacgctgcatcttcacacacagacacatccacgttccccacgcacgcgcgcgcaaacagtcgcgtttcggcgtgctgacgtcgccgtgcgccgctgcagccaccgcccaccgcacggcgcacacgccacggttgcgcggatgtctctggccgccgccaccaaacgtcccgtgcaccacccacgcgcggcgccgcccccatccctcgcttgcccacgcacgcacgcacgcacgggcgtcacgcccaccgcaccggcgcgcacgtctcaccgctttctcgttgcgaccgcagccgtacgttgcccgttgggcctttgtcccccgcggcgccacgtttaccgcgtcagtcaactcgcgcacaaacttgcaggttaaccgcctccgcgccgcgttgcggccatcgcacgtacgtacgcgcgtacagagagatccgcgtcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgaactnctgtacgactgcgagntgcattcaagcgcagcg

SEQ ID NO: 6434 - DNA, 746 bp, Oryza sativa
  unsure (1)..(746): unsure at all n locations
ncctcgaagggtaccgngantgnataaanncanccnngagtncangnacatngagactgtcattgatggagacaagggggagaatgcccaggtgcaggtctcagtctagcaggacaaccgtgactttgttatccacaatggcacaggcaccatcctatccagcctgagctttgatctagagcaacaaagcacctacacctttcaactgaaggcagtggattgtggcgtcccacctcactcagcttacgttggtgtcaccatcaatgtgctggacgagaatgacaacgcaccctatatcactgccccttctaacacctctcacaagctgctgaccccccaaacacgtcttggtgagacggtcaaccaggtggcagccgaggacttttactctggtgtcaatgccgagctgatctacagcattgcaagtggcaacccttatggactcttccagattgggtcacattcaggtgccatcaccctggagaaagagattgagcggcgccaccatgggctacaccgcctggtggtgaaagtcattgaccgcggcaagcccccacgctatggcacagccttggtccatctttatgtcaattagactctggccaaccgcacgcttctggagaccctcctgggccacagcctggacacgccgcttgatattgacatttctggggatccaaaatattaacgctccaagcaccgtggcaacaatctcttttgtgtggtggcttatgtcgttgccctct

SEQ ID NO: 6435 - DNA, 764 bp, Oryza sativa
  unsure (1)..(764): unsure at all n locations
cccgcgcatgtgctaatcagaggtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagcattcaccattcacccattcaactggaattttggttgaatgccggaattgtgtccacaaattgtggatggataggcggttggctggctggatggctggctggatggctggcttgatggatggtgaatggctggcggcggttcgggtgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacctacttagatcctaatagaaatctgctaatcttgcggaaaatgtaatcctattcactagctctactattaagtaacaagagaactattgtttttatctaacacctggaatattttcaacctttaatttgacccctaattattgaataaccttgggttggtacccggcn

SEQ ID NO: 6436 - DNA, 737 bp, Oryza sativa
  unsure (1)..(737): unsure at all n locations
cgatgcgnngatgagatcaccgctcttctgcaagtcgctcatcatcctgcctaatctgtttgataattccaccaccctttccaattacacctcccacatttgatgcagcacaaagaaggcgcaagctaaattcctttgcagagctctcctccctccgtggttgatatatagaaggccaatctccagccacatcacctttgtatcctccataagaactaattaaaggcgtaatccccacaactggtgcagttgaggaactaccaaggtgggagcccactggataaggctgtgtcatgctggatgcaagaagatgctgtgacctagatgggttgtcatggagacgagatgacacttgaagaagagcttttctgacaactgttgagtccccagatatctagtgccaaaagaataaagggttcattagcattattgactattccacagatggcatagcaaaaaaaatcaagtactgtaaatgataaattaaactagtaaaagttattttgctggttgactggaaagtgaaaacagctactattaaatctaagtcactgcacccttaaaagggtactccgtaaaagagaatgttgcggacgtgtcacaaataacccatgttaccaaacagagccataaatgcctatagtagtaacgcatgtacgacatgtgtaacgcgggaaaaagatggaacagaaaatcctcacanaccttgagaagtcattacaattgatgcacacccn

SEQ ID NO: 6437 - DNA, 72791 bp, Oryza sativa
  unsure (1)..(72791): unsure at all n locations
gcggccttctcttccagtggtacagtagttcatcannnnnnnnnnnnnnnnnnnnnnnnnnnnnnnnnnnnnnnnnnntggcgcaaaagtatacaaaattaattactacttgcgcgtaatcatggaccagagtactacgtattcgaaagacattaatctcgatcgtacagtttcaagttctagctaatattaccatgtttgtgagattagacacccctgatcctcctgaagaaaagttgacacccctcaggtataccgaggtgttgcttatagagaggtatggaggagggctggccaccccgagactgtcagctgcaattaatggaacaacaagagaagtatttgccgtgaaaaaaatattttcccttaaggccatcttcggttaatcccaaagagaaagagatcagcggaaatttattacatatttattgtggtgtgaaattattccccctcaaacccctccaatccccttcaaccctctccaacccgaacgagccttaagacaatggtcacatgtatatacatagccaatacaatagcctctaattttaattcccaagagtgcgcagtgtacgcgttgatgaaatactcaccaaggtagtcgacgaagttgtagccgttgctgaacctgccggtgggcttgccccccgggtagtcgacgccgttgtgagggtagttggccttgtacatcggcagcgtcgctggcaggtagttgttgttcccgacgtccgcctgcgagtcgccaagtacgtacaccgccggggcagcgccgcgtgcgcgcgtcgggcagcaagccaaagccacaaggaggagggcgacgacacagacgcctgcacaggccgatgtcgacggtgtgcaccggcgccagaaacccattgttccttcacagcgtacagtgtgacgtgtgtattaaagcctcctagctactctctccgtcctaaaatataacaacttttagcccttagaatttatcttaaaatataactacttctccacaaatatttctcttcctaaccaatcacaactattcaccattcatttttcccacctgtctccactacccatccaatcacgacccttcaccacttatttctaccctacttttttaataatcgtgtccaactctaaaacctcttatattctgagacggagtgagtagtgtatataggctgtgtttagttggatccaaagtttggattttggttaaaattgaagataatgtgactgaaaagttgtgtatatatgacaggttgatgtgatggaaaaggactgaagtttggatgcaaactttagatctaaacacaaccataggatcggaggacgccaaagctagctacatttatagcctattgttgtgcacacaaagacggcagcggctgtccaaagctatgccaactttaggattggacgagagggactagtcaaccctagtcaccgtacagtactactctctctgtttcgaaatatttgacgccgttgacttttgaaaacatgtttgaccgttcgtcttattcaaaaaatttaagtaattattaattcttttcctatcatttgattcattgttaaatatatttttatgtaggcatataattttacatctttcacaaaagtttttgaataagacgaacggtcaaacatgtgctaaaaagtcaacagtgtcaaacatttcgaaacggagggagtatatatataattgagtaaatttcatgaaacaaaatatattttgagaaattccgtacagatttaacaccaaattacatattgaacatgttattggttggggctctagccccagctctctggttggcaggaatctaatcccatatatctgttgcgtagtgagttcatagtgccagcaaaatttgcacagcaaccagcatacggccaagcagtgatggctagttggctggagacgttcagggtgaaagaaatgatgtgcatgaaaaaacattaggctgtttattactagctggatcatttgtgaattgtgatcattaattatattgtagattatttttactcttgtgttctagctagtagctgttgcagtgtgcagctcatggcctttatacatggaaaagactataggtactaactttttcttactaaattctaacactgaagtgtcatgctacgagttcatctagatttttcataacttccatctacctaaatcaaacggttgagatgattattagtaaagatttagtaagaaaaaactagtatgtgtagcagtgctcttatacctattaatttcaatctttttcagttcacttcagtctttaatcctctttttttccctatccgcgtaggattttgaaaaagtatattataattattatgtattatgactttaatataaagccccaataatattttcatcacgttgtacattcgccactgcacattctgatggtacattgaactacgtttgtacctgaagaaggtgcaagtgcacatcatattatgtctgcacgactgcactagactatttgccgaactaatgtggaaatacctgcgccagcagtagctgtgaatctgtgatatgatcctttctttttattatcacgtttttgaaaataaataaataaaataaaataaggtcaatagcttaggacacttcgtcagtgcccggtttttaagggccactgactttccgactatgatgatcgttggtgccgattgcactgattttctagcactgagtggtttcaattattaatacgaactagaaatgcacggacaccttgtttaattttgctttaatttttattgtgaatgcttatgttagaataatattgttgaaatattccctgacttcattttaaacatgttttgcttaataactgatttggacattggttatgatttttttctaattaccttgaaacgtataaactctatactaaaagtaaaattacttgaaaccatataaccttaaattgatgagaaaaattgtgtcggttcatatctatttgtattatgtatgattattttttggaacatttagcacaggggcggacccagggggtgtgccgggtatgcaccggcacacccaaaaaaacgaaaaacttatagtatatagcatgtattagtttggggcaaaagttgatgagtatgaacgcatgagccagcccatcatagatgcctgtgtgatgtgttgtgcgctttgcatcgtgcaagttccccgcttcacctcgcattcgcgtatccacttggcatcgtgtgaaaggtagctagggtcagggcatcaggcgttgttccacattcagcgagcggcggcggtgacaccgaagagcacgacagtcaacaggccagagcaccgatattggctggacggcgagtgtggagcgtcgacggtggagacgagagccgcagccactagcatttagagacatggcgaagcaatgtcgatgcgagcccggtgagtctgtgagcaacgcaaggaatgcagctagcagcaaccacattgaccaaggcaagcaagcaggtccagcttcgcatcatctatctaaaacttcagatacagatatactctttgggacttttagtctctcactatttttagtttctttgtctccctgaattttcttttaaaggagagctagagattggttgaaaaattgaaaattctgaaatcagttaatacgaagaggaacaagggcattgtcttcttttagcaaggcatcagaaaattcagattatgctttgtctaggccatgtacagggctctacattttggtgtataaaatgctcggtttgcctatatttttgtgtatatgctctagaccaatgtgtagggcttgtatttgtgggcacacccagggtataaatcctgggtccgccactgatttagcatatcggtttccaaaattttactaacattttttcttgtgtgctataaatgactttatggatttacgaggaagcaccggcaccatcgtctttgctgaccgtgctgtggcctccacagattcaccctcctgaagttcgagatggtgttgctccattcttcgctcctccagatttttttttgtcttcctcacatatctttaattttgacatggaattttgctggtggagcagaggatatgccatacatctctgtttgtttgcatgcattcatatatggtagatagacatctaccagtaaaaaatcatttgtcggtaattaaaaacttttcctgactactggatcattggcaaacactggtggtagactaagtgtcgacaaattgtttgacgctaagagcaggtacaatagcaggctataagccagctgcaaatatattttaaggagataaatgagaagagagaaaagcagtgggctacagatttgtagccagctgtagcacactccaagacgcagtgtgtgtatgacaggtgggtctatgtattaatagtgtagtatataactattgtatgaatgagctattagattagctatagatgaattggagctagtagttggctatattattaaacttgctctaatggccatttataccgacagtctaagtgcttccatatgtaggtcatggtgtagcgtgctctcgtgttccattatcttctcgcgaatgctaggcgacacataccatcccccatcccctgcatgggacgctccaatccctcagacatgaatcgctggagccgatgaggatggacacacttctccaggagatgatgagattgtgtacggtggactgtgaaggtagtcccgccactcccgataggcccgcatccaagtgactgtatggggcgagagttgactagagatcatggagatcgaagctcctcaccacacgacctcaccaactacaagcggttcacgaagcatgcgatggaggcagatatgctcctcacgggcactgatgagctcttcgccatcactgacgtcctcttcatctcacagtcactcctcccctcgggccactgaagatctgctcaccatcctcaagctatacgcccatgtatggtacgaatcaattttttcttggtaccaataagacaatgagcattgggcgatatcagtggatatcaatatctagtaccgacgagtatcggctgatacccagggattaaaattttggttcgaaattttcgaaatttcagaaccctcccccctccccccggcatgccaatatctcggctgaaatttttggtttttctccaatttttgtgaatttagtcaaattcagttaaattgtgtcaaaatttcagtaaatttcagtccaaaattaccaaaattcccagaatttcggttctaccaaaagggccgaaatcaaaattgaaaattgtgccgatacctatggggtatcatatgatacctagcaagtatcatgcatgactctggtaggtatcacctgatatatagctactagctagtatacctagcaagtatcatgcatgactctggtaggtatcacctgatatatagctactagttagtataccgggtctggatcccctggagttgagtataactctaccgagtggagttggccaaatctgtactatccattgtttcctacggctgagatcattcatcatcaatttcacctaataaattaactccttaaattaatggttaaggcttccgaggaaacttagttttttcatgtgtttgctctataatagcgatttgattaagttctcacccccaaaaaaaaaagtaacagaacaacgttttgttattccccaaacaacagatatagtcgatcaactctaaagcaactcgcagtgtataccaacatagtgctttcacatatatgcaaacagtgaaccatatcaatattaatgtgtatgatttttttagataattgatgaagcatgaaatttttgttctaattatacaataaaaatgatctcgtgataagttgttgatgcgagtttatttgttgcatggtcagttactggtttttaaagtataaattaatgtggcttaatcccagcccctgaagtatatggaatggcacatatttggccaactccacccggtagagttatacccaactctaggggatctggactagtgtggatgtggatgcagatgtggatcggattatttcggacggcggatttggtacagagtcagtgcaaactcggttcggaaatgaaataaaattgtcggatgttatgtttgtattcatggtgttgttgaaggcatgtttctttaacgatttctagcctagcgagagccctattcattacatacaacaagaaggcagcaatacaataagcagcaatgcgatagtaaaataacatctgaacatgatctctcaaggaaaaaccagccaaaacacatccataatagtataattttgcttaagtgcttaagtgcagcttgcataatatataacatcaagtgcttgaataatccaaaacccttccaggcattgcttgaaaatataagtccatccatggctccagcctccatgccaatgccataacatcaggtgtaaagtcccaagtcctaacaaattaacacatccaagatcaagataacagtatggtaacaataattccatgcagaagtacaacaattactcttgcaatttactaagttgcaaatatgaactagatctatacaacacacatcaacatgcaaggatccagacttcacttctcactcttcatcattactgtcggagggtgaactcctggagcgggggactaaggggcccccctttcagttcggcggggggcagcgggtgagaatcaaggtttggtgcaaggagtgatgtggagggggtcgggcccctcaagaacgatgagataaaatgggtttatacaggttcgggccactgagaagcataacaccctactcctgtgtgtgcttgatttctatgaggaacaccgtgtactagttggttcaatcagagagtgatcgatccccctctcactaggtctagacctccttttataattcaaggggttaccacaggggcccaaaagatctacctagggaagaaggaagacatcctttacatttattacacatcttatttctctgacagaggaaatcatgccttcgacgctccagcatggccctatcaaatcaccgcgggtgacacgggggacgtgtgcgtcattccccattaaccatctgaagactttgggtacccgttcccactaaggaatggataccctaatttaaattggagtaggaaatcatccccggcttgcacacggggcaagggatttctcatcatggtgatgtgactagacggcaccggccacacgccacctgacagcgggccagtgcacaggcggtcagcgcgcaggcacactcaccctgccacgccggtcaatcgagtgtcactcagcctgtcagccacgcctgcacgccgcatttaataatgcggcgttatgcggctgcagcaccagccttaaatgctgttagttgggcgttgagcgcgcccacctaactcacgcatgctgggggggtgcgtggagggggtcgggatggcctgacccctaactgggagggggcagccgctgctcaaccccgggcccgaccaccctcaggggagtgccacatgagtttgggggcggcctcctccctctagacacaatacccccaggcctatatcaccgacaatcactactctgttgcttttctgtaattatgagcaatcaatatacatttttttgacaataggactacaaaatgtatgaaataaaatgttcctactaatgcaagattaagttggtcagtgtcataccatatcatcaatctcgtcaagcgtcaaattagcaaccaaggtctctgcaacctcatccaaccctcttattaggatctgaaaaattagaaacaaagctatattagactattagcaaataaccaagaatgccctttacaacaatataaatgagaaatgacacaagtgatcacctcttctacatcgagcaactcaatccttggtacaaactaatgcttataccattttcgagttcaagtttagtacgaaatagatcaataacacgtccccctgcactaaaagctgattctaaagcaacaatgaaagcttgaatggacaagcacgtgaacaggatatacatctttgtgagctttccaccatgataagacatcaaatttatctccattaggaaccaacagtgatggctaagccatttatttatccaagtcacttgcatcacttccactatccacatgtgaggcatagacataattcataaaatcataatctgcttcttctatagtatggctttcttttgattcaacattgacactagttgttggtgcaatagtagtcttataaaaagaagcatattcttgataaaattgcttaacaacactagtaaacttttgcataggtgcatgatatgattgcttaccatacacctcagcatgttatactctactgcctttgtcttaaacctaggttcaagaaagtatgccacaacaagagtaagatttgacctcttccagtacttctcaaccttcttattcattgaggtggccattgttttgatggcaacatcatcacttgtcatccatggagtaattaaagccttgatttcacgaaagttgtggtaaaataaatttgcagttggataagaagtacctgaaaaaaaaatcttagtgatatcatcaaacctcttcaagcacatgcaaagtgtttagttgccttataccaatcttcagcttttggaacaagaccctcataaatttctcttttagtttcataaagcctctcgaaagactttctataatatatggcatctgacaactgacaacatatagtacgttgaattccaccatgtcaaaacatcatttgagactcccctcgctatatccaatccactctcagatgcacattttataaattcctccttctgtataggagaacacttcacaagaatcacgaatgatcgaatactaaaaacagcttgtccaatatgtgccaaaccatctctagcaacaagattaagtatatgacatatatctcatatgaaagaatgcctcatcacacatgaggggactttttctattcagcaccttaataacatccttaacacaaacatcatttgctgcttaattgtccaaagtaagagaaaacatttttttatcgatgaaccacttatgcaagcatggagaaaatacatcagctaaatttagcccaatatgcctccctttacatgcatgaacctgataatccttttttgaacacaccaattgtcataaacccaatgaacagtgatacacatgtaccccttgttttggttagaggtccatatgtctattattgcactaaagtgagcattaacatttttaaaaagctcatacaaccttttccattcttctgaaaatataccaagtatatccttcctaactgtgatacgactcttcaaaggaaaagtaggccaaagagattttatgaagtcaacaaaatactcattctcaacaatattgaaaggatactcatgcatgataattgccaaataaaatttttgtaaagagatctcttgatcatacctgtatgtttcaaccgatgttgtaccggaacccttatccattttgagttactgctatcctggaaccacattgtgggtttttgtgtggttcaagaacacataagtaccatttcctgctattgcgcctagctaaataggcacaatatttgaacttggcccactctttttaaccatctagccatttatcttaaccaccttataaacaatattgtagtgttcccaagctggcgaggatctcttctttgctttttttgctatatgttcatcattagtttcatggtctcaatccccatctgcaccattgttatccacatgaacaacaacaatagtgttggttgccactgcccacagttgatgacctttctaccccttcagttggagctagtgatgaggcaaccatgctagtttcagcagctgctgttgctttagtacctctttttctaggtgccatttttagggtcctaatgaatgatgaacaattaaacaaattataagttgctattgacataatttcttaaagcaaagctcatcactaaatttctaaatcccaaatttcaaattagactacaagaacacaatacctgatttggagccatggagagtattgttggtatttcttagcgacactactagaaatataattcccagcaatagcactagaaataatcctggtatattatggttacatatgtgatccgcaagtgcacggatataccattgtagcatttcacccgggagtattccaaggtgtcgtatttatttgatcccaatgaaagatatgataagagagaactttactaacaattcatatattacttatatacatgaaagtttatgcagaggttaattcagttcaaagggtagggtgacacacagaagaaaaaactaagatactctcactaaaatatagtctaaaataaatggagaaagaataagaaaagtatcattcctgtacttctagtatacatacatctttagtctatacttgctattatacagtcatgcaaccaataccccgtacctagtgtcctcctggtgtttcaagagactacccctggttgctgagttccttacgacaacctgtcctggccatccaaccggggctaaatacggaggagtaccctccccaggaaattgcacttagaataatatacacatgcagaggacacccatactgagccgtcaccatcagcggccagcctctgaaccactgtatattaccccaattaatggtatctaataaactaagcaccgtgcttatattactaaatactactctacatccttgcaaccgacatagagcaaccgaatactcagacactaaacccacaccaatacacctatctggaaagctagttgcatggctatattgattcaagtatgaagtaaagtcggcactcaagtaatatgaatggaataaaataccgaaaatgtataaagaagaatattctattaattcaatatgtcttacaaaagaagagaggaaagctactggagccataccagcaatctcctgaagactcgaggactatgaagactattctattttctactccactagcactagaactactaaactaaacttgagagagctctagatctttttcttgaggtgtgtgagggaatgaatgagaggaggggtatttataggtggagaggtgctctgggagtgtggagatgctccaagcatcctatgagcatctttgctctcctcatgacaagtggcatactcaagcatccaaatagcatatttcatctcctcttgctatgtgtccatgacgatttcttcagatagaattagctccaaccgtcataggatgccggtagtaaccgcctggccgaagatgggttggattgggccaactggggggtcggccgaaccctggctggctcccctggcccacagccttcttcaggatgctgacatgtgggccccactttatggtacaccatgttttagctcagaataatttctcattttatatgttgtagctcaaaaccatgtgagtccatcggcgcaaaatatattcacattcttcacgttcattctctcccaactttggtggttaatcacctctcgacggcttccgattgattgttcgtttgttttccatcgattctcctccattcatgcgtgcttctcctgcatacatgttagtagcatagcacatagtggaagtagatattttatttgggaattatgcattgcaaacatagctagtcttcatatattgggtaataatgacggtcgaaactggtcgatagcgaccgtcaacaagtatcacctattgctgttggaggcgatgcgccaatgccggatcgatgatctgtttaggaggccgtcggcttgttgttgtcatgggaacatggaggaggcggtggggagcaccgaggctgattgcgtgggcttctgttttttttataactgttaaaatcttttatgatgtctattttttatccatatataaagttttcatagatgtttacacatacatagcagtcacacataatgtagttcttggtcattcaaacttacggtaaagaatttcacgcctttgcacatataaactttcagcaataaaactatagctgagatctttgataattaccaaactaattactctacaaattttgatatctcttttttttcttaatgactcatgagcatttaattttctcatgagttattgtgatatcaaattggacatcagcaaatatgaacatgtggtacatatccatttttcaggtgacctccgatccatgattccctagcttgtttgtagcctatagaacggtgtagttgaggctcatatatgcaaaaagttattgaaattaattatgccatataagggtacaaaatcaaccgaaatatttatgccatgattaaaaagtatgatttttccaaaatattgctcaatagcataattattttgatgctatactaaatagcttctaaagtcgattatatagtaacaaagaatatattttagaacacctatgtaaaagattactccctctgctataataactttattttgcccccacaccgtttgttttcaaataagtttatttttgagtaatcattgcattagagtttgtgaaattaaaggataaatatattgggagtagataaaaagagagaaataattgcattgggatttgatatagtaagggtattttagtcttttatgttttgtatcggtatacgtaggatgggtgaaaatggacttatttcggacatagcgactattaggcttgcttggattactcgagcaaatttcaaaaaaaatatagagtaattggattctttccttgagcacgtgttgtcctatcaaatattatttaaccggttttttatgccgcgacttggactattcatacttgaattaattctatatccaattagttataaatgtttgaaaaacaatgtatgatggggcaacctgtattattgaactgtttcatacttttatgttaattcgcatgacatatgaaagggtagggatgttgtctctcgataaaatattatttaatatttgaatttgtaatttttgtttggatattgtagatttaatttagatatgtatgtttatggaatgatatatgatgactcaatatatgctgtcaaatttttatagtattttattgctagattaggaatgagatttgtagcttgaaaatttttgctgttttagtatataaaattattgatttttctcgattaatttagtagctaaattaaaggaggaggagagagcatgagctagagaggagagctacagagcagtgtgcaccgcaaacgcatgcgagtgggagggggcagcgagtggttttttacttttaaagttctctacatatagttctaatggttaaaacaaatgggtccatcgatctaagtgagagtgcggtaagttttttttccatttttgttctcagaatttttagatcaattttctaatttattagatgcatcttgtggtaggttaggagcacagttaagaatgtttaatggacttttattacataatatattgatatacacgatgtttaatttaatgaatatttattatttgctagctagaaattaaggaggccaaagtgagcaatgagagaggatttttggtagatggtattttgtttttttctattaaaatagatctaatggtgtaaaataatgggcctattaagtgaaaatcgagggtaagatgttttgctttttttagaatttcttggatttctctaatttattagagcgctaagtgatgttttagaagcgtttgtagaaattttaatgaacttttattatataatagatagataactttatcttttacctgtgatccctcttactaaaatcacatgtgacaggaaaaaaggagaaaatatgtagtggaaactgcaacctatatgaaaacttgcaaactcaatcgtggaccattggatccaaaatgtgcagcctgatgaagccttgccagcccaaccgtccccacgttacattttatgaaatgccccccgcaccatgctgtgtacaatttcatatacatcctttaaatttcctcttttctcacgttgctacatctccacttcaacaccaaatggtctagatccaaaccagatccatggaggaggggggaggctgcacggcgcgtggagattgatagagcgacgacgagctcgggccagtcgaatagttgagtgaggagacacaacggtggaggcagaggcggctcatgagcttgaatctggtcttcctcttccccatcgatcctgcggtgagcctctctgaagacctccaaatccctttcctccttagcagtcaaggctggagctgctgctgttctcttaattgccaagagaaatgctccgagaactgagttgttgtggctgctgcattgtactctcgatgattttgtatctttagttccttagagcatcaccaacaatatctgtatatggttatcctgaaatttggagattttcgttcaaaaacccagtccaacagaatccctagccaagcgcccaatagttcaaaaaccgaatttttcgttctccacaagtagggagaggcgctcgctcccaatctccctctctcgtgccgtcgtgcgaattcccacgcgcacgtgaagtgttctcgacagggggttcatcacgaggttgttcgccgtcgcatcgaggtgtcctacaggtgcccacatctcacgcgcgcgccgctgcctagagctttctcggcgtcgatagttcctgctctggcggcggcagcggcaccatctccactacagccaggcgaacttccatcggcccgagttggtttctcctcaaatcgggattggtctctcgatgatggagatgagcgaaggtatctgctagtgcttgctagttttggcgctgctaatctgctactacgaattctacagttggtactgaataatgttgttggtgccggtggtggtgttgaaagttgatgttggtgttgctgatgatgtgctgttgttgatgctactgacctgctgctagttgtgatctgctgcttgttgcttgccatgctattgctaattgccatgctgttgccgatctgaatttttttttgaacgacgtttgctgatctgagttgacgctactgatctgctattgttgaaaatggtacgatgttgttggttctggttggtaattagggactttgctgatgctgctacttgtagtggttctgcttgattgtttgcaggatcagatttgctgacgtgctactgcgtggagaggggtgacagggaggtgaccaccaagtggttcccgcgatcaatggtcacacgggcgagcgtgataatctcacaggagggagagcctgaaacagatttcagttggtagttttgtagagggaccactttttagatttagggagtcaattttagccaatctcttggagggctcaatattttaacaccttaaattttatttaagattcccataaacaaaattttgggatactcttggtgatgctcttactgagttattctagtacagtactgaattttaacacctatcattattctgaatttttttatgctacttgtagagaagtaaagagcaatactttctagtatatctgttagtgggttttattatgacccacacaacgggtaatgtactaatgagaatgatttgaactgaggaaattaaatttatattaatatttggtgctatccctaaatttatattaatatttggtgctatcccaatctgcagtccattggaaaagcttgagaggagagcaacatgcaacagacaataatcctgtgggtctggggttcagcacttcaaaactgacgaccattgtgagaatacataggaggtgctaactaagatgattgaaggtgacaatctagaggaggtgctgcaggaattggaggagatgaagaacttcatcaagacaatgcatagcacttatcatgctattaggatttaaaaagaaaattcatataagagttagtttgtaatcaatttgtctatatactgaaatgacaatattacacaatgtgtaaaatgcctctgcttcttccaacttgacttgcactgcttttgcatctcaatgacagcccgcgcacgagcagaactcgacggcaatccacgacaatgcacggcagtgagagttatcgttcttcccttccttaattcaaaaatgagcacaagaacaaggttttgctgaatttcaagtggacaatggacactgcagagcagactgaagtgaatataatctaccttatgcacatgacaacaggaaatcgtgcctagggtggaaaatggcatctccctcaccacatacacagaccacatatatggacgagggtgaacagatatataccttcatgaaaaaaaattgacatctgaacattcagggaacttaattctgaagaaactcaacatgaatatattgttatagagacacgaaaaactttcatgaccatggtgtgcaaatgcagcacaccggtttgtgggaacacaggtgcagaaaattactagttcaagtagaaaaatacagcacacagaaaatttatccagttcaagtatatttaggattttcctagaaaatcataggtccagattgtggccacaaacaattggcagagtcaacctagtccatcaatgtataccgacatggtctgatattcagatgtcttctgctgacacaatttagatcccacagagttttggcaggtaataacattcataagttacaacacttgtgcacaaatattagttatccccttcaaggtgttgtctaatcaaaatgcaaccttgctattaaatggctaaaatctattaatagatcacacacgtgtgcactggatgatggcagtggctctactttgaacaaaaaactactctcagcaaaagaattctcgccagctgctctcagcaaaaaaaaacctgcacccagcaaactgcatagtgaaaaaaattgttaagaaggacatatatacttgtgagcatagataaaaaattgttaaggacatatatactggtgagcatagatacatacaaagttttattcacactacggaccaaactaagataacaaaatgttcctggaacacaatggttgttctaatatttttttcctgtcttcccatatgtactcttaaccatttcaagctgaatattagctgtccaaaatgtccttgtcgcaatatacatttgtatatgagccgaacttgtcgcaatatatttaaatattttccatatgtaattcttaaccattccaaactgaaaatgcaatccaaaatgattgtgcttcctacacatcccgctgtatattacatgcccacttgcccacctcgaatccttcccatatttttttatactttgttccaagttgataacactaggtcccaaatcatacagtcaaaaacttaaagagctataaataagaacccatgcaaaaatgcaagggaccacatcagctaacaggacaattgtacatttgcgatttatattattaattagactcacgacgacaatactaaaaatgttattacctcacaatggtcccaactaattatatttcaacatgtgttcactacctactgttagttaaatattatatggccacctattatcttttacatgaattgctactttgttccaaggaaatctacagtatgtccattagaaccagaatgttcttggcacactatagactttacgatacaccgttagttgaattttggatgacaacacacaatcttttacagagaaacgctaacttcttccaggaaattgtatgacaactattataagatgactgatagttaaggaagcatgatgtatagaaccttgcatcactgttgtggttctttgttaggacagttgcgcgaatcgtgcagcacgacttgtttgcacttcttgcacctttgtggtactctctcttttttctttatcttcttgttttgctttttctccttgtcattgtgccctttaattctctttatccgacccctggaacgagtgtcatttggcgggtggatttcaatttgacttggaatgctacatccaagatatgattcaaattcctcaatttggctaagctctttttcaggaaccatctcatttaatttatcaccaagcacaactagttcatccctcaaaagttgcatagctgctgctgattgcttagcttgtaggataagcttctccatttggttgcatgcttctgaaagcattttttgcatcacaggatcattactgttgcttgtgttttcttccaacaagataccatctgcatcgaacacatgtgtcttcttgcagtccttcctaaacctttctaataaatagtatctcggcagttcacttagctgggcacttcttaggactggaattagatgacgacatggtataccatgagtttcaaatagcatacatgtgcacgttgcaaccattgtctgtctatcataacgcacaactcttggcttcctggattcttcaatgatatcaatgattttgacctagccctcttgttgcacattgtcaataaggcaacggtccctggcagctagcacctctttctgaattatgctaaatacctcatgtgtgaagaactcacttgcatgcttctctatcacccattctgtcttcaaattgcggattgtgtggagcgtaatgttatcttcttctagttccttatgtctttgttcttctagtgcagcatcaaacctgagccaaaactccaccaaagcaagcttccgcccaattagacgagaaaagaatgaattggcactctctgaccttgaggtggtccttaacaatcctgacaaaggtatgtcactaaaataagctggcacccatgaacgccgttgatcgaactttgtactgaaccccagaccccagacccacatctcaccatcattctaatgcaatatgcaagataatggagaacataaagcacgacggcaggccggcagcagcaacatcaattctacgcacgatcctcccatcgatgaataacacaacagtaacagctgcagacgccgccggttgctccacatcagtgggtagctcatcataaccttacagaacagcagtaatggagggacaccattactaccttttgttggccaatcgatgaggggccaggcccaagtggagggaaggacaagaagaacaacaagaagaggaagctgtagctgtctctacaagaacaccgacggaatactaactctagttcatctgcagttgtcagtgttggtggcatcaaaaccctagttcatctcagcccccaaattgttcaaaccaagcacattccacggaagaacatacacgaactatagcagggatcaagaagagagaatgaccttaattcagtggatgctggaggagcaatcggcgaatcgaggccgccgttcgcagatgcctcgacgtcaccggagcagcatgggggttgattcgtgttgccgtgaatcacgtggaaaggtggcgctgctgccgaccaccgccggtgccccaccccaccccaccgccgtgccgccgccgcaccacccctcccccaaccccaccgtcgtgccgcagcagagagttgagtttggggatggatttggggatggatcccttctgaatcggagaagatgtgctgtgggacaatttgggggctgagatgctaaagtttggaattaggcggggtgttttttgaacatttcattctgtggtgacgtggacatatctggaacctacgttttgcatccaagtgtggtttctatgtttgcactagagatagtgtttccattacatatcttctcggaaaaaagctcacctctcctccctctcgcctcatatcaccgccgtgccctccagctggtgccgccgctgttgaccatgcaccctcgatctttcatgtatgcacaataatattttttaaaacaattgaaacatgcaaacaccctataagtaatacccaaacttcaatgatactctataaaaccactcaaatatttgaaataattttagaagcatacttagacaattgtcaataattttaggtcagtttttagaacgtatgatatgatgtgaagacatggaaaacaaacatgaatttaaacggttgaatggaaatagtatatatggataatattgtttacacacaaatttggcacctatggacgaaataggggaaaattaccaaagtttagaaagtgacgggttttcttcacagggccggtcagaccacaggtgtgtgggcggtctgaccggctagtagggccggtctgaccgcaggtatgtgggcggtcagaccggcagggtccgtgtccgagtctgttttcgtcgggtctcgggttttattgctcgggaaggcatgtttcgtgttttctttggtttctatcccgagttgggcatggagaagggcctgtagagggcaagaccaacccctatttaagggacaaggccggttcattataaaacccccgaatacaatctacttgaatcgttcttttaccatgtttttctattttaccctagtttagtccatctttgtcggtttgcgccgtaaaccgtccgccgccgctgcgggagtgcgacacttctttataggtttgtcttgaaaaccttccgttttgcccacgagacgggtagttatcctcttatcgatctaaatcggcctagaggctgattttgatatccaaatcggctccgttagccggtttacctgtttttctacgaaatccatcttgatttggccctttggctagatcgaggtggttggcgactccatatcaccgcaaggcgtttaggtgttacgatcgtgcttgttgacttgtcacagaaagttgccaacacgatttttggcgattccactggggaacgatctaatcggccatatcacggccgaatttcgtttaatctaataattactgtttcgtcgaatcatcgaattagtttcggctaaacagccggaattaacctacactgtaattattattgtcgccgacattggttttgtcttcaagcttaagcttaattgttctgtttgatcacggctagacgttaaaccctgttcacacagggagcagcagccggattagcaacattgtttcctttttgttccacacggcaacagaaagatttgattgaccaaagcttactgtacacgggttagaaaagatcaggctattcaagccgatctattactgttcacattaaaaaaaaagagacaaaaaccgattcaatttgtatcggttacactgtgaaactttagattagtttccaaattttgctaagtctactcggttgattaccaaataaatcaaatacttttgccgagtacagtagcatacaaggaaaatttatgaccgtatattaatttattcggtcaaatattttggctatgagctatatggccgaaattaatcaaggattttcttcatcaactatgacaagcgggaacgggttcaacaatactactacacaatacattaggaccgatcaaggcgtcatgagagaaaactttcaccaaaggtaacctccgattcgcccaacccatactttgctattcaaaaggttaatgatcgttgtgtagattcatatgctacttctagttttgctcctatacaatatgcttataatgatatggggggggggtcaatgggtgtttatacagccgattacataggaatcggctatatgcaaagtcgaactgacggtatgaccagtcgtgacaccggtctaaccgcaccctatgtcggtcagaccatgtccaacatggccggtcagaccatgtactatgccggtcagaccgtgcccaccatagccggtcagaccgtaccctatcctggctagatcaggcctcctatggctagcctgaccgcaccactgacctccggtcagaccgggccatgggccggtcagacgggctatctatagtcggtcagaccggttccctaggaatttctccaggttttcataccacgactagcagtactgattttaattattattcatcacctgttaatactgttagtcatgctactccacatgtccctaatacttacaatgatcctaatggaggatattctcacgatactaggtatggccaatataacaatattgtgccacaacaaccgctctttaggccaccaaatccaccaaggcctgaaatcatggaggtaaggaatcgtgctagggagaaccaaaagccgtattctgatttttatgacgttgtcccatatcctcctaattataaaattcctgaatttaccaaatttagtggtgagtatagtaggactacatacgagcatgtagatcaattcttagcgcaatgtggtagggctagtagtatgaatacatgtaagttgcgcttgttttctttatctttgtccggtactgctttgatatggcttacttctttaccggcaaattctattgatacttgggctcaattagaacaaaaatttcatgattattttcacactaatgaaactgatcttaagttgtctgatttaacatcggttaggcataaatacaatgaatttgttgctgattatattgaaaggttaagagatgttaaaaaccgatgtttcaattagaaaataactgacaaagatttggccaacattgcatatgatggattgcttgattcttttaaagagaaattgaatggctagatatttcttgatgttgatcatgtgttgcatgaagctctggctcaggaaagccgagtggatgacaatagtttaaatgccaccttagatgatagtgcaatatcatgtatagccgaaccaagcgatggttcggatcgtggtaataatttgtgcaatgatgccgtaacgagtatagccgaaccaaatgttgattcagattgtcttactagtttggatgataacgcaataaccaatatagccgaaccaagtgttggttcggattgtgttactagtttagacaataatggaatagtcgaatcaagtaatggttcggattgtattgctagcttacagaataatgccattgaagatatagccgaactaaatgatggttcggattgtatcacatgcgaaagtgaaatagcattgtcacctaagaccgagtcacaaatcggtcatgtggatgttggaaaagatgataacaatgtcttgcgggatagtagtgaaatagaatccaaagttgccatacatacatatcaaaggccgtatcctgaacatgtagattcagttccatacccgcaaagatttgaagtgtccaacttcacgaaattcacaggtgaggatgctataacaacaatagagcatatcggccaatttattgaacaatgtggtaaggctggtagtgatgatttgcttaagttgaagttgtttcccctttccttgtcaaactttgcatctacatggtatagtttacttgctcctagttcaatttctacatggtcatgaatggagcatgagtttcatgattatttcaaagatgcaagcttgatggagcaaagaccgattgatacttcatcggtcacttgtgaaactatttcggttacatctattcctaagaccggaattgttagtgatcctcttcctgttagttctattgatgttgacaaaaagaaagggaaaagtgttatttggggatcctcggcccaagaataggatcaaaaatacgaaggccgaagatcataaagttgcaaaggatgagtcatctatgtcacgtcctgataaattcatcccgaaataaaaatcattcgctaaaaggaataatagaattaattaaaattcgaaaagaaattggcaaacactaaaatacgtacaagaaaaattcaaatgtggcccggagaatttttgttaaattctccttggtctaaaaggagccctcaaattttacttgaattttcagagcaccagaaataattattaagcaaaaaaaacaattatcaaagtttattaaaaagaaaaacctaaaaataatcctccttcctcctttgggccaagtctggcccaaagtcctccctctctctcttggcccagcccaaagtctccctctcctccctctctttcccctctctctcccgggcctctcctccccctcccggcccactccctcctcctccctctctcccccgggccgcctctccctcctctcttcctgggccggccgcccggcccaagccgccccctgcccgagccgcccctccttcccgcgtgcacgcgcgtcgcacgcgcgctgacgccgcgcgcccgcgtggggcccacgcgccaggtcgtcgtcctcctcccgcccggcatcctctctctcttctctctcccgtgaaacctagcgtcgtttcctcccctaaatccacgcgattcaagccggctctttccaaattaattggggggttttaatccccattgaatcctcttcaattgcccccaatttcccccttgaatcgtgcccccaatcgccgggaacgcccgcgccaactccggccaacttccatggccgccggccgccttttccaccgccgttccgacctcccccatggccggctccctctcctctcctataaaatggaaccccctcgccccgttctctcgttttagccccctcccgcgctctcccgtggcctccccacctctccccgccgtcctcctctctctcccgtgccgccggccgcctccagccgcctctcccgcctcgcccgcgcgccgtccggccgtgccgtcgccttcctcggctctgcaacaccgtccccttcaccggtctcaccgtctcctcgccggaaactcgccggaacggtgcccccgccggcaaccagtggcattggtgccactgtactccctccagccggctactgtccctcgtcggtgcggcagccgtcgtcgtcgccacctccctcggctccgcgacgctgccctcatccccggcatcacctcctcctcgcccgaagcttgccggagtggcctcctcgtcggcgtccagtatctccccgcctccggccggctcctgtacgtcgccggtacaccgatcgacgtcgccgcgttgtcctctcctccagctgctcctttgtttcgccggaacgccgtcgcccgtgctggcctctccatcctcatcgtcgccgacgtcccttcggccgcccgttcatcctcgccggctcgtcgtctcgcggcgccgcctccgtcgtcggcatcgcagcggcgtgttccgcgccgtcctcgtctccgtgcagctgccgccggctgccctcgtcgcctcctcgccggttccggtcgtcgtcctctcgtcgttcccggtcgtcatggcgttcgtccctccgtcaagccattctcgtccgtctcgtccgcgtccgtcaagtgtgccgctgcagccccgtcgtcgtcttcgtcctcgcctccgcgtcgtcaagccttgtgccggccgcgtctcgccttcgtccaaggatcgccgccgaagtcgttccctcgccgtccgtctccgcctcgcccgttcgtcgttgtcgttcccacgcctcgtcgcgtggtggtaaggatccctctccctcgctgccccgtcctcgtcctttaggtgtcgcccgtgcccgttgtgcggttgtcggccccggtacccgtgtatcggtgtcggcagtcgttcgcttgtgcgtgtggtgaccgtgttagtgtgtccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaatggcgcagccttcctgtcttttccaggctagcgcttacatatgttttatggttgcaaagcctaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttcccgaagcgtggtttgcggtcgttgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtgggcactctattcatggttccactagtatgaatttaggtagatgcttcgctgattaattaggcaacattaggtggtttcataactctagactttgggaatattcatatcacttggacattatggaatggttagattattgtggaattggatgcatacctccccctctattcaaaaccctcaaaatggttttaggctgggctcggggtgcatggttttgttagtagcacctcggccacctaaggaccggtcttcgggcctctgttgcaaagcactaccgtacttccacatgtctagtgggtaaggcttagtttgtggctcagtctggttataaacaaaagtacacggatggagatggatgaagccgggggtcgatggacatctctaggacaaatgaaggctacacgggctgcggcccggtagtcgagatgtcatggcacagggctggtgtcctgctgctaggggctcaattctgcctgcctgtctgggggttccggccgtaggtaggttgggtcggtactcttgtctatggctaggatgggttggaaactatgtcatgtcttccgtccatatgccgtggtggtatgtggcacgtggttgcacgtgaggaagacgtgtcttgtgggtaaagatgtacacctctgatcagagtataacctattcgaatagccgcgccctcggttatgggcaagcctagcaatgtacccaagttagtgttttaaattcttaaaacctgcttaataactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgcctttataaaatggctttgggcaactaagtgacttttaaatgctgtttactgcaaaacttaaccccgatattattatccccttgtacccccttgcattaattatgcatctccggtgtgacttgctgagtactgtggttgtactcattcttgctcaatctttccccccttcagtaagagaagctttggagaagaagtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaatctagttcccaaaagaccaaaaagccgaagctcacttttgagatgcttatcgctaagttcaagaaaggattagccggtcagcgatttgataatcaaattagtgattcaaaaagaccaagatcatctcgtaggaagagatttggtcaaacatcaaagcaatcggagccatcaactataccaactccatacaaacctccggttgtgatgccatggtatccatattcaatgtcactatatggttatccttttatgtattatatgctatggatgcctcaaccacctatgccgtattatcaaggatggaaggaatcacctaggacagtgtcaaatcattcatctaacccaagacaagaccgtttcccacaaaagaatcggtccggtggatcaaaggtgaaaaaagtgtaaaaggtgtgggtgaggaaagaagccaaaactccggaggtcgttgctatcaaagaggagtctcaagatgttcatgtacctactggagatgcggtggaaaccacgcaagcaaaggagatcgaagccgacgccgtgactgtcaaaattggtggtctaaccgagacagctggccggtctaatcgccagtctacggccggcctgaccgaccttactggccggtctgaccgacggcttatggccggtctgaccgggcctagaggccggtctgaccgaggggcattagagaagagtgggaaaattgaaagcaatacatgagcttccacttcgacaaaaaatatcaagaatcattgcttagctcctggaaaacaaccacagccgaagtggataccttatggcttatctcgctctcaaaagaggaggctacagcgtcttcgggccataggtcaaaaagaaaaggaggccgaagatgcggagaacaagacatgcaataatttagagcctcaaacagcacctaggcaagtatggagacctaaagaagtaaaagttaagagaccggtgatttcccatagtagtagtgataaatccaatttgatgagagaagaatcatcggtcattagagataagtctccttcacatgatgctatggatgttggtgcggtgttcgtcttgccttcaaaatcgtgcagtcgagaaagccgattttgcttggggggcaagacattactatgctcgtgaagaaaccaagagaagatgaacagcgatggatacaacatcacatctttgagccgcattttgttggatgctaaggcaaggtatgggtttattgtgttcatcatcatattatttacctatgtcatgttagaacattgcttactatctagcacatgtgtttgcttatcaaattgatattatacatacatgttgcaaataccagttctaagtagtgaaattggtaggttggcatataatttgtttgaagtatgatttggcttatgagtctttgatatttatttaaagtcaaattgtatgtgtttttatggatcaccatataagatatagattttataattattgtaccatggaagttttgcttattagtaattcggctaatgtcaatggtcaatgtgatgatttattctagagttgttttctttagaaacattggcattgttaatattttgcatacatgctcaagccgattacttacatttgtagtttattggaattcatgtctgtgaggcatatgactttggtgattcattattgaattggctaagtgttttgatgccatgatgattattgtttcaaaagccatttgaattagtattcaactagacatgttagttggatgttatattttttcatatgtctagagagaaggaatttcggtccaataatttgatacaccaagcatctggctattatgtgaagaaaaattatatactaaaggccgatgcttgatttcaaaagtttggacgaaattggcaaagtcatagacagaggtggtctgaccggcattgcacggccggtctgaccggctctgcatggccagtctgaccgggtagacagtgaggtctgaccggcattgcgtgtctggtctgaccgatcctgggcagagagctggggggcacgttacaattgatttaaagaccggattaattgtgaattcggacatttgtgcccataagtaagaaatagattggagaatcactttgaatagaatatttcaatgatcctagtcttgggattgatcggaagattcggcggcaagcgctcaaatattatatcgccgaaaaataaatgtagtattacttggataatgatcaatctaaagttgctaggagagtagtacatgaagggatttgtgaaattcatcaatcggcccgtaagataaattggttgcttaggagagtggggtttcattggccgaaagtaattgatgattgtttcaaatgttatagagggagtgaagcttgttaacggatcggcaatgttcaattagcgcctatcgctgtattgaatcctattatcaaatcatagccgttcggaggttgggctttagatttcattggtcaatcttatgatattaagttgttaagttcttactctcaggctaatggataagccaagtcgagtaataaaacattgttgaaattgccgtttcgccagttgaggtaaatcttggctctcttcggtatttcaagtaagacgagttgtcggttgaagattatacgaccttgatgggaagcaatttttgaagatgtcatcacgagcgtttgaagactttgaacgagatgaagacacttcaagacggtgttttcagagatcaattaatgggaaatacttgaagaaatacttcccgagcatttgacaagatgattaggaagtcctatggccggtaattggattatcaccctgagacaacatattctatgcgtttaggttcacatatgatcaccaaaaaggcggggggcacgtgtttacacccaaatttggcacctatggacgaaataggggaaaattgccaaagtttggaaagtgacgggtttccttcacagggacggtcagaacacaggtgtgtgggcggtctgaccggctagtagggccggtctgacctcaagtatgtgggcggtcagaccggcagggtccgagtcagagtctattgtcgtcgggtctcgggtttcattgctcgagaaggcatgtttcgtgtttcctttggtttctatcccgagttgggcgtggagaagggcctgtagagggcaagaccaacccttatttaagggacaaggccggttcactgtaaaacccccgaatacaatatacttgaatcgttcttttaccatgtttttctattttaccctagtttagtccatctttgtcggtttgcgccgtaaatcgtccgccgtcgctacgagagtgcgacacttctttgtaggtttgtcccgttttgcccacgagacgggtagttatcctcttatcgatctaaatcggcctagaggctgattttgatctctaaatcggctccgttagccggtttagctgtttttctacgaaatccatcttgatttggccctttggctagatcgaggtggttggcgactccatatcaccgcaaggcgtttaggtgttgcgatcatgcttgtcgacttggcacaaaaagttgccaacaaatatacctataactggcctcactttttttagaacaactggcctcacttagtgtatttgtcatggttatggataccacatacctaatagtagtcaactaaatctcggcaggacccaccacataccacgtcttatacggaaactgacttcggatatggagggagttccggataaggaaagacaaccagagttctacatggaaacgacaaggactactcggattgtatccatattgcttttcctagttctacttggacaagggaacacctatgggtataaatacaaggccccctaggaggagaggggacacggacaatcgacgaccacctcaatcaacacctaccacaatctacggaacaatagatctagacacaagatcaacatacaagccaacatacgccaagacaagacgccggatatcgactttagggataagcacggctagtcccctacggtgtctccggatactgtcaggagagacggaagtgctatctctgatctcgccgggcacggattcgaggaggaagactaccctgttgtcgactacgagtcagaactttagacagccatgtcgacaacagttagataggctaccccaaatattgtactggtgtgattatggtaaataaagagcaacgaccggcttcggccaacagggtgtagggttattacctgacaattcaggggcccgaacctgtataaaaatctctatctctatctcttttacctcagtcttgcgtatatcctagtaccaacgatccccatactatgcaaataccagaactgcgacatcaaacatcgacagtggcgcgccaagtaggaggattttggtgcttcaggattttgaagagatgggttcaagagatgaattctccaacaataaactactcgacgacttcactgtggggaagatcaaatccgaccggagtatgtcttccgacgagatcgaaattatcgccgtcgtggaggacgaacgatactggcagcattggtgaccgatccaatatgggactgttctggaagctgacggatgtcctcgcaggcacagacgtgttggtttgattcagactaaggtctacacggcgctgtactccttggattcatacgaaggccgacttcctctatgcgcgatatcgatttctaccgagacaaatgcatccatgtatgtcggttggatttcatatgcgcctgatccaaatatctgtatcgtgtacgtatacggcctgtattggtcctacatgcacacggacaccagatacatgccacgctggaaaagtcaaagcgactctatacacagtcgtgtactcagagacgaatcgaaactttacccaagtacacaggaacatatcagcgcgctaatcaaggtaattagtggattgattttttaaattaatctactaatttcgtaaatacatttggcatgtatctacaaaggtacgcaataatttatatccaatttatcatacctactttttccaatctatacgatattgtcagatctataatttattatgtttacctacagcatgtcttttatacaatatctgctgtgcgagtgtttccgatgttaaatcgactgcggtttaacgctgggggctcgctctattttcttatgtataaatcatgcttacttacggtttacataatgattgatatttaatctgctcgttatatcctgataatactagaagacccatgcagttttttaagtacatactcgatattctctgctatatgtcttgccttctagaaaatatttttcaggaacaattgagcactcgagtaggttgtggtcgagtacatcccactatcgagagcattctcgataaatgcggagttgtcgcgcccaacctaccaacgaagaccgacgacctacctcatagcaccggccatggctggactactcgagaaaaggttgttaacggataattcctcgcgaacgtcgtcggcttgatcacctgacatgattgcgaacggacatccagatatgttataagttgggtatgtgagtcatgctggccacatgagatacacatgtaataaaacaactctagcacttccattggtgttcgagagataattctactcgctcgctggttctcgaaccagtacacagcaatctctcgcaccgcaacttacattggtgttcgagatataattctactcgctccctggttctcgaatcattacgtagcaatctctcgcaccgaaacttccattggtgttcgagagataattctactcgctcactggttctcgaaccagtatgtagcaatctctcgcaccgcaaactttcattggtgttcgagagataattctactcactcgctggctctcgaaccagtacatagcaatctctcgcaccacaattttcattggtgttcgagagataattctacttgctcactagttctcgaaccagtacgtagcaatctctcgcaccgaaacttccattggtgttcgagagataattctactcgctcactagttctcgaaccagtacgtagcaatctctagcaccgaaacttccattggtgttcgagagataattctactcgctcactggctctcgaaccagtacgtagcaatctctcgcaccggaaacttccattggtgttcgagagataattctactcgctcgctggctctcgaaccagtacgtagcaatctctcacaccgcaacttccattggtgttcgagagataattctactcgctcgctggttctcgaaccagtacgtagcaatctctcacaccgcaacttccattggtgttcaagagataattctactcgctcgctatttctcgaactagtaaaacgtagcaatctctcgcatcttaacttcagatggttgaggaacagctacgactgatcttcgaccgacagcgtagcggtcctcgtaccacgactccaaatgatcgagagacacctactcactggttctcaaccagttaatcgtagcgatatctcgtacatttacttctagtggtcaatttacgactactacctggtcctcgaccagcggtgtagcgtttctcccactacttccactttaagtggtcaagatacgactactacctggtcctcgaccagtggtgtagtgattctcccactacctttacttcaagtggtcgagttggggctactacctggtcctcgaccagaggtgtaacgattctcctattacctctacctcaacaaaagttgatatcaggtacacaataatgctaagtgttttacccagagatcccttaccacgacgacacctagtgttgaaacctatcctactgtccctttacgccgtcttgacaaggcctccgaggaacctaagggaacttcggctggggacgcccagagccgataaggccttgtcggatcctgtagagacaaaagaccaagtaagatctggtcgtataagagttctcgccgtgcgtattaaccaagccgtgtaatcggaaattgagttttccaacttcacagctgggggctaggatcagtgcttgttcaaccaaggcaggtcaagggtccaagagccttgtcctccgagaacgattctccgacgacaaggctgggggctagggagagtgtatgactctacaaactgactgatcaaagtcggtaagagagaagacgctcatatataaaacattggtcggtaaatttaattcatttttagttttccatacaaattataacatgtcaccatttgagcgtttgctcgggggctatttctatttgatattcttttctgagtattgatttctggaaaattctattcgacattgtggaaaactccatgtctctatggttctacaccaagatcgactaaggcgagtacgacaaatgttgacaaggctccgtcgcagactctacgccttctcgatcgctcgagaacggttgctggatctcgacaaggaatacggaataaagagatggtgtacccgccgagataaaactttttgacttcaatccaaattctcgattacagcaagacgggagacttagtcgtatgttatgtactttcttggttgacgtcggagattgactcaagacaaaccctttaggtgcccgcacgaggctgataaaggaagtctaacgttatctctgaactcaccgagaacggtcacttgagctcgataacagttactccatggtcagcggtcgagaatatgaattcgttcatttgcattgaagtcgggggctactgtcatggttatggataccacatacctaatagtagtcgactaaatctcggcaggacccaccacataccatgtcttatacggaaactgacttcggatataaagggagttccggataaggaaagacaaccagtgttctacatggaaacgacaaggactgctcggattatatacatattgcttttcctagttctacttggacaagggaacacctatgggaataaatacaaggccccctaggaggagaggggacacggacaatcgacgaccacctcaatcaacacccaccacaatctacggaataatagatcaagacacaagatcaacatacaagccaacatacgccaagacaagacgccggatatcgacttcagggataagcacgactagtcccctacggtgtctctggatactgtcaggagagacggaagcgctatctctgatctcgccgggcacggattcgagaaggaagactaccctgttgtcgactacgagtcagaacttcagaccgccatgtcgacaacagttagataggctaccccaaatattgtactggtgtgattatggtgaataaagagcaacgaccggtttcggccaacaggatgttgggttattacctgataattcagggacccgaacctatataaaaatctctatctccgtctcgtttacctcagtctcgcatatatcctactaacaacgatcctcatactatgtaaataccagaaccgcgacatcaaacgtcgacagtattattgctagctttctctctgtttttttttgataagctatattatctcaaaagtttctagccttctatcttgtacatagttgatctaagaaataggttacatcgaagtctataaatttaaaatggattggtgactggattatttctgtggattacatatttcattatagggataaattagatatttttagaaaataataaaataatgaaataagtggtcttactatacaatggaataagttttttttgggaaatgtatttttgagcaactaattaattgaatgatttagtaaataagctgacaacatggcagtcaagccgtctaactacctagcaaatcaattaatcctcgctcggcgagtgtgtaacacattactccctccctccattctaaattgatctacatatttcataggtacaccaaaaccaagaaaaactaataactctctcatactatatttactctaaaaacaagctcgatgcatacaccatcccattattttctattcaatagcaaatcaagatattgcatgtgggttataaatacttgtgtgcatggatacatgtatcaatgtccatttactccaatattaatgcacaaatactccaacgaataggcttaatgaatgcacataaatataatgataatttaggaataacctaaaaaactatatatagatcaatttaaaataaagggagtatcttagaaaatttccacggcaaacactaattagctaggtttccatcaagctaattagcgagggtgtaacacattatcttcatgaccatcttccgaattttggccatgctctatgatcagctgccatcgcatgcatgcatgcctcgatctggcggtgatctcagtaaccgaatgcttatcggagtcaacatatcgcacatggccctgcttagtaattaagatgcagatcatcagtgagccttaagcccttaattagcacaattttattaaatcattgagtgtattattatggcacgcgtggtataattagcaaacagctagctaacagcccacatttcaaaaagtcaatgtatgaaccttaacaacgctgctatacgtccgaccagcgtacgactcaacggcgaaatacacggcgcaagcccaattgaattagcgatcgttgcagaagttacggacggcggacggccaatgacgtagtcgtgcgctggtcgtacgcgtcggttggacgtatagcattttcggaaccttaattactccctccgtttcacaatgtaagtcattctaacattttccatatttatattgatgttgatgaatctagacatatatatctatctagattcattagcaccaatataaatatggaaaaaactaaaatgacttacattgtgaaacggacaaatagtttttttgttccaaaatcgtgagagcaaaaggatcacggatggattcgcgacatgtgctgggaacagggcatttccggattagtcgtgcagataagctgatccgagcactttccatttgtattaaatttgctcgctcatagtactgctgatgtgatgcaaagattatcttagtctaattttgttgcaccttcttctttaggtacaacgtataataatgatcagaacgcgtgacatgcatgtacgtgctggttattactcccttcgtttcaaaatatttgacaccgttgactttttttaagtacgtgtttgaccattcgtcttattaaaaaaatttaagtaattatttattcttttcatatcatttgctttattgttaaatatactttcatgtacacatataggtttacatatttcacaaaaatttttgaataagacgaacggtcaaacatgtgctaaaaagttaacagtgtcaaatattttgaaacggagggagtacgtgacagtacgccaatgtctgcagttaatcaggactcaggagcatccatgcatgcatgtttccaggatatcaatacgagcccactacacctccaattataattaagttggcataggtaatttggacagctagctagcgcgtcttcgtgcgtaccaattagaacaggctataaatgtaagccctcagtttcattcacatttcaccactcctccggtgacagtgagtgagccgagggttttcgatatctggataggagcagactcatcgctaaatgtcttacccgactattcaaaacaccggagtacgtgggtccgtgacgctgacgctgtgaactagctagccatggccatggctgcttcttcttcttcctcctggtgcgcactgaaacagtcatgcgtggccctcctgatggctttggcttgctgcctaactacgtgcgcgcgcggcgcagtcgaggcgctgtacgtgctgggcgactcgcaggcggacgtagggaacaacaactacctgccggcgtcgctgctcaaggccaactaccctcacaatggcgtcgactacccggggggcaagcccaccggcaggttcagcaatggctacaacttcgtcgacttactcggtgagtgtatatctcaaggccattcattagctagttaattatagtacgtttattagtaatatatatattgagtcaaaaatatattttgatagctgatatttttgggataatcgatctaacattcaacgcaaaaatccctctaaaaatatatcaaatataactacgataaatatatatatatataattatggtgtaattataatataattcgcatgtacttacgtccctaaaaaattcaaaagttgtgctggcttagtgggggctgcctgcggttgtcagtttgaccctcacctcgcgcaatgtcctctgatttttacccaatacaacatgcatagatcgtatagcccattcggtggctgaaaatttgatacgatttttaccaattttttttgtcgaatgtgaaataactaggctgtaaactttttggtgtattcggatgcaccaacactctagctcacccatagacatccaggcggttgctataaaaatagcaaggcactattattccccgggtgagggcgttcacactgcatcaccgtgacgttcagccctcgagacgccaacagagatttggactgccacgttctcgccactgctgcgctcctgcgaggaacgtgctaccaaactatgacgcgcgaacctcgtgttaggtgaggccgcgtgatgggcggagcgacgggatagagtctgcattggacctgcgatgctgtccggcccccacacggcacacccccactcccacaagccaccgcgggtacctcacccaactccggtaagagaacaaaaggggcagcaacagcgagatgggggaagaggggcctacctttccagccgccgctaaccggagaaagaagagaagacaaaagatggaggagaggcacatagccttgcaggcctcgtcggcacgagccgccgccggattccgaggggcgaagctcagcagcggcgtaggcccaagccaccgtggggacctcgtagcccgtgcactacgccactaccccgatctggtcggcggtcaccccgatctactcatcgccacaggtgtcggcgatggggaggggagggagaggtgtcgtcaacagggagggaggggagaagaaccggtgatggagagggaagggagaggtgccatcttgttaatagagaaatagaaagggctaaaatagaaaatatgaggggctaaaacaaaaaaacgaagccacacatagagacccatgcattgtgggagacaattttttttaaggtgtggttttagcccatggcacgtgaggcaggccaaattcttctggcacactgtgaacgccctgagcatacggtatgatcattataaatgatctcttgtgtcagtgcctgcatgtatgtactactttcgcaagatctataattcttagagcatgatcaataataaggtaatttagctccaattatgtccaactcatctataacttactttgcagcttgtacacgcaacatctagttgtattgttgggtcctatatgcttcacatcactattaaaaaattgcagcatcgatcctatgttgcaatttttgcatagcagcatttctctcactctctcacgtccaacgtttttatctagagatgcgtgttgcagcccgatgataaaattgtcgtccgctcgcgccagctcatgcatgttctctctctttagctcttttccctatatcaccattgctatctacgtggacttagtgtcgcctgactaatgtacctgctcttaagaaaactacgaagacccttgctcttaagcaaaccatgcatggttaggcaccgtaaaacttcgccaccgctaatcgattaacttcgccaccgcgcagagcgcttgcttggctagagccaaacaaaatagggaagttctaaattaaataacatgccgaaagtaaaggggaatcagaggaaaaattaactatgtgtagtatagcttcaatagggcaggctagctagtagcttagcttcagcatacacatgcatgcacacccgctgtgaacgaaggagcgagcgagcgacgatgggttcttgcacattgtcctccggcggcgtctgcgtcgtcgtcgtcctcctgtgtttggctgcttgctgcctaacgtgcgcgcgcggcgctgtcccggcgatctacgtgctcggagactcgcaggcagacgtagggaacaacaactacctgctgcactcgctgctcaaggccaacttccctcacaatggcatcgactacccggggggaaagcccaccggcaggttcagcaatggctacaacttcgtcgatttaatcggtgagtatatatccatcatcatcgatcgatcgctgcgtacacgtacgtacggccattgtccacagcgtatttttatgtcaaactgttttcatgtgctatggacgctcgcaccctacgtggaggatatgtgtcgtcctagaatgtttaagcatgattgcaaatctaagtgcctcatcttttcgtttatacttatacttatcagctaaaatttaaattttcaatcttaaatttgaagttgattttgaggtttttcatcaaagtttatttgctagactttgcttttaaatcgataagaatacgtatataaaagttttattcataaattacttttcgtttttaaatatgccgtttggcttattccatgaataagcaatggtcacctaacacaataggtgttttcggtagtgcttgctattacagcagcgtgcaggcgacagcaactaaaaacggccacagcctagcactgcagtagctagcgtttcaatcagcccctatgttgacgagagtatggtttttttttttttagtttttcagttatcaccaaatgtattcatgtgcatatgcatatgtgttttaccgatatttatgtattgtattaaaagtgttactccctctgtattttaatgtatgacaccgttaactttttaacaaacgtttgacctttcgtctaattcaaaaaaattatgtaattatcatttattttattgtgacttgatttatcatcaaatgttctttaagcctaacataagtatttttgtatttgcataacaaatttgaataagacgaatggtcaaacgttagttaaaaagtcaatggcgtcatacattaaaattaaaatacggagggagtatataatattgaaatatacaaacagtaaaatgggattttcgcaggcaccctcctaagctgcagaggcaacccaaaagggaaagcgcttgtgcaacgcttagatcagaaaatccagcttagtaggaattatttaatgacagagagttcgagtttatgaaattaaaatgaaacttccggacatggggttgcatatatactggaacttaagtctaaaattaatggaatcttccggacgaattgtttgaatcaaatagtagagagctcgaggtttgggaaaaccagatctgagccccctccgtttaatttgtacgccaatatgaacatgttggcaggtccgatccagcactgactgattgttattctcacaactaggatggtagctcgcgcattcgcgcgggcattcatgaatcattgcttaaatgtttcttttaagatatttgttagtttacaatatgtaaatttgattcatctatataagcacctatctataaagttaatcatctttatcatttaagaagacgtaggtcttaatccaaattaaagtaaggtgttgtttttatttttaattaaatgttttgggctcttatttaaaaaaaattctcaaaaaggttatttataataaatgtgttttattccttcttttaattggttcacaattgatgcaattttttatacgtacttatgtatgaatcaataaaaatatagagtagatatattctagacctcgcttcctataatatgtgtgatctatatatttgtttaaatacatttagtcaacccgagtgttaaaacccaaatttaatagtaagaaatataatattcaaagccaactatcttctgctatggcatagaacagagagaagtctattgatatgtagtcacttaaaaatgatgaagtggttatgcatggttatctcaatttaagggaaagttatgaaccacaatggttctaagaaattataaggttttctagaattggttcattttacacttttgttttattttatacaaatattattttaagttcaaatgtatgatatgacaaatagtgacatcattacaccctatgtgtcaactttttttaaaaaaaaattatcaataagcaagtaagattggtatagattttcattatttattaataaatggattatatgggacataaggctatggtaaattgatgggtttgtatactccaatatatttgcattatgtgatagataattcatttgggaacgttttatatataatgtgtgaggctctacacaaccattgtgaatacgatttgatggctaataatacatcatagagagagggaaccgaatgggtagagggaccgatatatacatgtatgtactaagtacgcatgtacatgatggaagggaggacgtggcacacgtgggcctttcaattgtttaataacaaaaatctaattagtccaccatgttttatggaaaatcaatggttgtgaatggacttgaattatttattttcgtttttcatctaatctaaataaaaaagaaaaaaatagaaaaagaagtagggtgggatgatacgtacgtacaaacgtacatgctgtacaggtacacggaccgagggataatttaagagagataaattgatttggtaattttgtactcgcaagatagatctaacggtggttgatttggtaattttgtaaaatagatctaatggttgaaaataatgggtctacccgattaaaagaaaatcaacggttagatgttttgttttttacttagaatttttaggatttatcaatacgccacgtggcgactttggagcgtttttagaagcaccacgtggcagcttgagagcgtttgtaggaagtttcatggacttttagtatataaaataaaatagaagatagatagatcttttgaaacttgacattatttttgctttatctctactcaaaaaaaaatttcgttggtgtgtgtgtgtttatatatatatatatatatctctttttgttgtctttttttttaaccttttttccacattgcagctatcagtctcggggtgcccagccctcctccatacctctctataagcagcaaaccaatgaacagctccgtatatctgaagggtgtcaattttgcttcaggaggagcaggggtgtctaatctcacaaacctggtagtactacaacttaatactagggtcgaaataaagaaaattgagtgatgtttcggtgctctctacctataatattatactaccagtatattattataggtaaaatagtaatttactaatacaataattatgatttactttgtcatttatatatgttttttcccggctaaatatatttcatcgaaaaagccaaaaaagagggaaaaagtttagttactgctaatgatgattatacccttttatacattttttgttacaatatacccctccacatttctattactgctaatagtggtagtagtacaaataaattttaacacttcgattaaatgagatcaacggttcatactgtcttccaataataatagagagcaccacactgaggctcaagaaaattttgaatatatttttagtgtaacacgaacagaatatgtatgaatcagaaatttaattacaggttacatacttattaatccatcaattaattattacatgagtatttaattctatattaattattacatgagtatttaattctagtacggcgcatgcaggcccagtgcatcagcttcgacgagcagatagagggggactaccacagagtccacgaggcgctggggaagcagctgggcattcctggggccaaggcccaccttgccaaatcgctcttcgtcgtcgccatcggcggcaacgacatcatcaacgacctcctgctgagtcccgtcagcgagctcctacgctcccgagatgagatcgtcagcaatctggaaaataccctcaaacgccagctgcaggtacgtatacttatgcttgcaaaacgatcttgcaattaaggtcaacgtaacatcaggccgggtttttgcagtttcggtttcgaaacagtaatttcagacacccccaccggccggctggaccaaaattttcgaattttctcaaatgtttatggatttagtaacatcacatcaccttcgttgctctccatacaattctccatgtgcttactactatctccatttcattttataaatcattttgatatttttttttcatttcaaactttcttaagtttgaccaagccttctacctattatatactaaaattttattaaacttcttatgaacgcttctaagccaccatgcgtcattgcttccgagtcgtcacatggcactttaataaaatagagtaatataatcatcgatttttatttaatttggtgtaccattattttagatcaataaatctatttaaaaacaaaactaccttgatctatatatattaaaaaaaacaaaaactcccactgtcccagctgcctaaatgcggcgtacacatgtatgtatgctccctccgttactatatcgctctcctctttctgtcctcgtaataattgaaattaaaattactttcacggggaaaaaaacccacatgtagacctcgacctagctaataagtccagccagctttccctctatccctttatccattaatatttatagtctattaaacaacatacaaatatttctaaaccactacgtggaactacggaattaaaaaaaaaatttgaccatcggtttctaattgatttgataggcacattattttaggtcgttagatctatcatttttcttaaaaaaagcatcccaaacctccatccccagtaaacatcctataagcatttctaaatagatacgtgtactctaaaattagataaaatcttaatattcaaacattttaccaggacaaataaaattgaaatatctaaagttttatatagaatctatcaaaaaattggactttttggtaaatttttttggtacgatatccttctggggagacgaaatacccaaaattttctcattagaatcacatatattattttaacacagtattttctcataaattgaaaattgcacggtttcaaataattttagtatagaatttatatgctgcaatggtaataattagaaaaaaaaatcataaccaacgttcaaaacacatcaaataagtttaattttagtttaggatatagtaaaagaatatttaaattaacagtcactctaacatgaacattcataataaaacttcacgcacattaaataagatgcccacgtatatatgcgggctaccttcgtactttatagaaaaaatttacaatacctaaaatgccaaattagtttatgtaatatagaattcaatatattttgttaatttgtttgttttctattggaaatgctactatattttttttataaaattagtttagacttaaataagtttgataaaagaaatcaaaacgacatgtaatatgaataaggagtgcaaatctatcatgattttagaccttgtacgaccttgggatgcgacggttgttcttcgtggggatagcaccgctgggatgttgcccgttgatacgggagctgaaccccaccaaggaatgtgatgctcaggccaactacatggcaactcggttaaacgatgcggcggtcgtgctcctccgcgacatgagcgagacgcatccggacttcacctactccttcttcgacacatacaccgcggtgctccagtccattcgttacccagaggcacatggtacgtatgtactccttccattttaaaagtatagcaaacctactatactccctcttccactttttaatatataacatcattgttttttaacgtgatatttgatcattcgtcttatttaaaaaatataaatattatttattttgttttgacttattttatcataaaagaaattataattcgaacttatcctttcacatatttatactaaaattttaaataggttgaatgatcaaatgttacgtgaaaaagtgaattgtgtcatatattaaagaaaaaggaggtagtacatatattagacggcaccggggtagtactataaatctatacaggaattagattactatatatattaaggtgaagagaatatggtttattaggattaagattctccacatttgtcactttattcagtgattttgtttttttaataggctataaggaggttaaagcagcgtgctgtggcctaggagataacaacgccatgttcctatgctcgccggcgagcgtgtactgcgacaaccggacgagctacatgttctgggacgtcgtccatcccacgcaggccgcggttgagaagcttatgaagattgcgtttgatggatctgcgccgttggtttccccgaaaaatatcaagcagctcactgagagttaggcattatataaagccaagagtacgtgtctactggtactactatactatactactattatcaccactggagaaattttgaatcattaatttaggagttatatttagtgccagtaactaacgtggtaaagtaaacaagggatttgctagatttgaggtgactgatattaatttgtaaatttacagtctcctaaaattacacattttgcaaagtttaaaattgcatagctatacaatgtgaaactttacttattttaactatgatttttgttgttatatatatccatggtttcactttatttttctccatgtttgatttttttcatttaattatgtattgtgtataagctataagtttatttcattcaattttgtaggttagaataatttattgtacaaccttttgcctaaagaaagaacgtcattgtaataaaaaaacaataggatgatcacaatcattagattatcgtacgatggaggagaaaagtcaccaaaccttttaaaaatttgaggtaccggaaatccagaaactttcaaatatgtggtctagatcagagtactgataaagaccattggaaaagagtagagtacatcactagtttctaaggcttcgttcgtatgtgcgagtcctgatccggttcatgttccgtgcactggaagcgtggtcccgcacacagtaccaaaacgacggcttgtgaggcgacgttaacggcgttaacggatgtgagaagttgcctttgcgcctcggcttttccgtcggagttagggcatccaatgctctcgatccctctttcttcctcctctcgctgttgctctcttgcttccgcggtcgtcgatgcgacgcaggcctggaggagaatcgattcccctccgctgtaggctcccgtcctccccgattctcgccagccaccctcctcccctttcgactgtggcttgcaggcccgtgcccccccccaatcgattctcgtccgcgcgtcgtcttgcggcagcggtcggttcaaggtgctcaaaatcggggggaagtggaagagccccacgcctgtcgagctgtctgcgtcgtcctcgaggggagaaaaagctggccggcgtgctcgctgtgaagcagcaagcatcggcgcccatcaggccgcccatctttggcagtctggctgcctgtgtgctcgtcctctcggcctctcaggtcagacagtgctggcttgaagagtctcatcaaggcatccaagctggcggagttgaggagccagctctatttcaggacgagcgtgtgcgtggtccgatggagacgagagtgaagaagcggaagcaagagcgggatctattgtcgatccaagaggaggggacgattgttcaatcccctcaaacaggggagatctctgtccgcggcgccgatctagagtccggcgaggactcctccgactctgtcacctccgacgctggcagcgccaaggctgctcccgacgacgtgcttcatatcgcgcatgccctctacaaggtttgcgccaagtctcctagagccgtcatcgactttgttcgaagagtgagccctgccaccgtcggccgttcgattgattgggacgtcgtccgtgaggaagagtcatcgaaggtattggtttgtattaatttgttcatttccgattcaattttgtttgacttgcacgtagtagatgggcgatggccgtagccggtggaccgatatggaggttcgtgtgtttcttgagagctgcttggaggagatggcagcgttcaccatcacctccaactcccccaagccgcaggcatggcagaacctaatacacaagatgtacaccaagtgtaagaagaaggtgaacaaggctcaattggagtacatttgggggcagtgtaagaagcggtacaacaggtgggtgtggctagaatcacatgcaagcgggctgggtcgtgatccccatacatcagccattgttgccgatgatgagtggtaggaaagcaaaaatgcggtacgtacacttgacaataaatattttgaaccaacaatttttcctacaagaggtattatctgaaatttagtacatgcatgcagttataaatacagttttgtgaggtgtaataatttttttgttcaagttgtgtgtgccaacaaatgactagctgcagtaaaatggaaggattgtgctcacatatgtttcatagttgttactgtcatgtcgtttttagtaatgtgtgccattcccttgtatttaagttaacaaaatgatgtttacactatttaccatgaactgattggcaatgattgcgagaagtaaatgatcttgtacatgtgacattcaaaagcattttaacagattcacatgtgtttaattgtgaaggatatagcttacacaatgtagcattctattagcttatgcaatgtagcagtcaatgtaacatggtaatgctcataggttttgttctctgcataaacaaaatctatatgcagtgtatcagtaaattaggaaagatcttgtacaagtcatttaggaacatgttaatacatattcaactagctgtacacaccttctttctgatgtatatagagagaatgaacaaaaatgtgctcatctacaaagaatataacatatgcagtttatcttatgtttacaatgttcaaactatctttctttcattctgtcagatgtgtggcccattgtaacatgtactcctgattatatttgataacttggtaccaatgtgcacatttactgccagcattttagtagtaatgcacattggactgcacatattcattacgttcaatgtttgcacaagcctaatgcacttgccttgtactaacttgtttttactgtctacttatgttgcagcaaaataaaggtgtcttaagcttcaggaatgatcctctgaagcacattgaccttcaccacgcggtattcagtgggcgcacagttgtcggaaaccactccgccgtcgcaggggcagccccagccgcaccgcaaggagcagttcagtggcagaccatcgacatggcgcagctcgctgctgcttatagaccaccacctccaactccacccccaacggcagcagaccggggcaagggaaagaggccagcagcaaacactcctgcctcagggagttcttccaagaagtcccgnnnnnnnnnnnnnnnnnnnnnnnnnnngaggattgcggacatccgagagcagagctaccagagtcatgctgcttagatggaagcagagaagtctatgggccttgatgcgtgcatggagttggtggaaaatgatggccatgaaattggaggaagtgtgtggtatgctgcttgtgcgctattccgtgacccattgacctgcaaatgctttgttcaactcaaggacgcctctaggcgcttggaatttatacgcactggtggtactggacagtcatctggtggcaccaaactgtactttactttgagttgtgatgtgcgatgttttccaaataaactagtatttatgtttagaactctgtgtgctaacaatttttacattctgtgagtccctaaacatttgcggctttatatccaattcgagcaactacgtattccattgcattgcttttatatccaaataattcttcgattgcatagatcactgccattattaatttctatccttttgattatgacaaacattgcgtattctccggttctcatatgttaaaggaaatcggcgatgagttacggcgcgggtggatcgagttggaatggaggcggtcacacaagcagcaaagaagaagatgccatcattgagtacgtggctgctacccttgatttcaatgagagggcaccaaggagaataccggtgcaaaccggtatcagttggatgatggacacgatggcaaatcgaagccaatgcagggcaatgttcaggcttactgcggaggagatacacaatttgcatgatctattggtcacttcttttggtcttgtaggaacagcaggggtctgttccatggaaaagcttggtattttcttgtacacgatgggtggaaatcgtccaatcagagacgggaacaatcggtgggtccgctccaactcgacagtgtcggttcacttccaccatgttttgcaggctatgaatgatctcgctgggaaaatattgaaaccggttgatcccaacttcttagattacaaccctcagattctgcaagagaatcctttcaagcctttctaccaatcagtgggagctgtggatggcacacatattccagttctgcctaatgcagctagcgctatgcaacacaggaaccgtcaccacataacaaccagaaatgttctagtaatatgtgatcatgatgggagaattattttctgtgatgctggctggcctggatcagttcacgaccaaaggattctcaatgaggcagtgcaggcttacccctacgatttcccacgggtaccgttaggtgagttgtatcagtcaatacacttttttttattgccaaatgtcttgattttatttaattctacacatgtgcactaatatttaattctgcgccgttaaccaggcaggtacctacttgtcgactccggatttcctaccaggatgggattccttgcaccgtacccacatgtacggtaccacagggatcaacttgcggtcgagggagccccaccacccgtaggacgggaagagactttcaaccatcgacactccacgttgcgagggatcgtggaaagacaatttgtcatcgcaaaaaagatgtggaaaatattgaaagaaatcccttattaccgagatgaggacatccctgcacgcatcattcatgcagctttcgctctacacaactttaggttggatagtaaagatccgacctatcggttcactaatgctctctacaacggcaatccagtgccgctgctgaacgattcattcgaccatatgtattacgcaacaaatagcgaggccgctatgagcatgttgcgtgactgtattgctgatgatgcgtacaataactaccattaggtaggtgatgttacccataatgcttgtcgtatgttcagtacttcaattttcaagattgtatggtttaccatttatttttataacgttaacaacaaatttgatgcaccgaatcttgtgttatttgtttcacaattcatttttttcttaattcttgcgttattatttcagacaaaaaattaatcaatgttattgcaaaatttatgtccgaatcttcacatattatgaaaattattatggtaagaaatactgcgtcattacgaaatggttttctgctactgcatagcacaattgcgaaattcaatctacatacaatctattatttcaaacgaaactacatgaaattgaatccatatgaaattactactgtaatgcaattcccatttcttctcaattttttcaaatcggggtgtgttttcttgtgtgcatctaccaattcctcccacgcatttacaccccctgcagcgcatccggcggcaacggcagccattgtcacgcccagaaattcccgaatagaattccaagcagaatgtgcattaaaacccccgtcgaggactggccggggtacacaaacgacaatgttgacatacagatccatgtcttacaaacattataaaagtcttacataaatgcagcggaaaaacaaaagataactggagctaatccttgacttgaactacagcgggaacaccactccacaggtatcctcgacggcacggacgaagcctactcctcagagaacccgccatcggatacatactcgagctctgggattgggggaaaatagagcaaggctgagtactatccactgtactcagcaagtcataccggaatgggggggtatgatgcagggattcaacaagggatagctaaacaggttcatttgcataaatactggcatttataaacaggaattgaatgcgaaaacagttgtaataattaagcagaattaatcgtccactatccaacgttacaccacgttgcaacaggcccaatcatccacctataccatccaatttcattagactaaactaaggtgagtctaatcacggtgagtctggttgaccgcccataaccgcgggcacggctattcgaatagttttactctgatcagaggtgtacaactgtacccacaagacacagccccacgacacgtttccgtgcgccgacatgccaccacgacataccggaaagaggtcgtgacaggacccttcgcataaccccctctagccaagcacaccacacctcaggtttcacccccgttcccagcgggcaactggcagtcccctctcgtgcctaggtgaatccgaaagcgacagaggccgtcgcagggcccgccctgctccatcacgcccacccttgcctggatgcgtcagctagagaaaagctacactacaagcccagccgttgcccacgctggcttgtggtaagcacgataaattcttccagggtttcccgcgaaccggtccttaattgctatgggcgcgactagcaaaaccttgcacccacagcccaccatgtgattcattttatttaaccaacaccagagcggtggtactaatccaacattatcatataaacctatagtctaggttttaaatgagttttccccattgtgtgctagttgaactaagcatggctaagcaattcctagtccaaagtctaatcatgttataacccaagctaacaaaggagcatggtatccaaaaagcatagctgtaacaataggtaaccatcccatagtataattgcaaaacaaatgcggtatttgaaagaaaacattaggacatttgcaatataggatcaatatgatcaagtgacaagcatgacttgccttgctctgctgctggaggaacctcggcgactatttcgaagtacaccggagcgtcggaagagccggaatctagcgacatacaaggcaaacaatgcaaacaggctataagactactgaaacagagaacaaaaccatttttaatggattctacacatttttcttgatttactgagacttgaatgggcttaaacggagctcggatgaattagttatgaattttagaagattcaatgtgtttattactataacaaaaatccttaaataatttattgcgcaatattttccagggctgacgtcagcacgggggaggcgcggcgccgacaggcgggccccactggtcagcgactcaaggggggcggttcaccgtggaccgggaccacgcgggtggtccaccgccggtccacgggaccgacggcccagatcgccctcggggccgatcggacgggcggcgatagaggcggccgccgggctcggctcggcatcaaagccgaccggccagccagggctagcggcgacggcacgcggccgacggcggcggcgaccggcggcacgggaggcggcggcggcgtccgaaggcgacggcgcgcgacttgaagcggcggcgcgacactaggggggaggaaggggaaaagaggggagggatgcctcaccgagggtggccggcgcggaggaagacgacggcgaacggcgacgacgagccacgggaggacgacggcaaccgacggacgggattcggggtgccctaaggaaggagaagagagagattagagggagggagatgaaccacggcgaccggcattcatggccgaaggcggcggtagaggttgaactcaccggagcgcgaggggatgcgaattccggtgatgaatcccgacgtggaaggggcggccggggtgaagcttagcctcgcgaacccgacggcggcgacggcgcggtgcggcggcgaccctagtggcggctagcggcggccggagtggcggaaacggcggcggcgggtggttgcacggcgcgggagcgatggggagcacgagggagttcggcgagatggggaaaaagcgagagggggcgacagggaagcttaaataggggaggggagtcccggacgtggccggtagggcgagattttgccggccaacgtggggagtgggggaggagagagaggcgggattcgaaaatcgaatcccggccatctcgggcgcgggtgcgagcgcgaaagaggggaaagtgggtgcgggagatgcggcgcactcgcgggtgtggccaacgcggcccggagaaggcgaaggcgtggacacggcggcggttgcgggcgcggcgacgccggctggaggaaggagacgggcccgacaggtggggcccacctgtcggcgtcccttggagagagggaggggcggtttgggccggcccacaaggaggagggcgcgcgcgcggcggggtggaatgtgccgacggcccaagaagaggaaaaggagggaaaaggaaaaaagaaaaggaggaaaagaatttccctgggatttaaaatattgcatgctcgattttaattggttaaaattatttcgagagctctgaaaattccactaaaaatcttgttagtgaatttcgacatgtagaactcaagaaaaattctacatgccaattccgattattatttgcattgatttaatagggttaactcttgctttgcaccggtattttcttagggtctcttattaattcgattttaggcttaggaggagaacttccgggtgtgacagccatccttctctcgacgacggaaagtgtcggcgctccaacggcgcggtggacgccatctcgtccgtcaactgctacagtaatatactacagtagcagctacagtactcaggttcgtaaatccctggaaagcttccaaacttgctcatacgaacagagcctaaacttgttcgtttatgttatctgttttcatacaatcaaaaatagatgtagttattaactggttaacgtgtcatttcagtctgaaattgcacggatccctctaggattctacatggtgttaatgtgccacacggacgctgatatagcatcactactaactctacactgactgaaatgggtcccacttaggaatttccttttccttcttttcttcttttgtatttttccttgtccatcttatctcctttttttcccctttttttctcattttccactacaattgttgtcgtcaaggtcatcgccataaacttgtccatgttgtcattgggatgaagggaacaataacgagtggctcctctgctttgttgtcacctccacgagagggggatcatgcacggtgtcgtctacatccttgggagctgttgtttggtgtaggggcaaaggtccgggccgagatccagacccaaaacaccatgcatggcacgaacaatggataccgaagttggaggttgtccctagtcgccatcaccgagttagcccttgctgcgggccctcgagctcgcccccccccccccccccaaactcttcaccctatcgcctctattgagctcgtattcagtcaccacagatgggctctgccatggtcatgggccctcaagcggtcacccgggttgccaccatccttgagccccttcatgtatatgagccgtgcatgggaagaggagaagattaaaaaaaaagaacaaaaaacagaggaaaagaaaaaaataagaggggaaaattgaaaggaatttccgtgaggtggcaaccaacaccagttaggataccggaggcgtcgtagcaatttgggactaaaatgatatactttaacaacttctaagacctagatatgtattttcagagcatggggcctagatatataggtgaacaaatttagcaactagtcatgcactttatatatataagctaggggcaagaccatataggtgtaaatggccgttgtgaaattcatttacataagggtattaacaagcactattgcaaaaagtcacatcgtcacatggtttaaaactggccgccgcttacacgtgcttgaaccgacaaaagtacaatcttaagtggtactgactagcatgaatatcacaacctactgtgatgagtatcactccaacaattgtactattttcatccgtaagaatacaatacaatttgcattattttagaaaatttactttagtaaagattcctatagtgtcatttttatctcagttgacatttgatcatgaacatcatgagcaacataagtcaaccaacgcatatactccctccattccataatataaagcacaaacactttgtaacgtcccgcctctcccaggccgggcccgcttacatctgatagcttttataggttatagactgccctcacagaccaatacaagtcttttctgcatactttgtcctcactcgtgcgcactcgggaagaatttcccgatcagtcacccatccctaaattgctcaaggccaaacacgcttaaccctggagttctttggaaatcggcttccggaaaagaagttgcaacttgttccaggaacgtcccctcctggccacgtccgtgcgtccagtgccagcacatgtgccatgctgtgtgaccactcccggtccacaccagccatgcgcaccatgcctgcgcaactgcgacacacgcactcgtgaaaccgcgagagtcggctctgataccactttgtaacgtcccgcctctcccaggccaggcccgcttacatctgatagccgtttacatctgatagctttcataggttatagtcttatagactgccctcacagaccaacacaagtcttttctgcatactttgtcctcactcgatcagtcacccatccctaaattgctccaggccaagcacgcttaaccctggagttctttggaaatcggcttccggaaaagaagttgcaactagttgatatgagtattctattaatcctattaagccctgggctgggatgttacacactttttttagatgttccataatataaggcatacatgcatgcatgtcattaactatgacatattctccattaaactactattttttaaaatccttcactctcacattctctaactctattggatgcatgcattacatttattaggataatccaaactacaagataataataactatttcttggtctttggattaaggtggttgtgccttatattttggaatggagggaatatctaactaaaataccaagagcaccacaagagaaacacttacgaggtgttgggcatgacaaagttaggttgtaggagctaaacctggtctctggttcctccatgagaccactttatatggatcataccgatatgtagaaatgaggctgctgccatggcattgagtggcagggtagcaattaccaaggctcaaagcacccaatgccaggtggcctaattaactatcaaaaccttagctataattattaaaaaatggagcaaaaatgttcagaaatgaagatttacaagaaggcattttggtactggtctcccggacttgtacttgaagggaatcaaatggcttgatgagaaggagatgggccacaggagatacgatgacctacaaccagtttcataattcctattaatgaaagattgttatcatttctgattagtgcgtgaaatcagaatctaaactcctttagatattaagtgttgtaacctgagttgaaccaatttagatacttgcatatcagcgaatgggaaagtacaaaattgaactctaaatttcatttgttgttaccggtaacttgtaatatggtgcagtcttgtggcgaacaccaaatccccaatccatttcttctactccaattttcataacaattttgaggcttcatactacactagactcgagtgaatggtggaaattggtggagtctgtgtttgaaagggacaaaaaaccaaggaagaaggaaggttgtttctgttgcaagaaggggatgatgttgaggaaggagcaacaatctacaactacaggagggttcaggaaaagccacaatgggatgggcaatcaggagacagatgggtcgagatgggacaggtggaagagctaattgtgattggtatattggtagagaagaaatagaaaccctgtaaagaaagctatctttatataaactttgattgagagcaagccccgtatatggagttaagtgcatttccaggctccagcaattaatatcccatattttggactccctaaaagccaaatggctccatgtcaagcacaaacatgtattgctcagcctccatttctttttctcttctatataaacatacgctttatgtataagcatagtttaacaccacacaatagttcaaacatgaatatttatggtgcaaagaatttactatattcaaattaaaaatttcaagcaccataatttaaattcaaaattttcaactatggatgtgtcaaataatcctattaacatggatgtctccctcgttgtgtgatgagtatccaacatcagtagttcagaactatgcatgacaataaatcactgaccaaaaaacaagcatcaagcatcacgtattcctgaatgttaggaatgtctcaaatgaatggccatatgtgtagcaaaactagcaaccattgtactatccatgagattcctgaatctcttcgaaaaccttgtagctagccgtcgacaggctatagccgacaacggtatccataaagcataggggtcattggtactaggatatatgcgagattgtatcaagaagacatgggacaaggatttatactggttcaagccctcgagatgaataaaaccctacttcagtttatatgtattgctggaaaaagtaccacacaggttacaatgtgggaatctgtaaactactctaatctaccgactagaacccaccgagtacatctcaacgagtggaatacaatgactagggctttggctttctccggattatttttcagtgtggctctagctatggcttgtgatttgatgccctaccttcgtatggggccttgtatttatagcagtaatcgctttcttcttcaagtagatctcgaagatcacgggcatggtacgaacattggaaaacttatcttctttggatcggactgacacctgctatcccacaaatatagtttccttccgagttcgtcttatctcctcatctaagtataccttctcgtataataacattaggtgtgcggtatctcaatacaccacgaactcaagtataggaggtatgccttattcgtagcactgacgctatccttcacattatcacttctatagtacatggtggggagtgggttacgaacaaaaatactatgaatgaacccatccttaatgatcgatgcatgaagttgtctgtctaactcaattgaatttatagagctgaaaacggaaggttggcatttgtcatttggccctaggccatcatgaatcatccaccttaacaactaaacttttggttactaaccccccaatatgaaggctgaccaaatacttctattgcttaatgtgccaccttcctaacttgctctaacaactcaatagacccaaagtttttatatgttgaaatcaaagtatccttgacaacgtagaccaagaacaactatatctttgttatcataccatgcatctggcaagccttataccatagacttccgagagcaagcaagcaagatatacacgaacccacaccatatcacgaaacatattgatgaacaaacattccatgccattctacactgccatggagataaccacacctgaaaccatgtgttgcactagtccctatctacaaatgccttgaacatgtcagaaaagatgccaggcatagttgcataacagatcaggaagggagcacggtggggcagggaggggagggttgcggactgcccaacttggggatcctagggcatcaggcaaagtaggcttggagtagggtagagtctccagtgacgctgatgacagcaatgaacaatgtagccgggcttcttttctaagatggtgtagcaagatgctagtgtagggcaggcctcaggcggagcgggagcaggtgtcgcagtcacgcgggatcaattcagcacaggcacgagaccagaatattcctctttcacgtagaagctatcgatgggggttatagtttagagctccgggattaagggatatgagttgagatttgggtggccttcctattttttaaagggttctctagcaggggcattgttagacctttttttacatcagtcaaaaatatttatgggttatgtttagaggccttgtgtcacaccccgaagttttcctcccaagccaaaattttaatttttaaaacgaccctaagaaaatgcaggtgaaatcaagagaaaaccctaagaaagtaatgcaaataataatcggatttgacatgtggaattttttcttgagttctacatgtcgaaattcattaacaggatttttagtggaattttcagagctctagaaataattttaaccaattaaaattgagcaagcaatattttaattccagggaaaatcctttttccttttctttttctttttcctctctttttcctcctttttttcgaatgggccgtcggcccattccctccttcctccccctcctccttgctgggccggccgcaggccgaggcccagccaggccgcccgccgccctcctctcccggggtcgccgacaggtggggcccacctgtcgggtccttcccccacctcccgccgctcccggcgcgccgccgcgcccacgtctccgcctcctccgggccatgtcgaccacgcccgcgcgtgcgccgcgtctcccacgcccattcccctctctctcccgcccacgcccgcgcccgcgcccgagatggccgggattcgattttcgaatcccgcctctctctcctcccccactcccccacgtcgcccggcgattcccgcctctcccggccacgtccggtcccctctccccctatttaagcatcgccgtcgtcccctctcactttttccccatttcgccgcactctctcgagcctcccatcgctcccgcgccgtgcaaccccttgccgccgccttttccgctactccggccgccgctagccgccgttagggtcgccgccaggccgcgccgtcgccgccgtcgggttcgcgtggccgagatccaccccgtccacccttcctccgtcgatgttcgtcgccggagccctcgttccctcgcactcgggtgagcaccacctccaccgccgccttcggccatggtttccgatcgccgtggtccatctccctctctctaatccctctcttctccttccttagggcaccccgaagctcgtccgcccgccgacgtcgtcctcccgtggcttgccgtcgccgttcgccatcgtcttcctccgcgccggccgccctcggtgaggcaccccctcccctcttttcccctccctctccctcctagccgccgctttagcgccgccgcccgttagtcgtcgctttagcatcaccgcccttcggcgccgccgtctccgccggcggttgccgtcgtcggcaacgcgcgtgcgcgtgcgcgcgccgtcgccgtgaccggtcggccggctttgtgccgagccgagcctagcctggccgccgccgcaccgtccgatcggccccgggccgatccgggccgtcgatccccgtggaccggcggtggatcacccgcgtggtcccggtccacggtagaccggccacccgtgcgccgctgacatgcgggtcccgcttgccggcgccgcgccccccttgatgacgtcagccctggaaaatattgcgcaataaatcatttaaggatttcttttataggaataaacacagtgaatcttctaaaattcatatctaattcatccgagctccgtttaagcccattcaagtctcagtaaatcaagaaaaatgtgtagaatccattaaaaatggttttgttccctgtttcagtagccttatagcctgtttgcaatgtttgctttgtatgtcgctagattccgattcctccgacgctccggtgtacttcgagatagtcgccgaggttcctccagcagcagagcaaggcaagtcatgcttgtcacttgaacatgttgatcctatattgcaaatgctctattgttttctttcaaatattgcattgttttataatagtatactatgggatggttacatgttgttacagccatgcttttggataccatgctcctttgttagcttgggttataacatgattagactttggactaggaattgcttagccatgcttagttcaactagcacacaatggggaaatctcatttaaaacctagactataggtttataagataatgttggattagtaccaccgctctggtgttggttaaataaaatgaatcacatggtgggctgtgggtgcaaggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaaggatcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcacattagtttagtctaatgaatttggatggtataggtggatggttgggcctgttgcaacgtggtgtagcgttggacagtggatgtttaatactgcttaattattacaactgttttcgcattcaattcctgtttataaatgccagtatttatgcaaatgaacctgcttagctatcccttgttgaatccctgcatcatacccccattccggtatgacttgctgagtacagtgggtagtactcagccttgctctatttcccccccccccaatcccagagctcgagtatgtgtccgatggcgggttctccgaggagtaggcttcgtccgtgccgtcgaggatgcctgtggagtggtgttcccgctgcagttcaagtcaaggcttagctcttgttgtctttcttttcttccgctgcatttatgtaagacttttatgatgtttgtaagacgtggatctgaatgtcaacattgtcgtttgtgtaccccggccggtcctggacggggattttaatgcacattctgcttgaaattctattcgggaatttctgggcgtgacaccttgctagagtcgctcttagatggataaatgggcaagacaggtataggcatgaatacacatgcctaccctcttgcatggagcgctagataattggacttagtagcatagggtatggtatcaagattcaacaagtcatgtcacgtgcacatgcacataattagtgaagcccattagcatagaaggccaagataaaactaacagttagtgggatttggattgcaagtgtactatagtgatactatatgttcacgagagtcctgtttggtccatgttaatcagtctagtgcgtggcttgcaggaaagtacgaaaggagtgacaagttttccagtggcgcgtgtctgagacagtgcttattatcgaaaaaaaagaacaagcctggacttagtgcatcatcaattaaggctgagttctttccccagttttcccaactcatcttccttgtttttcatccgcatacttttcaaattgctaaacggtacttttttaaaaaagtttctatacgaaaattgcttaaaaaatcatattgattcatttttgaagaaaataattagctaatacttaattaatcatatgctaatgggtcgttccgttttctgtgcgcaggagatgggtttccaacccaaatcaaccaacacagcctaaatatgagcaataggatataactaggatgtttgttggatgtacaatgacattaagtaaacactagtacagacccctctattggcaccggttggaaaccgaccatagatgttggttttatagtcggaaccaatttaacggcaccacaccaatacccaagggcaaaggtgacggttcacgacacttatagagattatagtggccagttcttgcctaacaaccagaacctatagttttcaatgaaacaaaaaaaaaaaagacagccggtggaggtagacatacacggagcaccagcgctcgcggccggcggcaaaagtgtcgagcgatggaggctgttgcacaatcacgaaaacacctgacaaccacccgagatcccatccaataacatcatccccatatatatatataaaacacgatcttgaaacacacaaaaacacatggcatgaaggcgcagacaaggccagtgatgatggggccggtgccgcggctcctccggcgctagtacccccttcggaccagcggcttggtggcagcggggtcacctccaccaaccaccgctgccggaagggaagaaggaaaagggaagaacaggaaagggagagggaggcagcaagggagtagggaagggagaggggaggcggcaagagaaggggagggagaggggaggggtggcgaacgaagagggaaggggaggatgcgcagcgagggagtggggaaggagcgcgaagaggggagagaaggttggggagaaacaagagaagggggagaggggatcgactgggtgtggctctgtgtagtggataaggacatgcatagtggtatggataagcacgttggctagctctggctcggctcgtatgggtacccattttttaaccggtatttataatatgttataggtaccggttcttttaaaaaataacacctataatattggtgcatgtttttgctccggaagcggcacctattgttgcctaaaagtgctggttctatattttcctgtgtgaaaaggactataggtgccagttttaaattaactaacaccaatgaacctatacctatgaggtgttttgtaatagtgaaaagaggctaattaagttataactcttattttaagagctaaaaggtgaaatttataagaacaaaataaaaggatactaaaataattttgattgtgggaaacaatgtaactagattataaatatgtgaaacaaaattataccaaatcatggagtaaaacatatctccatcaaaaattagttcaaccaataaacggtatgcaaataaattaatttaaaacggtgatataaaagctaaatttttgtatgaacatgactttgacttattatcatattaacggtgaatatatattgggttttaagatggatatcaaagtggcgcaaagcatgactatatggctagtatacagagtgagcgaaaagagggtcagacttatttctgagtatttaactatcctggtcattttggccattttactttcattaaacatttttcgtatctgcctcatgcctcttaattttttaataaaaaatagaagaaaaaaaagaaacttttcaaccgaaacacgcatagatactgtgtgggatcacaaagaatgaaaaccgcttgcagataaagctgcacaaaaccggagggagggctgatctacgcacgcattcgcgtgtttctactgttgcgaacattctcagccacgccgataattggctgtgcgacgctgacggcgttctattttaacatttactagggcagttgaccagttaatccggggaaaaaactcctgcatacatgcgcgtaaatagttggacgatccaaaagaacttttgcacgcatgttggagattagtttgaggactttgtaattaattgggtttcgcgtgattactgttaactttgctatattaaatattaagaaatacattctattatactgaaaaaattcaatggaaaaaccttcttatcaacaccttctagtatttgaattttctaatagttgacatcaaaactttgtactttgataaaatttatattcataaactttctagataaaatattttcattcataaactttatacataaaagaaaacatatctgttgaaaaactttatacgtaaataaaaaaaattagattcagaaattttctacgtagataaaacattttcatttatatactttataaataaaagaaaaaatctattgatgaactttatacctaaataaaaaaattacattcataaactttatacataaataaaaaaaatcatatttatcagttctgacatattcgctggatcggaagttagcgaacgttcgctaactaccagtttggcaaaaggagagagaacagatccaccaagcatatactgtacaatcttgaaagtgatatcactgtgtggtgtgtactggtccatcgtccacatgtagacagcgtgcaactcgagtcttgaatatcgccaaattaacctgcgcttgtgttgatggaggccatgtcgtccacacgaccaaactctccaccgatttcattgtagcctccacatatatagcagtactccgctgcgaatagtgggggagcttttcgcagacttctttcaaaaaaagatattcttttacagaagcttctgggtcaacgcagactggccacagcacagcctatatgagctggaatcttcctgccagttcgtctgagaattacacgcgcacatacagaacaacgcggccaagattacatggaaaaaggttgcacatagggccggtttagttgtcaaaataaattttgcctttacatgtcacattgaatatacgaacacatatttaaaatattaaacgttatttaataacaaaataaattacagattctactagaaaattacgagacaaatttattaagcctaattaatctatcattagcaaatatttactgtagcaccacattatcaaatcatggcgcaattagacttaaaaaattcgtctcgcaatttacacgcaaactgtgtaattggtttttatttttgtctatatttaatactccatgtatgtgtaaatattcgatgtgatggacgaaaattttttgttttgaaaactaaacagtccaatagtacaagctttgctcattagctgtgactacccatgcacaagcttagtaatccctctgtcccacaattactcaaaccctatatttccaaggtggatttaaagagagatatgaatgatcaagatatctctaattaattgtgaagttatatcgatgaataggtaggtaaagggtatgaaagaaataaaatttttagatttgcaaactaatggtaggtaaaagagtaaaagttgatttattttgattttaaattttagaagctgatttattttgggacggagtgagtatatagcatataggaccaccgaaccgcgagacaggcacgtcacgtctccatcgatcgatcgcgcgtcggcgatttgatttagctgcgccttttacatggaaaaggttgcgcatagtgcaagcttagcaatagagatcataacagtgtggctcctgatttagctgcgccttttatatgttctccgtctcgcgcgggcgcatatcgttttcctttgctcgatcggcaacacagtacagcggtgcattattctagctgtttcccccttcctcctgttcggaatgcagctagcagtttggtgcttcacatgctagtatctttgattcctttcgcgtggtcgcgcgtagacataatcattcttaattgatctgatgtacttctctataattttgattaaatttaaagaagcttaatctagaaaaaatcaaagcgcattataatttgaaagggatggatggagtagaatgttaaagtagttttgttccaccaccgttataatatctttatttgttataaccaaattaatagaaaaatattcagtcacaactatgaaatggacctagagacatattgatcgagatggatgaaattgcaagataagagtttttcaggctcaataataatgcaatgtttctttactatatgcatataatctatgcaaaggtcagatgcttaataaaaataatattttctacaaaataaaaataatccaaaagtatttttctgtgacaattaattctataggtcagataatgccacattaaattgtaggactaaaactcttaaatctataataaccagagcagggtgaatagttgcagaaacacctaaatctacatttttcataactaatatttttagaaatttccttgggaagcatatgtaaacgtaagtttagaaatattacttttatatattcataaacaaactgattcatatttaaaattagtgatttgtaatctgcatgcatggaaattaataaatatgtacaaataccattaattttttctactctaaggtcatcttgatataagaaactaattcaactactacaagtccaaaaagtaaataacattccgttcattcagttttcttgacttagtaataattgtgaaggggttgttttttgtaatactccatcaaaatttttcttttaaattttttttttggaatttcaagaaaatgtttaaattcattcaatatctcgtcaaataaaaattttattgagtttttttaaatttggaaatattccattctgttggtccgcaaaaatacctttttttcgcaatttgggaagaaaagtttcgaaatttgcaaatctgttaaaatttagattaatatcattcaatttttcatgttcaattttttgaaattcataaattttccaaaatattttttatttttgaattttgggacaaaaatttactcaaatggagcatgcatgcaacttgtcgtaggggtaaaaacgtcatttgtaaaaattttagatgccaaattgaaatagaaatgttaaattaaattaataatggtcatattgcgttctagcaaattactatatactacaatagaatatgcggcatcagtgtccgtgcgtagtggtgtttggaaaaaactacagcgatttaatttgtttcacacaagctcgtatacatatcgccgtccaggattggcagtatatatgtgaacacgtatcccaagagataaagagaggcggaggtatacgtacgcgccaagccaaataaaatcccgtcaagtcccactccatatacgctcggtcgtttggacgtcgaactatcatatatctccatcgcttttgctattgccagttgacatgccgtcttctccgaacacaccaaacagtcaaacaccgcatacacacgcaagacaacaacatacgttaacgttgtgcctccaatctcccaatcgatcgatcatacattcatactccctatctagctagctagcctagttagctacgtgtgtaccggggagattaatggggatgcatgtaacactcaagaagcaaattagctagggaagatgtgtatctcaaagagtaatagagtggtattatttgcagcacataggctactcgaagctctcagcaattcttagtttcataactactctatatggctgtgttcggcagcctatgttaggaacacattttctgcacacgaaaaacggagtggtccattagcgtgcacgtaattaattaagtattagctattttttttaaaaaaatagatcaatatgattttttaagcagctttcgtataggaactttttttaaaaaaaaacgcaccgtctttagcactgtgaaaagtctgcgagcaaaatacgtgggaggtgagttgggaaaattggaggaaagaacacagcttgtatatgtagttctctgcacgtgtttgtgtctattttacgaaatatcctatagatgcaagtcttcacatgttacatacacataacatgtacattaattaactaacaaatattcacaaaattctaaaaaatatgtatgtatactttcaataaaagaatttgtaatagtattatatccacatatgaaattccatcttcaaattcatcatacatggaaaaaaagacaacattttgacaaatttatagtcttaaaactatcagaattttttttgttgttacagccaaaatataatgaattaatttgtggttagatttatacataggtgtaatactatccatagtatatgcatatatttttttttataattttagataatatttattagttggtatgcacggagtgtgctgtgcacaggatatgttcccaccttactataacaatttacatctgacatagctccatacatattatagtatggtaatttttttggccttttcagtacgatgagtgtagctcaactgattatgttccttgtgatggaacctacccacccaaattcaagttccagacttgatatagatgagtttaagtcctatacttgacacgactgctcgcatctatggctaattagctttttaaggataggcaacttaccatcggtgattttatttgggtgctcgcatttacggctaattaggttttcagtgatagatgacttacccgtgggttcaagttttagacttagacacatgtgtttgtatgtatggctaattatattttcaatgatagacgacttacccattaattgatagtgaggccctattgatgacttcgtcgattttaaaatatgcgacatgatgactttatcaattttaagatataccggttcagtctttagatatgtttataaaaatatccgcgtatttataagcccttggatttgtagtatgttttaaaaaagaaatattttatcaccaacatataggaactggataaatctacgtgcatggtgcatctatgattggtgtagagaggaagactcgtttagcagtgtttgcagtttgcataatgtatagtaaatactcggtgcatatatatgcacgcacacgttttgatagctagtatcttgtagtttagcttctaggaaaaatatcaatatttatgggtggacgactgaaaaatgcttgagttgttctcgctatggtataaagtctgcaggtagcgcgcgtcgtctccagtccagtgaagaaagctcacgcacgcaacacgcacgcacccctagctcatgtgcaagacgagccggcgagctgtatacgtagcagctggactctggagaagcatcagctaagctgtacgtactactgtagttcgatcgatggatgctggtaataacgcatacgctgcggcgatcttcgccatcgtcgtgcttgtcaccgccaccgtctacattttagcggcggcggtgccggcggtgtacgtgctcggcgactcgctggcggacgtggggaacaacaaccacctgctgacgctgctcaaggcggacttaccgcacaacgggatcgactacccgggggggaaggccaccggccgctttagcaacggcaagaactttcccgatttcctcggtgcgttatcgtcgcaaggggcgaataggcggaaatatggtggaagtttgtgtttgaaagggacaaaaaaccacagaagaaggaaggttgtttctgttgcaagaaggggatgatgttgaagaaggaacaaaaatctacaactacaggagggtttantgagaaagcacactggtatttggctattaagcgaactaaagtgttgagatgggacaagtttaaagaaccaattgtgaatgggttattggttagagaagaaataaaaaccnctttaaagaaagctatttttataaaaactttgattgaaagaaaaccccggttttaagagttaatagtattgtccgagctttaaaaaaaaaatcccaact

SEQ ID NO: 6438 - DNA, 11814 bp, Oryza sativa
  unsure (1)..(11814): unsure at all n locations
cgaagggtagggttgacaccaaaagagaaaacttaagattttctcactaaaatatattttaaaataattggaaaagaataaagaaaaggatccttccttgactttcaagtaacaaaaaatcttaagtctatacttgctataaacagtcatcaacccaataccccgtacataagtgtcctctgggtgtttcaagagacaacccctggtagctaagtcccttacaacaacctgtcctggccatccaaccgggggctaaatacgaaggagaaccctccccaggaaattgcacttagaataatatacacatgcagaggacacccatattgagccgtcaccatcagcggccagcttttgaaccactgtatattaccccaattaatggtatctaataaaataagcaccgtgcttatattactaaatactactctacatccttgcaaccgacatagagcatccgaatactcagacactaaacccacaccaatacacctatctggaaagctagttgcatggatatattgattcaagtatgaagtaaagtcggcactcaagtaatatgaatggaatacccccccccccgcgttttctgaatgaatgatagtacaatcctgcaatctgcatgccttcctcatgcgtcacgcgtgcgtgcatccagcctcatggctcatgcatgcatgcaaattcatggcttaattaccattatattgtgcattattgcatttcactggtgaccgatctcattcttctacgcatagtacttagctagtaactattacattcgtccacacaaagtataaggagttcgagatgagttccacacatgcattaaaaattgatggaattaaatgtgataagttgtgtgattggttaagaagaggtgggtagctagggattctagatggtaaaatgttatgattggttgagaatataataattattttagtttgagaagttattatattttatactaacaaattttgaagagttattgtgttcactaccgagctcctaagtcgaagtccataacacaaaagaattgttgcgctagcctaacgcccacgaagtttcagattagtaccaaattaaacaggacaaaagtgtttcttgtattaataataaatatgcttgaaatctaaaaaaatgatttcttataatagtaatcaaccaaattgaatcatattagagacaacgagagcgatagcgcggcgtgacccagacggcgagacgtcgagctgaccgttgcaccagccgcgcacacacaacgaccgattgccctgctgtgacggcctgccgtctcgccctaacaaacacgccgcgccggtctcgcgtagtcacgttgcatttggtcgaatcttctttcacgcctagcttgacttgttttcttgatttttcctgttttgctactcatccgatatactacctccgttttattaaagtacgacgccgttgacttttatcaacgtttgatcattcttttatttaaaacttttatgcaaacataaccaatatttaattcatgcttaaaaacatttgatgatatattaaatcataataaaataaataataattacatattttttaacaagatgaatggtccaacgtatcttactaagtatacattagtaagtatatattatgtgttgactttttattagagaagttaatagcagtgccacatatttaaaaagaaaacacactatatgaccaaccgttcagcagtgcaggctgaccttaattgattaagtttgctgattctactttctccgacacaaatttattcaggtaaccagttagaaatagctatatttttagacggaaggggcaggtagaaatacgtttctataatatctgttagtggcgtaatttgaattttgtatgttaacaattaacagcaccaggtgtgctaccgttgacgtcgtaccaacggtatatagtcaaccttttatcataggctagctgaacacgtactattggcatacgtacttaacaggacgtgcttaaaataaaggcaacaagactactgctactaattaagtcagcatgttgtctaggcaaattcaaccaagaaggtaacgcatagattttaccagttggctctagttggttcggcactaaatatcttctacagagttttattttttctgaaataaaatatcttccatgaactgtcatggtgtgacatgctacttgtattgacataaataaaaatatattttttccatgcactccttttgtttcttattataatcattttgactattttcttagtcaaaattctttatatttgattaaattagttttattaaatttaacatagaatatattttgatacaaagtttatttttattaaaaatattactatatttttctataaatttatctataaatttagtcactaagaaaaaaaattaaacgacttatatcttctattatatactaaaagtccattaaactttctacaaacgctctcaagctgccatgtggcactcctacaaacactcctagatcgctacatggcacagtctaatctcaccgtcgattttcatttaaattggtggacccattattttataccgttagattagatctatacatgccgtcgattttcagttaatatattatatccatatatatatatatataatacctttctctgtactgtttgtcggaggaatagaacgtatgtacgtacataccacaaccaaaataaagcatacatgcttagtacgactatcaaaaaagcaaatatcactctacaatataaagatatattggcccacaaatatatacatgcaattgaatgattttcgatccattattttatccatatatattatcgatttataaattattggacctgttattttttactattaaatatgtaatacctttctcatgtgcataatgtttgccggaagaaaaaaatatatgcacgtacttaccataagccaaaataaaatataaatacttagtaccatcaaaaaaaaccacggtctttaaaatagaactatcaacgatataaagatgaaatatattacttcacaaatatatagatgcaatgttaaactagatctataatataaatatcaaatcaaccatctttaaatgttcatcttttcaaattatttttaaattatatatccaatttgtgatctacaaaacagtactaagtcttcatgtggcgttcctacaaatacttctagaccgccatgtagtactgtataatctcatagtcgattttcatttaaattagcggacccgttattttagactattagattagatgtatatatatactaaccgtgaaaaaaacataagtacatatacaaacgtacgttagattgaaaaagaaataaagcttcggtactactattcgcagcaagaaaaactattatatactaaacgttcattaaactttctattaatattcctaagtcgccatatgacgctgctataagtgctcctaggccatcacatggtactgtataatctcaccatcgattttcatttaaattggtggacccgttatttaccctctaacgtggcatacaaatggccgagttgagtgggcccagtgtgtcataggactctatgaaagggttatagtaaattagacattaaaattgtgcttcgggctgatcttgaggggacacaactacccaattttcaaggtaatagagaaagaaagtctctacggctatgaccggcttcacccgttagtgatatttttagaatatttatatgtggatttggaaataagtgagacataaacacttagctaagtagtgtattaataatatattaggcttattttattatgcgcaatttcatgtattggtagttagcgagcttttaaaatagtgataatgagttgttacgataataggaaaatttatatgtaatcgggacaaagtgtttttaattctgggagacattcttataatttaactatattgaagtctacgatctatctcacgacgtagaaatggtgagatatgacttcttttagcactatttcataaaacaataaataaaaagcccgcgcaccgtgcgggcttccttcctagttataaaataaagggagtaattttattttcttttctaaattcgttgagaaccaatgacaaaatgttgattgatgcacgttggctacttgttgatgattccatacagcttgtaatcaatttctgtacgtgttcatccgacgttgcttgtacgctcaagatatgtttatttccttggttgttatacctataaaaatatatagacacatataaattttaaggttcacgcaatagttggatgtacactataatgaactatagtttgtagtttctccatatattcgtgtgcacttagatttcaacctactaggtgaagccacaccatagtattgccttctctattttgttaattttggtttttggtagctataaatttaggtggagacaaattatattttttaaagataactggagacatattacctaatgaatgataggtcaagcacatcatatgagatatcagatatctagccaaagggtttttccgatatgtccttttcagcctggccataactttttcccccaagaaagtgaaatggaaattgtccgttggcgaagccaatcaattgagaacaaatttggtgtcattctctacttcactttcgtgggtcagattaccatacgtgtacgtccttaattattctacatttgaggatcggatttaggcgatttacctatttgatgttgacaagctggttattattgttctaaaaaatgttgtggttaattaatttggaattttattttatcattctttagtttggctacaacactgttttctttaatttatctcttgcaagcttgctggattgaccttctatgtataggttatgtgccatatggtggagctccaataggctagaggcataagtttctcatgaattagtccataaaagatatgtaagtttcgattttggaaggggacctctacattattgacgagaaaaaaaagaagggtgtgagaggacaactagcaaacagcttttttaaaaaagtcagaaaaacaagaaatatatatatgtgcattagcaattacaattttcaacttgtacatacgtacgttctacacagcttagcccttacatactaaccaccagggttcaaatttttattttggctattttctatcaggtactgaaataatttgaattttaataaaatttggtcacatttaaacaaaatttgccaaattcacaaaaaatggaaaaaagggtggaatagttttggttttgggggggggggggggggaggggggcgatagacccaaaattttgaaaatttcagtccgtaattttgaacctgcttattacatatatagtacgttaatttaatcatgttattacaagcttcccgatccttgtgtatccgatcataaattaatttatcacttggtcatttttgatatgaatggtgcattgcagctgagaaccttgggttggcgacatctccaccgtacctcgccatatcgtcaagcagcagtgctaactacgtgaatggcgtcaactttgcttcaggtggcgccggagttttcaactctacaaacaaggtagttctaattagtttcaactcgtacacgtaattgcaataacaaacttttctcatagattaccaggacgtaggattatatgtatgcatgttagtcgtcaacgcactatatataaagttcattttttttaaaaaaataatacaaatggtttacatatttctgtcgacagtgatatagtcaatttgttttcaacttgttttagagttgaaaattggttttaattacttgtgttaaacattaatgcaggatcagtgcatcagcttcgacaagcagatcgagtactactccaaggtgcaggcgtcgctggtgcagagcctcggcgaggcccaggcggcgagccacctggcgaaatccctcttcgccatcaccatcggcagcaacgacatcatcggctacgtcaggtccagcgccgccgccaaggccaccaaccctatggagcagttcgtcgacgccctcatccagtcgctcaccggccagctacaggtgaggatcgaggtcaccgatcgacagataattaaatcgatcatcaaatgatcaatttcatggtgttacgttctaatggtgttcgatcgattgtgttcagaggctgtacgacctcggggcgcgcagggtgctgttcctggggacggggccggtgggctgctgcccgtcgctgcgggagctgagcgccgacaggggctgcagcggcgaggccaacgacgcgtcggcgcggtacaacgcggcggcggcgtcgctgctgcgcgggatggccgagcggcgcgcgggcctccgctacgcggtgttcgactccagcgcggcgctgctccggtacatcgagcggccggcggcgtacgggttcgcggaggcgcgggcggcgtgctgcggcctcggggacatgaacgccaagatcggctgcaccccggtcagcttctactgcgccaaccggacgggctacgtgttctgggacttctaccacccgaccgaggccaccgcgcggatgctcaccgccgtcgcgttcgacggctcgccgccgctcgtcttccccgtgaacattaggcagctcgctgctatgtaggcttcatctcatcttcacggtgtactgatcgatcgagctgcttgtgagattccacttttttcaagcttcaagtacagccatagaaatatactactatataccatgtaaagtatactagtgtatttacttacgattggtacatatagcggtagaatcatataatatagcaaattcataataagtgattgttgaagttcatcagaaattcacctggaattggggtcggaatcataacaagtgattattgaagattgtcagacagctatagtacttaccaagacgagaagatttgtggtgcagcaatttttctttcagggatactagcgctcaaaacgtggcaggaaaaattcactttagattccgcatagagtaaattgcactagcggtacttaaacttgtaacgatgtttcacttaggtccacgaacttgcaaagcgcacatcgagatccctaaatttgatttattgtatcatcccggtccaaagccgcgtttgaccgtggtcttgcctacttggcacgccacgtagacgatgacatggcacaaattttaattttcctttttttctccccatcttttctctccttcctcacctcgtatggtcggaggggacgcggggcaggagcggcgcgggcgtgctcgggcgccggccgacgggaggagaggagcggcgcgcgtgcgcggccagcggccggcgagaaaggagcggcgcgcgggtgtcggctggcgggaggagagaagccgctgcagcggggcggcagggcgagctcgtgctcaacggtgtaagctcgacggcgacaacggccatgtgagggctactgccggagtggtggggcgaagaggccgaggcgcgcacggggggtggtgtcgccagccgctcccgggggaggggtcgccgaccgcggccgcgcgtgcggggggaggcgtcggcgggcccgagctcgacgacggcagcggggcggtggggcgagctcgagctgggcaacgcgagctcgacggcgacaatggccatgtgggggccaccgccggagtggtgggacgaagaggagggcggcacgtcattcatgcggaagcggctgaggtgcgcgaggggggaggtgtcgccggggcagccaaagcctcgttgacgggagggagggaggacgacggtgattgggggaggacacgccgcgcggcgcctcccagccgcgtgtcccttcctcctttcctcccctcggcgtcgcctcctagctgcgcgtggccaagccactgcgccgcaccaccttcctcctgagctgtgccgcctccctcccgtgcgcgcgcccggccgtgctgccgcgctcagccaccgccccgctgcctcatgccacgcccgccctgggcagcctcctctcccacaccgagctcccctcccttatcccaccgctgcccctctcccggcgctgtgccaagctgcgccgcgccgacacgccgctgtcgcctcagccgcgtcgtcgcgtgccggctgcctcgcacgcgacagcccgcgccgacgccgctgccccgagctcccccgtgccggcctctcccttccatcgccgccgcccgtttccgctcgagccaagacgacgccgccgccgagttttcctctcctctcgatagccgccagctcctctctcctgcaccgccgccaggtcgccgaccccggccacaacctcctcgcaccggtcgtcaaccgcctctccccgcctctctcctgcgccgccgccaggtcgccgaccccgcccacggcctcctcgcaccggtctcgctggctccctctctccctttgcctgccacagatgcatctagaggtggaggaaggagagaaaaaaaaggaaaattaaaatttgtgccatgtcatcgttcatgtggcgtgccacgtaggcaagaccacggtcaaacgcggctttagaccgggatgatacaataaactaagtttagggatttcgatatgcgctttgcaagttcgttgacctaagtgaaacctcgttacaagtttaaggaccgctagtgcaatttactcttccgcatataacggttgagtttggatagtgcccctcatcttctaaaaccactttaaatatatagtcccgccatatgcacactatatttcttctctatggattacatgtacgttgacccacttttttttgttgttgttgttttatcgtataagtttcacatagacgccacattagataaagaacaaatcaatatggcacgttgaaaccgtcttcgttgggactacatttcctctgttcggtaaagataaggattgcgttagtacattgtttcgcggttgagagactcgatcgaaactcaaccttagatgagagaccggcagtgaactttttccaaacgtggttcgtggcccatcaaaattccaggattccagcttatgttgggccttccagatctgcgtcgttgggccatatgggccagcgtgcttgttcgtccaagcacaccgccccacggcccaccgtccgattcacacgtctagtagttccccaggccaagctaccggtgctgccggcggcggcggcggcggcgggcgccggaagcacgaacggcgaacggctaaggcacctgcctctcgggactcggggaccagcggcagaatcttctccgggcggcccttttctcttgccccagtggcctctgctgcaaactccgcacaaatgccgcgccccgctgagcctcccagttctcgccgccggcgatatgtgtaggtaaaattatttagaatgagttaattttttttggttatgcgcaaatccacaattaatctacatttgagctaactagttgctccatagtttctttgctgagctggagattggatgcagtattgttgccattcagatctcttggtcgagtttgaacctagaactgggcctataaggctataatttgttactgcagctattatacttctatacgttatatgcatttcaggtttgtgactagcctgattcaatccaaagccttgactttaactatctttttttttaaagaatacgtagaaggtttgcatgccatttcttatagcgataagagaaaaggaaccaggctgctatgagtgtccaaatagtaccaattacaccactcaggaaccactacacataatgcagctgttttctccgcaaaaggtaaataatagttggttgtttaattcacacaatcacaccacatgacccatgagagacggtaaaatatatatgtagctaatatggtatgagctcctcacctgtaaagcatgacgttgattaggtgattattacttataggttgcagtgttctttctaatttttataccaaattaagctatctattcatcctcttcgctactgtcatcactgccgtactgaatttcctcatcttctgactgctcatggtcttgctcatcgttgtcctctccattgtcatcttcgtacaaaagcccaaactcctctctgtgctcgtcctcacttgcatcattcaattcattcagagcttgttgctcttcataccaagcatctttagactcatgtaactgagagaagggacattaattattataaataaaaaattcagaaaaaggaactaagaaaataaacagtggtcctagtactgcaaatgcactaataaaacttaaagcataaagtatttgtacgtagatggtgatagagatctatacctggcattgctggtgcgaaatttggacttccaaccagtctgctagcaatgggcactttgtgatggtaagtcgctgaagctgtgttgacagtggtttatcagatggtagctgcagataaggacatctatgtatcttcaaaaatttgagtgacccaaggctgctaagacccattatagagtgaagacgtgggcaaacactgataaccaagacttcgagcaatgggtgattctgattgtcaagtaaaaggtgctcgatgctccgtgacagtaacactttcagtgatctgagatgcggaaagtgcaaatcattcagaatttgttcatttatcttgctcttcaagaccaaagtagtgaggtttggaatagctggtagactagcaagtttgctgcaatccttgataactaactttgtgagggaggaagatagctcctgtgggaggtacctcaactcgtggctatccttgatttttagcaggcggagtgaaggaaagtcatcctgaccaacttgagaccactcaacccatttcaacatttcttgaaactccagctcctcaacagctgggaatgcctttgtggtgatgtttccacggaactcctgtcgcacatgctccacatctgtcatgcactccatagagagtatgcggaggcgtggcaattccccaagtggaggaaggaacttgcagctttgctgacataggattatctttgccaagtgcatgaaggtagaagccccaaaccagctaggatatttgtatccactataattgactacctccaattcttcgatgttcttgtgcggccgtaggctctcaaagatctcttcctcatgctctgggtctggggtagccacatcattttggctgctaggatgactgcagttgttggggcaaacaccatcagaccagtctaatctcaggatttgcaattggttcttactgactaaattagctgtctgagcatcatcaacatttataaccctccgtagtcctgtaatacataactctccatgtatgttcaccagatggtgtagctcggcaacattggaatgccaacctccgcttccaatgctaaaccttggcaatgtctgtagcctttttagcccacctatcccacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgaactacgtgcagtacaaacggaatctaaannnccg

SEQ ID NO: 6439 - DNA, 772 bp, Oryza sativa
gtggaaaattgaggttgattcgcgctttactgcaagtagttcatcattcgagaaatagcgagcgagtagaattatctcttgaacaccaatggaagttgcggtgtgagagattgctacgtactggttcgagaaccagcgagcgagtagaattatctctcgaacaccaatggaagttgcggtgtgagagattgctacgtactggttcgagagccagcgagcgagtagaattatctctcgaacaccaatggaagtttccggtgcgagagattgctacgtactggttcgagagccagtgagcgagtagaattatctctcgaacaccaatggaagtttcggtgctagagattgctacgtactggttcgagaactagtgagcgagtagaattatctctcgaacaccaatggaagtttcggtgcgagagattgctacgtactggttcgagaactagtgagcaagtagaattatctctcgaacaccaatggaaattgcggtgcgagagattgctacgtactggttcgagagccagcgagcgagtagaattatctctcgaacaccaatggaagtttgcggtgcgagagattgctacgtactggttcgagaaccagtgagtgagtagaattatctctcgaacaccaatggaagtttcggtgcgagagattgctacgtattggttcgagaaccagggagcaagtagaattatctctcgaacaccaatgaaaattgtggtgcgagagattgctatgtactggttcgagagcccacgagtgagtt

SEQ ID NO: 6440 - DNA, 824 bp, Oryza sativa
  unsure (1)..(824): unsure at all n locations
natgtagagtagtatttagtcatataagcacggtgcttagttcattagataccatcatttggggtaatatacagtggttctcaggatcattagttttggtcacaagtccgtctggcaatcctacatacgccaagacaattcgcaggatatcgtctttagggataagctcggctagtccctcacggtgtctccggatactgcaagagaaccggaaagtgctatctctgatctcgccgggcacggattcgaggaggaagactaccctgttgtcgactacgagtcagaactttagacagccatgtcgacaacagttagataggctaccccaaatattgtactggtgtgattatggtaaataaagagcaacgaccggcttcggccaacagggtgtagggttattacctgacaattcaggggcccgaacctgtataaaaatctctatctctatctcttttacctcagtcttgcgtatatcctagtaccaacgatccccatactatgcaaataccagaactgcgacatcaaacatcgacagtggcgcgccccccccaaaaaaagggttttaaagggcggaaaaggggaatnttttgggtgcttcaggattttgaagagatgggttcaagagatgaattctccaacaataaactactcgacgacttcactgtggggaagatcaaatccgaccggagtatgtcttccgacgagatcgaaattatcgccgtcgtggaggacgaacgatactggcagcattggtgaccgatccaatatgggactgttctggaagctgacggtgatgaactactgtaccatcaagaaagcatcac

SEQ ID NO: 6441 - DNA, 1353 bp, Oryza sativa
  unsure (1)..(1353): unsure at all n locations
ctgggntttgactgccttgcgcctacnagatggtacagtagttcatcatgcattcgtggactggacagaccgagtaaatttgggcaaattttggggttttaggttggtagctggtggtatgtgaggaattcgtacaatgcgtttggaattagtgactaggtgcaatataggcaaaatctaccgattacaaatgcgaatatctgataggaatgttgtgtaagcgtgtggctaatgcctaatgttctggtattttctttgcgtcgtcgatgaccgtgatgactgatgacacataattgcatgaagtttgttttttaaatcatttgttactttcagggctaccggtgagacgcccaaagcttttggcatcctagaagatattgtacaacacacgctgtgtagtttgcatggtattcagaaaagcttactcttttggcagtccaaagctgaggtctcaagttaattcataaatcttttattttttttacgctgcaattaattaaaagagtgcatcttatacttcatgctatttacctatttttggttctgttatatttattcagggaacaaattcacagaaaatgtattttatgatctttgaaaggggaccaagggcctttgttaaagcaacatatcagacattgactagactaaggagcaatgagagtccaacccagtacattttgcactctgcatctgatatggtctcaacaaaacttgctgtcctgacaaacatgcaacactgcttggctgcttttcttgctaaggtttgtttagtcagatgtttatcattacaaatgcttatgtctagtagaataaaactcgtgtcagcagttctttcaaagctaactttgtagttgctcgcttccaaaaattgctgtactactctagtcagatcattcaaacccaattttctaactctttgataacattgtttgttttacatgacacagttccacatttataaatccaaatcataccttgcttgttctataggtttattgcgaagttgacaaattcaaagaaggattaactgaaaattcagataaatcgcttcacacactgtttgctgttttgaatactgtcttctccaaattggaggtatcactccaaaatgtttgtgaggtatgcattgtttgcttttcttgcatttggatgttatatgtataatatacttttgtgtttggcattatgtaatatattttcttcaggggcatactctactgttcgcactcgatggaagcccatctgaacttctctttgaaagattaccagaaattgattatgataactcagagtggacatgatgaactacttgcagtcgangcggaatccaaaagccaatcaaagccctct

SEQ ID NO: 6442 - DNA, 684 bp, Oryza sativa
cgatgtgaatacactacccatggtacagagcacattattttcaccgcgctaactctctactcatgccaacggaaatcaaatacagcctctacagttcatgaaacaacgtttttatcctcataaaaaaaactgattaatggggacaaattaatgctataatctgaaaatctccacaacgcataaattaaactctatcctgtttaggagtccatctgacaacaaaaccgccacctaaatttcaaatcgtaaaacacaccttttaaattttggttttccatatatgctcaaaaatacatcaaaccttggggatgctctactagctaaagtaagtaatcatgaatctcggctcttaattcgctatagctagcacacacatagctagagagatcacgaacataatcacatgccaacaaacccaagtgaaaaagatctcacgaacataaaaactggattgccaacccagagatcgagagaattaatttgccccccggaatataatcgacacgggattttgtttccttactatagccgcatgcatatctcgacagtatccatggcggcgcccccccctgccgaatttgggatcccgttcgttcgttcgcaggagacaacaagaagttaatgacggaaatgcaagctcaccacacgcgtatctgatcattcatgtttgccgatcaatgccga

SEQ ID NO: 6443 - DNA, 718 bp, Oryza sativa
  unsure (1)..(718): unsure at all n locations
cggcccttggttgcatttcacgtagtagnncatcactatggagcgcaataccctactcctgagtgtgggatttatggttgaatgttacaagggttcctcaactccggagaacgttcttgctcttcgcttcctggagtgtaggcctactgagtgtcgtcctcttttacggaggcgaaggtcctgcttttatagtccaaggggataccacatgtgctgcttctacctcttctctcacgggagaggaaccctccttaccttgatcggaccacgatccgtgccttcgcccggaagctaagcagcagtccgtccttgagtgggacccggcgccgccccccgcctgacacgggggacagccctgtcattccctcttaaatgagcgaaggcttgtggcggtcctcctcacgtggagggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6444 - DNA, 984 bp, Oryza sativa
  unsure (1)..(984): unsure at all n locations
cggncattgttagctcgcgttctactgcaagtagttcatcactcctgacagtatccggagacaccgtaggggactagccgtgcttatccctaaagtcgatatccggcgtcttgtcttggcgtatgttggcttgtatgttgatcttgtgtctagatctattgttccgtacggtgatgagtggcgcgattgtccgtgtcccctctccttcctaagggggcccttgggtatttataccccataaggtgttccctttggtccaaagtagatactaggaaaagcaatatggatacaatccgagtagtccttgtcgtttccatgtagaactctggttgtctttccttatccggaactccctccatatccgaagtcagtttccgtataagacgtggtatgtggtgggtcctgccgagatttagttgactactattaggtatgtggtatccataaccatgacaaatacactaagtgaggccagttgttctaaaaaaagtgaggccagttataggtatatttgttggcaactttttgtgccaagtcgacaagcatgatcgcaacacctaaacgccttgcggtgatatggagtcgccaaccacctcgatctagccaaagggccaaatcaagatggatttcgtagaaaaacagctaaaccggctaacggagccgatttagagatcaaaatcagcctctaggccgatttagatcgataagaggataactacccgtctcgtgggcaaaacgggacaaacctacaaaagagtgtcgcactctcgtagcgacggcggacgatttacggcgcaaaccgacaaagatggactaaactagggtaaaataagaaaacatggtaaaagaaacgatcaagtatattgtattgggggttttacagtgaaccgggcttggtcctttaataagggttaggctttccctttacaaggccttcttcacgcccaacttgggattagaaactcaaggaaacatcaaacatgt

SEQ ID NO: 6445 - DNA, 725 bp, Oryza sativa
cgagcagcccatgcacctactattggtacagtagttcatcaactctattcatggatccactagtatgaagataggtagatgcttcgctgattaattaggcgacattaggtggtcccataactctagactttgggaatattcatatcacttggacattatcgaatggttagatcatggtgggaatggatgcacacctacccctctattcaaaaccctcaaaatggttttaggctgggctcggcgtgcatgggattgttcatagctccttggccacctaaagacctgtcttcgaacctctgatgcaaagcactacctgacttgcacatgactagtgggttaggcttagtttgaggctcaggctgagtataacacaaaaaggcacggatggagatggatgaagccatgggtcgatggacatctgtaggacaaaatgaaggctacacaggcttctgaccggtataccagatgtcatggcacatggctgacgcgctgctgctatgagctcactaatgactgactgtctaggggttccggacgtaagtaccgtgcgtcagtactctcgtctatggctacgatgggctcgagactatggcatgtcttacgtacatatgccaaggagctatgtcacacgtggatgcacgtgaggaagacatggcttgagaggtaagacgtacaccattgaacagagtgtaacctattggaatagccgctctctctgtaatggg

SEQ ID NO: 6446 - DNA, 1862 bp, Oryza sativa
  unsure (1)..(1862): unsure at all n locations
acggccctttggattgcacctgtantatcacgtaagtgcctatgagttatctggctgaaacggcacctgcatttactgcttgagaataaagtttgagtgccagttgctgagttaaaataaccacgcaaaacaatgcacaacccacagatcagatctcgtgaattgctttctctggctgctagaattggcactttccagtggatcttacgttttcctgaattaaatgcatagctccctgtcacttgccgtttggttcatggtcactctttgccacacctcaacttaggtagctttggccgagatagttcattgtcacgcttgtggcaagatttttttttaagcaccttggtcccacatggcattgttcaccatattggggtgtgccaaatttgttcgtctaaccttagacaagcttggcaagaaaactatggcaaccctaggcaatgttataatacaaaccaaacaacgaatgtcaggctatcatgattctgtggtatgtatttttgtaatctttacatgttttcccttgtttttttcaacagaagaaaaggggcagtcgcaaacacggcacaggagctcagtcttgtcttccaggaagttatgtagttgactgaccacacactgtcatacatacacaactgaatgggaaatgcattcccgctgatggcaccaatgttgggcatcagttgccatggagagctgttcgttcgtgcccagtcaccgagctccaaggcacagcagcagtggataacattttgttgccactgtttgttcctcttgtacacacactaaccaacagtgctcgagatccttgtctgttgtcacttttgaagggaagctgccatgagcggtgacatctgccggcagcgttcttcgcgtttgtctcattggtttctgaagataccagtttgcccttgatagatgtggatgaccgtgagatggagcgaatgtcagcgattgtaatgccttgctggctgtagcctcttctctcgtgtcttgtgttagcgggttgcatttgatagtttattgtttggttgtgatgtctggtcgattcaatgacaagattgatgaagagtgattgagctccttgtacacctgtacatcagttttcttttgaatagtatttgagatctatactcttgatcgacacctttgttactcgttggcttgtcacgtccctacaacagctaatgtctgagttttgatgaaacatttctttgcttgtaagtgagatatgccctttggagtattatctggagggtcatgaacatttcattgttaagcttcatcttctgggtaaaaacacaactgtaccttcaattttttttcagggtacagaacagtaaactcctgaataattctgctcacattcacaaaatcaaacaaaccaacatacaatctcattaaactcgtaaccacatttcacacgacaaaggacctaccatgcaacatcaaaaacaccatataattaagaagactagaacaacaacaaacattgggcctaaacaaattaattcgacgacatatatgagatgagaggcactcatgcaagtgcagcatgcccctgcttattcccttctttaccaagcaggcaaaacaagctaattaccatgatcaaggctactacgaaaccgaaggattcgatggatgaatcgaatcgcggcaagaacgagctagccgcaggtggggatgcaggacttggagcacttggcggagcacttggtgtgcgccgacatggtgcaggtcttgccgcacatgagcctcttcttgtggcactcctccttggtcacgcagctctccgacttatggggatcctctagagtcgacatgcgggcatgcaagatgagtttctcaatgcgtcg

SEQ ID NO: 6447 - DNA, 6186 bp, Oryza sativa
  unsure (1)..(6186): unsure at all n locations
agaaaattatattaatgtggtgagggttttttataataaaagaaataatatgagtggtttaatttgttttttggagaaaatatgaattgaaggagaggggtaaattttttattttttagaatggttatggtataagaaggatatttagagaaggaaaagagggtatggaaataggtttttttgaagataaggagaaaggaagggaaaacataagggagggaaaaggagatgaggnnggnnnaannggnggnnnnngnggcgccaactcctcctccacattgtgcagcagctggtgggcgtcggtgtcggtgtcggcgtcggagtctgccaggaggatccgctcgttgtgcgtcgcctcctcgtgcgcgggctcctccgccgccgtggtggcggcgctggccgtgacgacggcgagcatgaggaggagcactgacactaccgcgaagctggagctgcaggagcgagacgacgacatggctgcctttattgactacgtttccttcttcgcgccttgggtggtgtggctgcgagaagctggggttgctgctcctatccgtgtttatagctagagctcagcatgctgcgttgctcgataaatagcgatgagatcgatagctagcttagctgcatgagcgtgcatggcgtggcgcaactaaccgagaatacttcggtgaggagcgggagatgcatgccgctagatgggaatggtggcaattggcgattttgaaatacaccgttgcctcatctttttttcatcattacactcctttttcacactgtaaaaaaaaatcggtgttgtggtgttaaggccactccccgcgactttggtacattttcataaatccttcgaaaaacagtaatccattcatttcacaatgtaagtcattttagcgttttccacatttatatttatgttaatgaatctagacatacatcaatatgaatgtgggaaatgatagaatgaattacattgtgaaattgtgaaacagaggaagtatatacatttaaaaaaatatgaaaggaacaatatagttttaaaatttaatctagcaactgctaagcaagaaaattcccatgaaaaactgcatgggctttactggcagctgctactgttaatctgaataagttactcacaatatactgcatctatctatctactcaaacgagatcaaccaaaggataacattattggtgccttttcagttaacatggactcacctaaatatttgcggtgttaatagagttgccaactaacttaatctagaaaagctcgtgacgaagatgggtttagaaaaaaaatcaaaaccgattaggcggagccaatttaaagaacaaaccagtcttaagaccgatttaaaatcaatttagagataactacatgttttatgggctaatcaaaaagtttacgggacaaccctagaaaaatatcacactcttgcagcaatgacattcttgtcccatcaaccaaaaggagtctgtcagcgcgattgtctttggacaacaattgtctaccctcatttgttatgtttttttttttcttttcgctgtctctttataagttatatcaagacatttgagtatgtaactaaatctcttctttttataaagttaatgtccactaaacacttaatgtccatcattagcaaatatttactgtggcaccacattgtcatatcatgacgcaattaggtttaaaagattcgtctcgcaatttacacgtaaactatgtaatttatttttttcgtatatatttaatactccgtacatgtgtttaaacgttcgatgtgacgggaaaaaaaaatttgccggtggatttaaacacccccttaatggcgatgccacagtactcgagtcctttgcgggggttatattttcttggctactccaattagcttgcagatctggttggatttttttttatttggagctagcttaatttagtcggtattgcgagggtaatgttgaatgtttttttttcttaagggacacatcatgtctgatattgcggttaggggtaaattttagacttgacgataaattaagggatctaaaatgagcttattcctctctaaaaagcccatccacttaagaggggaaaagtatagcccattactactttgcgcggctgatggcggatggagggagccgcaactgaccgtggtcaaactgtccaaggcacctttggctttttctttagctttaggaattcacccagcttagcttgctttaatgttgtagtataagctatgcatgcgatttgctagtttagattaaatccactatcacaacgagaaaatcaaatactcctttagttttggcttcaataaacatgccacgggtattgacctggcctaacctaccatgtaaagaactccctccgtcccaaaaaaaagtcaaaccctaagtttccgtgtccaattttgactgtccgtcttatataatttttttttataattcgtatttttattattgttagatgataaaatataattaatattttatacgtgacttgtctttttaattttttttataatttttttaaataaaacagacggtcaaacgttgggcacggaaaccagagtttgtctttttttttttggacggagggagtatgtactacctgcttctgttttgctgtaaaattattttattttcttcgatgttgttgtcaaggtcgacggtgactgttccaattctagaaccatgcctacgaaacaaaaatgatcgtcaaacggattgagaaattccaaactcaacagaaccttttcctcttgtaacaaaggactaaagaagtttcttctctggtaataaaagactaaagaagaagaaaagaggacaaaagaaagttccattcttgattctttcatgcgcttattttctcatcaattaagcaagccaattgtgaactgtctcgcggaagaaaccatttgttatacaaaatttacatattttttcttttttattaaagaggtttctgataagttgacttcggtgcaggatgatcaatggacgcaaccacgtctgcccatcgcgtgtacgtacactgttggtcaatcgtcacaagagaattcgaactgcagattctttctaaattttttttggcaaaacaaaacaaattaatgttttggccgtgtttagttgttttggaaaaaaaattatcatatacatacacacatttgaagtattaaacgtagactaataacaaaactaattacagaatccgtcagtaaatcgcgagacgaatttattaagtctaattaatctgttattaaaaaatgtttactgtaacatcacattatcaaatcatggcgtaattaggctcaaaagattcatctcgtaatttacatgtaaattgttttttcgtccacatttaatacttatacatgtgtgcaaatgatgtgaaggaaaaattaaaagtttaaagggaactaaacacagcaaaaataacaaaatgatggaggaatagaagcagagttgtggagatgtagagagaaaggaaaacggaagaggagaaagaccaggcagccagctagcagatggatcgctggaccgacgaatgggaaacagagggtgaggtcgcggtttttgacgcggacgtcgctggttttgccggatgctggcgccgccctgattgcccaccgccccatcgccgttcgctggtatatgccgttgtcttggaatcatctcctcgagatgtcaaactcaccccaagattagcacgcccacacactttacccaaccaactccattcagtgcgattttggccagtaattagccacactgcatattagccacgacaccacaagtttcaaattataaaccttaaagttgtgttaagttcatgttaaaattaaaaatttaattgaaattaaaatgatacgacagaaaagttaaaagtttatgtacgtaggaaagttttgatgtgataaaaaaatttagaaatttgaaaaaaaaattgagaactaaaccagtcccaaatcaaacagtcctactagttgcattttgtaacttcttccccaagaagatcagtggggatgatttccatgtggagaaatggagacagtgaggcaggcactgaatcgcctcacctcgaccctctgcccctcaactcggtggtgaccacgcgtccacatctctcatctttctttctccgctattctcctccagtcctcttctcttcttcctccctcccttcgcccactgaatcgccaaaaaaattcccctcctccactccatctctataaaaatcctcccccaaatctcgcctcgtttagccagcacaactcacacaactctctctctctctctctctctctctctctcgtggtctgcaagcttccgcctcccggatcgcggcgaccaccggaggaggagggagcagccatgccgaacatcgacatggggaagatcctggcggggctggagaacgacgacgcgcgggtgcccaagaccaagctggtctgcacgctcggcccgggctcccgctccgtccccatgctcgagaagctgctccgcgccgggatgaacgtcgcgcgctttaacttctcccacggcacccacgagtaccaccaggagaccctcgacaacctccgccaggccatgcacaacaccggcgtcctctgcgccgtcatgctcgataccaaggttaccccctcactgctttgcttgtcgatctctacatgcttgtatgctgctgggttgttcggatcggaccagtcggggtagcttgcgtttgatacagagcggatttcgatttggatctgctcgtcttttttatcgggagaagctgggtttgatttggaggcagcatggtaggattatgagttgagtttacagcggtttgactttggaggactcgacaaaatggtatccggggttagatttgcctgcgcttgcgcttttgccttgtcgcagatggctggatcttggattgggggctcaggcttgcgtctccatgtgggtagttagttttggagtcttatggattctgagcaagtgtaagtgtgtaactggttcgtagtgtgatccgtttgcggtgttggtgagattgatgagctgcgtgcatcttgtttgtcatatttagctttacagttcgtctctatgctttttcaagttaatttattcatttgtagagttggattggaaggatggttaacagatcttgggatcggtggctttggagtatggagtgttcaaatcctagtgttctgattttgttgcttttgtaggaggatatgattaacacgtaaaagaaggctttattagtgtagtcatttcttctattatgccttgatgtttctggcatgcacgtaactattggtgcttatctttttacactctcacacttcatggtttgctttgtagttcaaataagttacttacagaattgtactgcacacagattatcttttttatcacttcttgtactgcaattagttccattatttttacctgtttagtagcatatttaaggcgattctgtggtgactgttctgaacatttcattcattgcttcagggtcctgagattcgtactggatttttgaaggatggcaagccaatcaagctaacaaagggtcaagaactcactgttaccaccgattatgagatcaagggtgatgagaacatgattaccatgagttacaagaaactgccagttgatgtgaagcctggaaatgtcattctctgcgccgatggtacaatctctttgactgttttgtcctgtgatccaaaggctggaactgtgaggtgtaggtgtgagaacacagcaatgcttggcgagagaaagaattgcaatctgccaggaattgttgtggaccttcctacactgactgagaaggataaagaagacattttgggatggggtgtgccaaatgacatagacatgattgctctgtcgtttgtccgtaaaggatcagatttggttaccgtcagacaacttcttggacagcatgcaaagcgcatcaagctgatgtcaaaggtttgtaatcattatcactattttttgggtcctgttaggttttcagttccacagtttgcttaagtatttaattaccaggacggttgagtgacaatacttctcagttagatgctttaattaatgttttgttgtccctttctggtatatactggagccagaattgtttggtctctgcctttgtacattagggtgcacgcaggcacacac

SEQ ID NO: 6448 - DNA, 1377 bp, Oryza sativa
  unsure (1)..(1377): unsure at all n locations
gtggcctttgatgtctactctcnnnnnnnnnnnnnnnnnnnnnnnnnnnnnnnnatcttggaatggagattccagttgagaagatattccttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgtcatgcttagtggagagagtgctgctggagcataccctgaagtagctgtgaagatcatggcacgtatatgtgttgaggcagagtcttcccttgacaacgaagctgtcttcaaggagatgatcaggtctgcgccccttccgatgagcccattggagtctctcgcatcctctgctgtacgcacagccaacaaggccaaggcagccctgattgttgtcttgactcgtggtggtaccacggcaaagctggttgccaagtatcgtcccagggttccaatcctctctgtggttgtccccgtgttgacaaccgattcattcgactggacaatcagctcggagggcccagcaaggcacagcctaatctacagaggtcttgttcctctcctggctgagggttctgccaaagccaccgattcggagtcgacagaggtcatccttgatgctgctctcaagtcagctgtacagaagcagttgtgcaagcctggtgatgctgttgttgctctgcaccgtattggcgtcgcatccgtgatcaagatctgcatcgtgaagtaatcgctacacggtgtcttcttagcgccattttgctgggttaagtggcaaaacaaaaactgctatgcttgtttttactcccatagtccatctttgggagacaatttaattaccgtatcagcccctgcagttcgcagggtgcctttcgttacatagatttgctggtaaaatgaggagagatagaactccattatgtagagctctatttatcgtcgatgccatgtagtatggcaggtggtttctattccatgcctgcacaattttctggtagctactgtgttgtttgattactgttttttcaggtgatgtcgatggagttgataataatattggcatcattgtcgttgtatacgagttaaaaaagaatgtcccaggattcatcaggaatctggtgtgcccatatggccatatggatttttgtcttgtttaagattccggtgaccggggtacgaaatcttggttggtaatcggcggcctgagccgtttaacggtatactaattgcatgaactatgtattctgcaacgttatttgtggtaatacaggatatgttccacaaatgtgggtccaacgaaatcaacataggcgtcc

SEQ ID NO: 6449 - DNA, 9202 bp, Oryza sativa
  unsure (1)..(9202): unsure at all n locations
gcgtgnatgaaaccacttggatgactaccccttaattaaactaataataacgtttacaatccgataattcgagagggcaaacagcacagggaggagtggctgggtggacggccgagtccgtcggagacgaaggaaagaaggaaaaaaaaacccgcgcgcgcctaactgtccgcgaaaagggcaaggcggaacgcatgcatcgcattgcgtcgcagagcatccgtcaaaagcacggcacgtctccaacaaatctcgcttgccttaaacgggcggcgtgacggggacacactgccgacgatcgaacgaacgaacgaacgatgcgtccctcctggtgctccgtcgtcgccaccccagatgggtctccttgaggacctcctcctcgccccgcgcgtcgacggcggtggcggcggcgacggcgaggccatggcggcgcccgactacgccatccctcccctttccccaaccgccgccttcgtcgtccaccgatgcgcccggtatgatctccctcatctcctcctcgtcgtatggattaatgtccaatttgatttaattgatcgattcctgatcgatcgcggcgagaaacgtcaacctgggttcgaaacctcacctcttctgattatttgatattaggtcgttatttcttaatattcgtgtatttttttatcgatcgtggctgcaggatcgccggcgtggaggtggagcagctgctgcggcggttcgagccggagaagggggaccagccgctggcgtacgccaggagcgtcgtggagtactgctcctacattgccctgcgcgtcgagaccaagcgccatgactacctcagcgacagcgagttccactcgctcacctacgacatgatgatcgcctgggaagcccccgacgacgagacggacgccgcgttgcaggtgatgacaccccggttttctttttttttttcacccccaattcaacatcaccatcttgtttgttgttcatacgcaactctgatcagaaaccgatacgctataacagaaaatgtcatttagcttcgttgacggcaaggatgacgacgattgtgggtccatgttctgtttgagccccacacaaatggccattcaggttatatatatatctctgtcaatttgacatattttgtggtttctcaagtatcaatccaaacatttgatgaaatatttaggttgatgggaggagaacggtcagtcctgaagcatttgccaagattattcctgcgtgtcctgcaatggcacacgcgatcactgttcgcaacttatttgatgcgctcacaaactctacgggaggccgcctgcattttctcatctaccataagtacctcaaatgtttagacaagtatgcattggcaccagcttctcttgtttctcttcattgttacagttattgtcattctctgaaacctgaacaatgagcattactgaatattcaggcactcggttactttcactgcatgattgccttactatggcgcctctggtttctgatgttagggtgctgagatttgcgaaacgtatatcaggtggacacaaagctccagctcttcaactttctgatggagaagtgatccttgatatctatggtgccgcgacaaccaagccgattcttcaacacattgggacgtccacttggcctggttaagaatcctccctatggtaattttgatcagtgttggtgaattgtttccttcactatggccttaaggtgtataaggtgcatattttgcagggaggctcacactgacaacccatgctttgtactttgagccagtcagtgttgatttctcatacaacgaggctgtggtgtatgatctgtcaagggacttgaagcagtctataaaacgtgaatcaactggcccatggggtgctcagctatttgacaaagctgtcatgtacaaatctagctctacgtgagtaattactactgtagaataaaattttttttaagtttctgctcatcttgtagctttgctcatacaattttactttgacagaagagagccggtgttcttcgaatttcctcaattcaaaggtcacactcgtcgagactactggtttgcaatcatcaaagaggtgttgcacgctcacaagttcattaggaagtacaggatgatcaatttacataaggccgaggcgctttctgttgcgacactaggaattctcagataccgcacggtgaaggagggattccacatactgcctgcacatttcaagactacccttgccttcaatttggcagagaaattgcccaagggggacaagatactggaagcattgtatggtcagatgaaagattattcctcaaggttcagagtagatgaagattctgttcaaagcagttcagatgatctgacgcttgctgatcctttcccactttctgcatatactttggtgaacatgggtttgttgacactcaaagaggaggacaatcccgaggaatgggatctcactgtccgagatgtgcagacgggaggaactagctcagtgcaaatggctctagagagatctgtaggttactctggcagagtggaggctgcgagggcgacccttgatcaggtcaaagtggaagacatcgacactaatgtggctgtcctgaaggtactaaatgtcattttctcataatcttctaaactaagatatgaattcagataggaaaagtcttgagttctggaacaaccactgagctctgagtgacctgtacaggcatacctaagcctgaatttccattcatagttttagattgctcaataattgtagactgatagttgcttccaatgtcatcaagattgatcacaattcaagccattattaagtgtattaatgtttgttgatttactgttaatatgcagaaactgctatttccgttaattaaaataggcaaaaggcttctctttttggctgagtgggaagatccacttaaatcatacgtcttcttgttctgtttcctcttcatagtttaaaggtaatatctgaaatcacctctcttttttttttggctaaaacgaactgaaatacttctaccagtagttaaaaaattttgtttcacggagcaatgttaatacctattccatactaaaccctgcagaggctggatttggtacattttccctgtctttctgcttggttctaccatcttcatgctatggcaaaggcataccgggaacgggcagatgataggcgcatttgaagtcacaactccacctaggagacgaactgtagaacagctactggcgctgcaacaagctatctcgcaattagaggcacaagtgcaagccggaaacatttttcttctcaagctccgatccctcctgcttgcagcgttccctcaagtacgttacttcttctcacattatcactcacaactacgaattactttgtaaaccatcacatcaaaactctaaatcttgcaacattctgcaattactatataacaattgttattgtctggtcagagcacgaacaaagtagcagctacaatgctcgtggcatctgcgatattcgcgtacctgcccttgagaagcatacttgtactgattgtgctggaagcatacacgaggcatatgccggcgaggaagaagagcagcgagaagttggtgaggagactgagagagtggtggctgcgaatcccagctgctcctgtacagctcttgaggcctcaggataccaggagatggacatcgaggttgagatcgagatgacccacatcggaaatgtcggtactttacacatgtattatatgtacctgtaaattcatcatgttgttagaaatgttgatatatacgatcagatttttgtgttgaaatggaaagtacatattgtgcaaaatggaattgtgggtggatcgtattttgtattgtgaatttttgttgaaagctgcactgaaggaatttggctgtctatcctatgcagtagctactatgcatttatttgaaaatcaaactgatcattagctggtatctgactgaagtcagagtgagaggccacaaaccaagacttgccttgttgaattcacacttctgtctgggctgctaatggattaaattttagtcgctgtcatatcggatgtttgacactaattagaagtattaaacgcagataaataataaaactaattgcataaatgagagctaattcgcgagataaattttttaaacctaattaatccataataaaacatccgatctgacagggactaattagtctctagattcaaacactacctaagcgccccgtttgagttaactttaagatagagaagtacgggtatgtaaaacgacaaagatattagtaacggtttgagctattcacatgccatctaattagataaggtgtcccagatttttctaatgtatttgcattccaccaggaaatggaatgacattttagtgtatgacggcaaagcgggcaatatgcattgtttggctatccatggactgccataaaatatattcttgttagctataaagtacttaatcacatccactcacgcaatttggtgtatccatgatgcaatttatctactccctccatcctaaaatgtttgacgccgttaacttttttaaaaatgtttgaccgttcgtcttattcaaaaaatttaagcaattattaattctttttctatcatttgatttattgttaaatatacttttatgtatacatatagttttacacatttcacaaaagtttttgaataagacgaacggtcaaatatgtttaaaaaagtcaacagtgtcaaacatttagtaaaggagggaatattatgtattgaactagttatatttatagtttgactaattgtttattaaaaatcataacaaagatccggttttaaaaaacaaaacatcctataaaaatcatcagaggaaggaccatgtagcttgcaagcttcagtagcagcaacacatatgtttttggttccattaaaaaaaaaacacatatgtttttggagaggcttgagttacataggttaggtagtagctagcgtgtcacaccaatttgtttttatatatatgctactagatgtgcacacgttgatattccatttgagttttgttaacacggagtttgttgggcttgtcgtgtaaatacaaaatacggaaggaccgtcggcaaccgttgatcacgtcatgcctgaagatccccaaattgatgcagtagcctctctgaattttcaacacgacaagcagccgtccggtcagctgcagcgtggttaattattcagagattagagaggcgtcttccaggcaattattcaacctatttctcctgacgaacttgctctttgctaacctgaagcttcgtgatcgacggcagctacgcatgacatgatgtcattatggttgtgagcaaatgttttttcaagagtttttcatgtgatctcgtcagtaattccgtccctcggttaacaacaaccattcaacacgatgtacggaccgtgacatcagattcagcgtacatgggtagcactcgggcgcagctcatacttcatcattttcaaaatatttgacactgttgactttttagtacatatttaaccatttgtcttattaaaaaaatttgtgaaatatgtaaaactatatgtgtacatgaaagtatatttaacaatgaatcaaatgatataaaaataataaataattacttaaacttttaaataagacgaatggtcaaacatgtactaaaaagtcaacggtgtcaaacattttgaaacggagggatacatttctgcaagtcgcttaattcgtatcgaaacgcaacacggcgataacctgagcgatcacatgacggtaattaatcaataactaatccagctgctactgtaaatgattataaatgtaacgcgtcgtacaaagagtagtcaaaatctgaacacacagaaagttaaaaggaaagggacatgaccattcctgcgagaatcagcatagatttcttgtgttctccaattaatttcaagaagaaaaaaataatactacctccgacctaaaataagtacaaataatactacctccgacctaaaataagtacagctgtagctatctgtgcacaacgtttgacggttcgtcttatttaaaaagatataaaaaattaaaaattagtcacacataaagtacgattcatattttatcatttaataacaataaaaataataatcataaaattatttaaataagataaaatggtcaaatattagattggacggtataaaattacactttttttttgagactgaggagtaatcagcaaccttgaagtcaatcacacatgcggcagccatggcaaccaagtcaagagctgaacatgataaactaataaatccatcacgtctagaagccaaattaaccaaaccaaaaacgaaaacgtgtcacgaatcgtcacgtataaattgcactgtgtacttagacatccataacgttttcaccaaatcaactctgccatttcgtcgattgtcctcctcttcccttgacggtgcaaagcagcatctccatcgcaatggattaccaccgaatccacccggtgggcgtcggctcgccggcgccggcgccggacagccagcagcaggtcggcaaggggaggtcgacggcgagctacggtgagaaggagcagctgccgatcaccgcgccacggccgtacgcgccggcaccgctgccgccgccgccgccgcggcgcaggagccgcgggcggcggtgctgccggtgcgtgtgctggacgctgctcgccgtactcgtcctcgccgtggcgctgggcgccacggcgggcatcctgtacgcggtgttcaagcccaagataccggacttccacgtggaccggctcaccgtgacgcggttcgacgtgaacgcgacggcggcgacggtgagcgacgcgttcaaggtggaggtgacgtcgacgaacccgaaccggcggatcgggatctactacgacggcggcgaggtgacggcgtcgttcaacggcacggagctgtgccgcggcgggttcccggcgctgtaccagggccaccggagcacggtgcgccccgtcatcctgctcgccggcgaaacgcggctggacagcgccgtggcgctgcagctggcgcggcagcagcaggccgggttcgtgccgctcacggtgtgggcgcgcgtgccgatccgcatcaagttcggcgccatcaagctgtggaagatgaccgggaaggcgacctgcaacctcgtcgtcgacaacctcgtcgccggcaggcagatccgcatccgctccaacagctgcagcttcaagctcaaggtctgatcgagctttgtagaggcgttgatccatctccatttctgtgaatccatccgttgagttgagattagcaggtggtagaggcgtgtatttttacatttttaccaatactagtttctgtgaatccatccgtttttggaagctctgctactcagattaggtttaatgtatgagcaccgatgtatatatgaaaatgcatacgcgatgaatttctttgaaaatggcaataaagatggcgaatttgttcgtctggcatgccccaactgaagcaatttcagtataaactcactcccaaaaagaacacctttagccgccccgttggtatgggtctatccaagtaaggtcttaatgggccggtctacaaattaaaagtctatgctgcctacctcaactatggcacacctggtttcaggtctttctcctttgatcaatatatataggtagttccttgataaaacattaaaactcaattagatacgtatgacagaaacgaaattagtacgcagctacagtgcccaataccgacttccacgttatcattttacagtgcgaccacaacatttatcatcctcctctaccctaaactagatttgtgtaacttcccgatttacaaagtatatgatcaggagatattacaaatcagacaatgcactactactctatttctctaaacctcgtaaaacatctcacacaaagtagtcttgtgctgtaccgatcgaaatgcaccatatatgtcacccatggcgaagcagcaatcactgccacgcacggcggcgccggtcaaatctgcctgcacggcggcagcggcttgccgcagaggcacaggttgccggcgtacgcggcggcggggagcaggttgaacggcctggcctgcggtatcttgccgcacagcttgttgccccggaagctcgcgtgccggagcctcgccatccgggcgaagctgtccggtatcctcccgacgagcgcgttgccggagatgtccagccaccggaggctcgccatcgacgccacggatgccgggatggtgcccctgatcttgttccgggagatgtccagcctctggagcccgaccagcctccacaccgagcttggtatctggccgccgatggcattgcccgacacgtccagccacctcaagctcgcgccggcgccgaactccggcaaggctccggtgatactgttcttggacaggtccaggtgttgtagttgccgaggaagaaagatcactgacatgtctgagcttgcattcttggtcagcctccttgctggtgatatgcttctgaagaagtgatcaatgccgccgacgagatggttgtgagagaggtccatggacacgagagacggcaatccatggcggattccgggaggaagtgaacctgacaacccgtttcttgacaggttcaggttccacagcttctgcagaccaaacagtgactctgggatcgagcctacgagcagattgctgtcaatggagagagaattcagagaagaaatgctgccgatctgagaagggatcacgccggtgagcttgttatggcgcagggagagatcagtgaggttgcgtaggccgcacagcgacgccggaatctcgccggagaagccgttgttgctgaggtcaagcatggccaggctcttgagctgctgcccaaagaacgccggaattgcaccggagaggaggttgttgctcaggtcgagatacgccaacctggagagattcttgtagctcggcggcacctcgccggagagccgattcccggcgaggttgatctgcaccagccccgggagtgacccgagctccggcggcagcttcccctcgaaccggtttccggcgagcgacaggtactggagggaggccatgccgctgaggacgctgccggggacgccgccggcgagcatgctgccctcgaggtagagctgcttgaggcgcgacagccgcgacaggctcn

SEQ ID NO: 6450 - DNA, 2414 bp, Oryza sativa
  unsure (1)..(2414): unsure at all n locations
gtgggncnttgaattcaattgcactcggcacccaacagagtagaaatttaatatgcccaaacacaaatacatatatgcttatttccaaagggaaaaacacaaggccctttaatcaaaagatgctaaccgcccatggagagaatgtcttttgtttggttcctttggccacaagttatgtgtgtcttctcattaagctcaaagattagcaaccctatccctcatagattggggctcccactttcccaaatttgagagaggagaaaagaaaaaacactctaccaaacaaccaattcaacataaccaccctcctagttagcaagctagcagtactctaatagtctaattagacaagctaggcaacaactagctaatggagcatcatctagctgtcaatccctagctaatacgagtagcggatgcatgggaacgatgatatagaggtagtacacacatatgcatcatgcatgtgcagctagctagcaaccaattaatacttaattctactagaacaaaacgaatctgcacacatgcagattatcatgcatgatatatatgcaacatccattcatctatgacctcattgttaagttctttgattaagtaattacctgtttcttccccaatcagatagaagacgtacctacagaagatgaaaaaatatatatataccaacatcgcagatacagctacaaaggtaggttagtaggatgcatgaatttttcacaattcacaaacacacatatacgcagatatatagatcgatttactgacaattgacaacaattaacactgcactaattcactatcatatagtatatgtaacttcatccttctctttatatgttacaattaattacccctctttctcttctctctataaagccttcttcttggtatatatgattcaattcattgtgctcccagccggtcggcctatacttctatacatggatgtatgtatccaacaatcttttcatcacctaccaataatcttaattaccaacaaaaacaaaaaacatgtatactaacactccacccaatctcctagatcctccccttaattaccccaataataatcccctatcttaaccaaccatcatatgcatcgatcgatcgatccacatgaacaagagatagatcgatatgatgtaggtagagaagtagaacagaagcagcaacagcagcatgtgatgcgtgcaagacgaacgaataaataattaaccatatgatgcatatgttaattactcgatggatggatcattggtaggagaagaggtcgacgaggccttgcatcagctgcacctgcgcgcgaagcgagcggaggtagtcggcggtctcctccaggaggctggagtactccatgccggcgccgccggggaccaggcgccggagcgcttcggccctcggcggctcgccctgctgcggcgaagcgggcggaccagcccgagccgccgccgacgtctctccggcagcaataatcctgacgcctctggcggaggcgggagaaggcgcaggagcggctacgacgcgcctccgcaccagcacggcggcgcgcctcatcagcgtcctggacctccgcgcgcggacctggccgagcagcgcccggctccacgcgcggcgcgggctcgccgcccgcgccatggaggagtaggccgcccggcggatggtccgcgtgcgccgcgtcacgggtgtcgcccggtggatccgcgacagcgcgcgcagaaagtggaaggccagcatgtgcttcgtcgccgccgccgcttcccccctcccaaatccgccgccgtccgcggcggcgccgctgccaattacgctagggttagggttcggcggcgtcggcggcgacggcgtcctcttcgcgtccatcaaacggcgcccccaacctcacctcacctcctcaccttccacggagagaagagaagaggagaggagagagatggagaagaagaagaagatttggctctgacacaaacggatcagaaggatttgtgggttgcgattttagagagagaaaaaaaggaaagggaagagagcgaggaacccggctctgacacaaatgtcctgagcaagatccggtgtcttataatacctagttgacaacgagagacaaaaacaatccaaattattcttttttattaaaaaaattagtctgctagtactgtagagaaagaaagtaagaaattgttggccaagatgaacatgagactcatctttggttagctcttgcttgcatgtgggctaatggatataaaagcaatctggtcggactttggtcggatcgatatattgattcagttactcgatcggtcacaaacatctactcctacgcaatctgctgatttggttaattaacctgatggggatcctctagagtcgcccgcgggcngcaggaattgttctaagtttcaatgcca

SEQ ID NO: 6451 - DNA, 1767 bp, Oryza sativa
  unsure (1)..(1767): unsure at all n locations
gtggtccnnnnattagtagattcctatnnnnnnnnnnnnnnnnnnnnnnnnnnnnnnnnnnnnnatatatatatatatatatatatcgatcgatcctgactccatgagcgtaagaatatgctataatttttaacgatgatatataatcatatagacacttttttttatttgatagtacaatagtataatccggttacagcttaaatagatatcctgcatgcaggtttattcagtatacaatacatttattctggtggaacactcttaatttgggccattttattctagcttcacgcatggccagcgcctactcacgcagcaccaccatcggggcgccggtgtagaacgggtacacctccgacctgaggaggcacctcggcccggcgatcctggcgccgtcgacgttcgccgggaacgtgtcccaccacctggcgacgaggccctcgaggcagccgcggcacgcctccagcgtgatgtcgaacgcgcactgcgccgtcgcgtacaggttggggaaccccgggtcggcgcccacccgctgccccgtcgcgaacagcttcctcgcgatgtcccccgccgcgtactccgcggtggccgccagcagccgcgtcaccgcgcggtcgtaggcggcgacgtcggcgccgctgctgatgttggtgctgctcatgagggtcgtcagctgccccggccccaccttgtcggcgaggaagtcgtccttgtcgaagaggcgggcgtaacactcgttgtagacgagggcgacgtccttggcgcggcggcacgcgctcccggcgtccctccacacgctggtgccgcagtcgtagcagccggcgcgggagatgtcgccgcggcagaggaggaggccgtacacggtgttcggggcggcgccgttggagcccgtgaaaaagaggatctcctggaaggaggcgccgtcgcggagggtgagggccaggttcaggaggttgttctcgtaggcgctcccctgctcgtacgtgccgtcgccgcaggtagcccacggctggccggcggcgagcgggacgaccgccaccgccgccgccacgaggagaacgagcaaagtgcaccgcgccattgcaatggcagtgatcgttaagctataggttgatggattagcgatcgatgtgtgtgcagcaaagcgtcgagcattgcatgcatatttataggtacggtaacgtactaaggtagttttggacgacacgcatcgccaacctatcgttttggatgaggctctaatttgtcgagatagctagctagttggcaatttggcgtgtgctatttgccgataactaaacacacagttccacaaaacaagctgaattggcgccgattttatgtacgggtttaactgtttaagaaaccggtcaaaaccgttggttctgatttcaacatcgatccagccaatgagagaaccacgcacggcagctgcgctgatctttgatagcactagttcaatgttgcctagtcggattaattcgctggtttcagacgaactatagaggaacagcattgactgttaggtacattcgtcgcactcgcacaggcgcacatcaagtgaatatttcgttactctactttaattaatttgtagtcaccaaactgaacaccgtctccgatgtactagaacaaaaggatatacttaattactctacttaatctactttttttgtttgaatcatgggctgcgtgcctgcgttctatnnnnnnnnnnnnnnnnnnnnnnnnnnnnnnnnnnnnnnagaaaatactatgcccaca

SEQ ID NO: 6452 - DNA, 744 bp, Oryza sativa
  unsure (1)..(744): unsure at all n locations
cgactgagannggtaagatcanctctctacccctgcagtcaagtcaatgcaattgcatgtctcaatattctgtatcctgtcatgttcatattatataatgtcatcaaaaaggaaggtaactctttggtcttacgtgattatcttcaaaaaagcatccaatatatgaacaaaatattgttcagggcagtcttgaaaaaacttcactaatttctgaatggcatctttcttcaacaaggcttgttccacttttctgtgatcattgtcatgggacaagcaaacagcaattgaatctaacgcagtacacgcccatgcatcatcctccaataagttcaagtacacatccaatcctccatgagccctcaactgctctctagagttgcgagaagcgtgagccatatcacacagcagaggtaaagcatattgcctgagaggtgagtctgacatgacaaaattcattaagtgagggatgatcccattttcagctgcttgttcctgtcttcttttattgatcttgcaaagattgaacagagcattgaggacctaaaacagcaaaaaattgcatagagttataatgtgctgagaaatcgtgcagacctatttcaaattctgaatagccaactgtcttgacatttgtccctaacacaaagtttgcgaattccagaaaaagtgcagttgcacaagccattgaattttgcgatgtcaccattcgtttttctactcctacgacccaatgaagttgtttgg

SEQ ID NO: 6453 - DNA, 746 bp, Oryza sativa
  unsure (1)..(746): unsure at all n locations
gccgtcanggtaagacanctctctaccctcaccacaattgacaggttcaacgtagcatcatcagaccacttggtaatcaaacatgggccgcattgggcacctcgtgtgatatgatctaaatctaaacacaaaacaggtggtgcaaatcacctcttcccatttcccaatccgataagttccactaattgcgcgcacgatgtaccacatatataacctagtctcattaatctcatcaatctaagcagccaattgccacagatcagccaaaccaaccaacataaacaataataggaaataccacaacacaacactgcatccgagcatcgggacgagaggggcaaaggggggatcaatcgagcgagcgatggtgtgggggtacctacacggaagaggtcgatgaggaggtggtcggggaggcgggagaggtcgtggaggtgggcgatgcggaggagcgcggagtcgagggtgagggagagcagggagggggggcgcatcggcgccagatctggatctcgcgccccctcttttataatccccacgcttccgttgcaagcaaagcgcgcgccacgttgcgcccgctgcctcgatcctcctcctcctcgcttctcgctctccctcttccgcttgccggcaatcgaggaggaaacggatcggcgactttttttttttccttcccttgtcctttttggcccccccaactcttgtggaatttttccaccgtcctccactttctgtaaccgtacgag

SEQ ID NO: 6454 - DNA, 745 bp, Oryza sativa
  unsure (1)..(745): unsure at all n locations
gcgtaanggtagtcagcatcttgnacccanctttganacaagggtgattactgattaggaggaattaaattaagatggtaacggtaacacctcccaaaccaggaagtgacggatggaaatgactcggaatgtaacgtaaaacgttgctattttccaggatttgctgcctctttttttctgctatagttggcacgctcttaaaaagcagaaacttgtcagacaaaaaaaaatgtataagagcgaaactgacgacataatacgttattacgtcacgtacgaccaccatgattattagtgtgacgcaaataaccagtgcaacaaaaatggagttagagcagcacggcaaggtttcgatctctttgtacctgcaccaggttcattactagtacgaatcaggtagtgaaccaatacatctgttcataattacgaatcagatagtcggatacttactgaaccattacatatgttcatgattacgtattgactcgatatttacttttcagataataaaccactacatctgggctgaaggagattcagcattccaaccattttacgactggggcagggtggccaggcgtacaattgganaaaggaaaaattttgggggacgaagtgcggcgtacaaagatgataatacagccagatgcctaaaatgctacattcaataccatttgaatgtacaaggtttattgatatgctttattgagacataacagcatgcattgaaactctaaacaagaca

SEQ ID NO: 6455 - DNA, 3226 bp, Oryza sativa
  unsure (1)..(3226): unsure at all n locations
ccacgcaattaattacccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggggtagggcattggaggcatgtttactggggcaccagggactacagctccagggacaggggcatgcatgccataggctatatgaggtgcagcaggaacaggaagtgtaacaggagtgccaactgcggacacaagaggaccaccaactggctgtccaattgtcgtaccataagcatcgacgcctggaggcgcatttgctggctgtagagactgcttagaggattttccaggatttgctgatgggccatttggctgacctgtgattggcccctgagcagcagatgtatctccattgttcacgctggttatgtcatgtatacttgatcgccgcctctctctgttcattgagttcaggcgaataaaatacttctgtgcatgactagctacttgggtgggtgtccttgagatcacaaagtttcttgagatactcctccagtcgcctttgccgtacttctcaagtccaagaaggaacagcctgcaaattaaaatcaagtggtaggacacatcaataaccatatgagtaaagggcagtctgcatgaattaatcaactttggatatttctcatcctgaagagaggggtaatagctacaaatttatgcatcagaacaaaaggaggttagttgtgccatttttacaaccatgctttcacttgagttgtaatcaatatcatgcatgtgcatacatggcaatgaacgaacaacacattagcatccatcagggcatcaggttacttctacttgaaacgtattttcatgctctgcatcatcttggtatgttatgtctatttcactcattcagccattcaaacagacaaaaatacccgataatcacatcattttatatggggatctgacaagcatactgccttatatactgataaaacacattcaatattaccaatatgccaataagatatcaaaattttatctccttggaccagaaatactgtccacaatatcatggaagaaacaggttgcaaatgaaaacaggactatgtctaaaagacacaanaaccaattatatgcgcacagcaagcatgtactagcttgttccggtctaaagctagcaggaaaatttcaactaaaatagcatatcaaatacggaaaaaaaaatggaaatgtgaaacaaatgcgttcaaaatgttcattttgctgaaataaatttaagatggacaaaaatcagttataagctaccattgtcctgattcctctaactccttttagggaaaattcgtccatgacacacgctgaccattaaattcagaaaatagcacaaaccttcataatgccacaggttgtgggtttttctaggggaaataccactaccgtcatcttttgagctaacgggagtttatttggacaaaattgtccctcagattgagcctagatgattcgaacccatcttgtaagttcctgactgaacaataattccccatctcctccaaatcctcaaatcccttgatctaaccccctcttccgctgctggggcctgcttgtgtttcgtcattctcggcaggcacgggctagtggtggccgccattcccctcccctgtatgctcgcgattgctggacgcggcagtgtggtcacttgctggtgccaccgcctcaccctcaaccaactcctgtgagctcgaagcttagcgacgtccatggtgattgccgtccctccaacctgcacacagcaaacgcgcttggtggatgtggccgtatggttgcttgccagtgacgctagcctgctggctcaccacgtgttaacccaggtcaatggctaatcgatcttctagctggaagccaaggcgcacatgcacaacatcgttcttcactccactttgaagccaaatgaccaagtttaattttgtattccatgaactgctggagctatgtaggggattgagcattggcgttcggaaaatcaaagtagatgcaagcagacagatttgctttctttcttttatttgtacctatgaaataggagatttctgtaatggtgacaaagatatttgataaactatctgtttgatctgttggtttgtgattaaagatgatgtatgagctaatggaggtgtcagattgaacaaagagaaggagaacgcgccagaggaaccccagcaaacaggaatgcgtaagaggtaggtcttgttgcattgcaattgaagtaaaattattttggtctttcggtggtatttttcaaacaaaaaactgatgcgctatggtattaagcagagtgagaaaaagcttagttgtattttacgaattgtgctatgaacagaattttctcatccttttaggaggaaggtgaaatatgctaagatgaatcaattaaacaagccttcagcaagaagaaatgagaaacaaacctaaaactaaatcagtgggatgtagctcgaaatgcataggatccaccataagaagtaacgtgaataggttattgttagaaaacagtttataattcaaaaattgattgagttaagtagttactggagttgtcgaaactagcaaggaagaaacaacatctccaatgaaccacttccagttgaaaacaagtatgcagcacaagtaatcagccgctccatctgagaagaactatgcaggatgtaacataaactgccaagtggtgaaacccataaaaaaaccatgcgggacaaaacctagcacacacaaaccaacaagcctacttcctggggtctgaagcagtaatttccaaaatcgtaaacaggctgcaataattttttaaaaccccagacaaaccaatcggcaaaattcccaacaacacagaagcggtacctaattcacgattaaataaactactattctagcttctatgcaatcatttattcaaagaaatagaaaagggagctacctaattgtccagtgcaaagaaagcttgaga

SEQ ID NO: 6456 - DNA, 2894 bp, Oryza sativa
  unsure (1)..(2894): unsure at all n locations
ccaccagctgtaganccgcctctcctggttagcttagttccatcctagcgttcttttgtttttgccgaacccgactcttactccctggacatccccaccagcgccaagcgcggtaacnaacccatattccgccacgagcggccccccncccccaaaaangaanaaccctcctccccacccccaccgccacccccaccacgaccgccgccactgntgctgctcgcctcctccaccgccatgagctcaaaccctaaaacagcgcgcggcgcagcgagattttgtggggagggattgcagcggcggataagggagggagatttaattcgttttaggaaggctgcgggtttgcggggaaggaataaattgggggtttcctccgagaagagagagaggaagagcaggagacggtggaggtggaggaggaggagatctaccgcgcagcggcggccgcggcgggggaggagtgtgatggatgttaccgcgaggcgaggcgaggcgaggcgggggatattttggttcaccgcgacagtggctggctggctggctggggggagtgcggtgtcgggtcgggccaggcttcctcctcggggaggaaggagacagacagcggatgcagacgcggacatggccgctggctggcgcgacgccggccgtattatttctccgtctcttttttttttctttttttttcctttttcattttgttctctttctgtgattttgtggggagggacttttctttttgggtgttatagatgtactagctggttactactctctccgtatttcaatgtataacgtcgttgactttttaaccaatgtttgactattcgttttatttttgtgtaaaatgaaaatatttatatcatgcttaaagaatatttgatgatgaattaagtcacactaaaatgaataataattatatacattttttgaataagacgaatgatcaaacgttagataaaaaatcaacagcgtctaggcagtattaatcatgagttcgtgtttatctcttcctgtcgctgtccatatgctcctgattaccggtgatagcgagagcatgatttgcatcttttcaattatttatattcaacaagttttgtcgtgtttcaagcgtgatagcggtttataaagaacagatatatttaattgttttaccaatatagacatataatgtttggcgtaaataaatgttctcagttcatggatatatgggacttatctagttatcttatatgtataaaaaatggaattcatgcagtaaaatggaggtaaatctatgtctaccagtatattagttatctaaaaaggctatttttgaccataatactctacatcatggatttaaatattacaaaaacaaatactccttccgtctcataatacaaagaattttagaggggagtgacactttctaggactacgaatcttgacaggctctttatccagattcgtagtcctaagaagtgtcacatcccttcaaaattctttatattatgggatgaagtgagtaattcatgagctagaattataacatggttagttacctagaaggatcatcccatcaccctattatttgtttagctatattagcaccaccctgtaagcttttaagtagggatgaaactggttcggatagttttcgtccgtccggaccatttttcggattaggatagtttcagtcggaattatccggaaattctcggattcggaaacgaattcggatattttttcttggaaacgaaaacgaatacagtaagggtaatatccgtcggaatcagaaaacggtcggaaactatccagaatttttttcagatatccgcagacattaagcaaattatataaaaaacacgtatatatacataactttttcatacggaatcagatgaagacaaactttatatcaacattgtagagctcgatgagatctacaactttattattgactattttattatttgaggtcatttatgggtctaaatattcattataatataccatattaatttttacaaaatctcagatctacaattcaacgacatctgaggagatgtgttccatatcaaaattgtagagctcaatgggatctaccactttgcagtttataacatttgtatttgaaagcatttaaagtacaatacaaacattacaagtttcgaagatgtgaagtaaaataaacaaaatctccaatttatacaatggtaagtaagttatacatctagtgaaaggtctcgggaatagaaaatgataatcatatttgcatatggatctcttagaggaacagccatgaaaatcgatttccacatacagttgtgggaccgtctataaaattgacgatataaatgttggagatgttgaactaaaataataagcgatatctcttccttgatcaagaaactcaatttgaggggttttttatataccgataaatattcgctaccgtattcgttccgtctcgtattcgctccgtatttgtattcgataatattcgatttcatttccgtatccaagttttcgattccgattccgatttcgaaaaaaaatattaaaacgaatatgataaagctagtttccgtccgttttcatccctacttttaagtaatagtagtacaagattatttagggactgtcattagatacaacagctgagactataaatctctaaccattgactaattttttattactattctctcttttttttcacccttatgtaaccatgttttcaatatagaggtcaaaagtcattgttgagccactgttaactacagtaaagtcatcttctttttttctttttcgtattagcaaaatattcccaattggtaggactaaaaacctcctatgtctaatgattattgcncngggtncagagtcgnagatctaccntccactct

SEQ ID NO: 6457 - DNA, 4524 bp, Oryza sativa
  unsure (1)..(4524): unsure at all n locations
cgccccattgaattctaannnnnnnnnnnnnnnnnnnnnnnnnnnnnnnnnnnnnnnnnncaaaaaagtccaaataaacaaaactttgatatttcaaggtcaaatgagcaagggtaagaatggcaatttatcccttagttaacaatgttatattgtcttcacgataaacaaaaagccttgatctgttttcaagagggtcaaataaacaaacctgaaaaaacaagatcagattgatagtttgacttcaaaagaggataaaatgagcaattgtcccttcatcatttgataaattaggtgaaaccccgcgcattgctgcgggaatttagtatgataacaataaaaaaaataacgtgtaagatagctagataacatcagattaattaaattaatgtggtttatgatagtttaaatttaaatagtatgtagaacggtgattcaaacgtaaaaagtaaggtgatatgactttatggaagaagaaaaatagggagataatttggaccgtagattaatcatctaaaggctaaaaaacaattgatgtgatatgacttaattagaggaaaaaagaagaaagataatttggaccatagattaatcatttaaacactaactaagtgaggatgaactatataagtatataggatatcataaaacacaataaagatatacattaaaacattatatgaattatgttggatgataatttaacatgtttatatttaaaaaactcttaaattataaaaactataaagatatagcatgtttgcatgatgtttaaatgtgatgattgttaatggatgatgatgtggcatcttgttaattagtggattaatggatgatgatgtgatatctttgtatgagcttaaggaattagtgggggtaactttatagtaagataggattagatgcaattaatattcaaccattttttttaaacgaaccggtattaatattcaaccattggggcaagttgctatgggtttactccactcggagaactgactatatttctagctcttttagcgattggttcttgatcgatcggttctttctccaactttactaactcatctaccttgttttacacgggcacgctttttaaactactgaatggtatttttttaaaaaaaattatctatacgaaagttgctttaaaaagatatattaacccattttttttaaaaaaaattagtaaatatttaattaattataaaaaaaaatatgccgctccgttttatacgtgaagaaaatgggtttccaacgcaaggaaaggaacacagcctactagctatggtgtgttgtttctctctgtaatttaattggaatgtttgcactcagtttctaatcctcgtccccaaatcgatcaaagatgttatgcttttttaattgtccccagcttttcctgaagaatgtttcacatttcaaacggtaagcataccaacgactcttttttcactggtgatttgggtaaacgagaattacaggtgtattttcattaaaaataaggggaaaaatatgtggtgttcccaaatcccaagcaggccctagagaaaaatacaccaggggaatccaagctaagtcccccacttcctactacgcgcatatcgttccgactcctatagttcacctccttttggcactaaaagaagtgattttggtataataatcctatttttgagctaggatagcacaaaccttaccatttttttttatttcggcaagcatgtcccaattcaggaaacaaaatctaagacatactcccttgtttcaaagcgattaataatatttcaaagcgacttaattattataatatgaaaggaagacttataatatgatgaacagagacaaagtaagatagaaaaagtgaaaccaaaaccatgaaggaaaaagtgtaaccaacacaatgaagaatgtgagccggtaaattagtaatccgttatttctatagtgacgttcttttctcttgaagatgaagttttatacgcaaaacgagatgatattaatatatgattaattgggttttaattattacaaactagaaaatagattaatatgacattttaaagtaactttcatatagaaagttttcgcacgaaacgcatcgtttagtaatttgaaaagcgtgccacgagtatccaaaattttatcaaattttgttgaagaaaagaacagggtcacagtgataccaattaattacagttataattatgatcctagagctcaacactcggcaagccaagtcgtcactcatataaggagataacacaaattaagagtgccattaaatggtagcatgacttcattacaaaccactgcagaggtgactatcaaaatacatcgaagtatgaaatggacagcacaggagaatgtccgaacttgttcacaacactgcccagatggtatcgctgccagcatacaatctcgatttatgagggatcatttggagttcccctttcctactgttgtcgttgccattggcatgataaacactcggcaccacctccacaccggtcaagacagtaatgttcttcccaattaattcatcggagtccccttggggagtcttattgtgaaagaaccttgcaatgcagaacttgcccgagccaaggttgacaagttgagaatccttgcatcgcttccattcctctggctggtcaaactccttacaagtagctagtagctgtggctgggaattcatcgatgagagatcagcagcagccaagtcttgggtgtcggcagaaatgccaacccagagcttgagctcaggtacatactcaaccttgccggtgaagggtagcatccatttgccgaggtggctccatgtgaagctccgcatgtccatacaataggtgccgacaccttttacagagatgcagatgttcgagccgtcaccaagcaaagcataggaactgatctccaggtacctgcccaagtatgctctgtcatagatacatggcggtggcaggaggatctggcgggtccaggacttcaaggtgctgcttccacgatagtggcagtagatgaaggcctcgaattgattgtttcctaactttcctgttttactcctcttatccattatgtaaaggttgccaccgtcgaagtcaccggcttcctccaggcaggggacgaagatggagatgggtatctccttgggctggtgaagacagggcagcataaccacgcgtcttcttccgcctcaaagataaagcagcgtcccgactggtctgcacacaccaccctgcgatcaaaaagcggcaagcagtctatcttccaatagtcgtcaatacctgaacgtgaagcttggaagttgaagatggggcttggaagttgaatcctatccatgctgcttacggtggcggtggcggcctcctccttattattgttctgcttctggatgcaggcatcagccgcgacaactttggactctggtccgtttcggttcggtggagtagcgttgaagaaattgtggagcgtgaggtcgatgcagcgcagcgatttggattctgggaagcggctgtccatgatcagattcagaaacctccgagagagggccattatcggagtgaacttcaagataaaaaataaactacaggaaaagcatttgttaccaagaagaaggatgaaatcatcaaaatcaaaataaacaggaaagatttgtttaccaagggaaggggaaaaaacatgcctaccttaggtccaggtacagctgctattgtgagggaatgagtgattccagcaaggaggagagcgtatagctgcagggttggcaagaaggcatcaagtgagcagccttataatcatcagagagaacaaggaaagagagtggatgtagatctcggagaaagggcatacctcgccaagccggagaagggaaggaggagcacccagcacccccaacagaatggcggcggccggcggggatgggagtagggagatctgctagggataggttctgccgaaatcgctaaaaagcgatcagtcgcgggcctcccctcctgcgcggcgcggccacgtggcacgcgcggagagggggccgcggtggaacggcgcgggagcgccgtgcgcgcgtttctcgttttctttttcgttttttttctttcggtttttcttttcgtttttttctgtttttttccagatttggcgtttctcgttttttttctttcggttttcttttcgtttttttctggttttttttctatacgtggtgttttttttgtttttttcttggttttcggttttcaaatatgtatgtatttacatatatacaaagtttgtatacgcgtacacaaagtttgtatacagtagtgtagtagtagtatagtagtacaccgaaggtccctcaacttgtcatcgagttaaaaaatcatcctcgaaccgtaaaaccgaatacaacgcatccctcaacgtacaaaaccagtgcaaactaggtccctcgggaagaagaggctgacacgtgggannnnnnnnnnnnnnnnnnnnnnnnnnnnnnnnnngatagggtatntcaaatatcaggtttcaacgctc

SEQ ID NO: 6458 - DNA, 8417 bp, Oryza sativa
  unsure (1)..(8417): unsure at all n locations
ccacccccatttgtttgcctaacctcatccctgatggcggccccgcctctgcgcttccgccctttcaaatgtcgggcgagaccggtgaggaacaactgtcgcggcgcgtcgctagttgccaagcgtcgccgtcgtgtcgaccatcgtcggccgccaacgccctcgtcctctccctcctggccccgccgaaggcaacagcccgccgacgtcctccctagctgcctacccaaacaggagaagagtgagagagagagagaggagaaagggagaggagggagagggtgatgacatggccagctaacatgtgggggcacacgtgggtcccacgctgactcagccgccaagttagacaaaactgggttggaaaaccatcgagggacatattgtgactggttttggttagttaagagaccccgcatatctggttttacggttcgaggacgtttttttatcctgatgacaagttgagggaccttcggtgtacttattccaactatttatatatactagcaaagtgcccatgcgttgcatcggcaacactcaaatttcacgagatgattaatttttaagattggagcactttaaaagaatgatattgctagagaaattacacagttacaactcatccctaacaaataaatcaatccaaacgtatatgacggatctaccttctatgacagataagtaaaaagcaaggaaataaaattactacttcctctgttttataatgtaagtcattttagtatttcccacattcatagtgatgttaatgaatctagataaacatatatgtctagatttattagcatcaatatgaatatggaaaatgatagaatgacttacattatgaaacggagggagtataacacttccattgaaagtaggatgttcggcataatttgtttcgtatagaatggcacacaatcagaaaaaagccatgaagcaaaataatcaagctaactcaaataacttgattagctcaaattctaagataaatacttaaaaattaaatggaaaaaaaatacaacttgattagctcagatcttgagataaagacatataaaaaataaaagagaaaagagaaagctgtcatctcgttgtcgtcgtccctacgccatttggtgcctgaagggaagttcctcggcccggtgcagttctccaccgccgggtgcatcgctggcttcatgtgtgtgcgtcgtcgtcgtcgaggggaacgacccggccgccgtcggcagccaggagatcgcggtgccctaccgctatacccgctactcaagcacatgcagcaggcgcaagctagggcatggagatgtcgaggaggacgaagctgaaccgtcttcggtatgtcgtcttgcccgttgctgacctggcgagctcgttgccatgggccggctcgtcgccactccccctgacgttcgcgcttctccccaacggtggcccgacgtggagcggaaggcaaaagatgaggtagcaccgatctgatgaagcggaaaggaagggaagagaagagatatagtcattgacaggtgggctccacaagatgactcggcagcttagaccaagtcaaagcgtcacatcagcgaaacctcccttcaaaaccactgatagagttaaattaaaccagttctaatagttgagtgtaaagatatgtggtattgtgattcagggatgtgaattagattgaagttactccctccatccctaaatgtttgatgccgttgacttttttaaacatttttgaccgtttgtcttattcaaaaaattttatgaaatatataaaactatatgtatacataaaaatatatttaacaatgaatcaaatgatagaaaaataattaaaaaatacttaaatttttttgaataagacgaacggtcaaacatgattaaaaaagtcaacggtgtcaaatattttgggatggaaggagtatatgggagggagttaaaattaggggtgcaagtggggctggctttttttatggcccgtagtcccgccccacaaaaaagcccgtaaatttgcgggcgggccatcccgtatggttttgcaaaattgtttggcccatcccgcatagcccgttgggcgccaccacattagggcacgagactgggtctctgggagacgcgagacaccgccgcagccgagacgggagacggcggcggtgctactctcgtcttcctcgtcgcccatccatcttcctcggcgagacgacgccgcagcagccatccccaacccccacgtgtgttcggtgcgagcctgctacgctacccgtgctgctgcctccaactctctacccatcactggctccatcggcctgggagactgggagcaggtaacttcgagctgccatggaagagggctgcagttccaattggccggccacaccttgtgccgcagcgacgacggccggtcaattgtttttcctccttcaagatttgtttgttcttcaagcagcaggggatttgtttcttcaagatttgtttgttcttcaaggagcaggggatttgtttgatgagaagtgatttctactcgtttggattattgaataagaacttcagattaaataataagcatttgggtgagatttggttttggatcaagtcgctaagaatggttagcaggccaggactggcttggactatacttgttatgtcattgaaaaatgaagtgttgaacacatgttaacatccttatgtaccagtttgatgtagaccatgtgcaccgggcttcatccgagctgtcgatggtcgcctggtcctttacgttgccccatcacgccggccaatgcttggtggctcaaggtgaggcatggactatgagcagcaataccgtcattgatttgtcccgcggtcccgccaataacttgttgcacctccttgatttctctgctctagcaacttgtgcgacttttatttttcttcttttttttctaggattatcggctggtttagttctaatgcatgcaagactatgattgctcgattgttttttcaatcgatctttgatgttatgatttgtactccttacgcgattaggattttgtatggatctctctctctcttttgctttggttgttgtacgcgattacgcacgtgcggagacggagggcgtcgctcggtcggactcacggacgaaaaaattatgatgatcagaaagttacttatttttgaagtagttaatgtgtcccgaaataataatgatgttttcgccgataatttagtacgtcgtccgtatttgagtcggtttctaagttcgttcgtttttttaatacatcaagtatttatcttgaaggttagtgaaatatgcgttgaaggttagtgaagcgcagggccttgctaggggtgaaaaaaactgaccgctggtgagtcgatcatcggattctactctgcggtacggtctggggtttatgaagatcgattcttgttttgtttatccggtctaggtacccgaaaaagccgaaataccagatgatcatgtgctttcccactcccatcatctatcccatccctactcccagcgcttgagctcccccatccgccgtccatacatccatcaatggggtgggaaaaaaaaagtccaaactgaaagagcatgatggagactgaaaatatcgagactaagaaattccgtcgtaagtatttaatttattttagttagcagccttcattaaccgaaacgagaaaaatatctctttttgtctgacagagtacattatactccctctattcgaaattgatctacatattttaaaggtacatcaagaccaagaaaagttaataactctcttatactatatttactctagcaacaaactcaatgcatgcaccatccccactattttctggctaatagcaaatcaagatattgtatgtgggttataaatgcttatgtgcatggatgcatgcatcaatgttcatttactccaatgtacaaataacaaatagacctaatgaatgaacacaaatatgtagatcatttaggaataacctcaaaaaagactatatataaatcaatttggaatcgagggagtagttaatctattgaatggaagtaggagtacgtactactaagagcaagtctaatagtacagcccactactagctctaattcatctatagccaatttaatagctaattcatacaatagttgtttactatactattaatatatggtcccacctgtcatacacacagtatgtcttaaagtctgtgctgtagctggctacagatctgtagcccgctgctcttatctctcattgtatatctcattaaaatatatttatagctggctaatagcattagcctgctattgtacctgctctaattgaatagtacgagcacccaccagtagcaagtggtcccatcgatttgcacgtcgtgttcaccaaaatactattttcggttatttttgtaaatagaaatgtttttgcaattttactattttctcagaccaaaatacccttgatgtagaccccacctgtcattccctctccccctctctttccccttttcctgtctcgaggacgggcgccggtggccggcgagcgtggcctaatgcacgtcgtcgagctgctcctcggtggcacgggggcatccccggcttggaacacctcgaatttcgagaagcacgggcaggggaagggcacttataagcagcgcccggacgagcgcggcgttcccgttgccggcggcgaggaagagcgcacgccttgagccacaccaccccggcgtagttcacgtccgcacgcccagacgcgagcagcttcccggccttccttaaaatatgcggnggcgatgctctgctctggtcttgctgagttgttgcttctgctggtccgcacatcttgaggagtaggggcagccagcgacaacagtagcagtggagagagttggggaagatgagttgctgttgctggccgaggcctaccagagcgccatcgcggatgtccgccgcgcggcgggggcttccgggaccatgggttaccccgagggcggcaggcgcctggatgacgagcccgtcacaaggagctgcacggtgttccgcggcgaggagacccacgtcgagcgcgtgcgcgaggtcaatggcgaagccgacgtcgagcaggacctcggagatgcggacagtgatggcgtggactacctcagcggcgatgaggactacgtcggtcgcgagatccaccggccactgcccgcctcccggccgccggccactgcccgcagcacgccacccccaccagccgacggcgtcatcgagagaggaaaagtggtaagagagagggaagagactatgacaggtggggctcgcgtcagaggtattttggtccagaaaaatataaaattgagcaaaaacatttttatttacaaaaataaccaaaaatggtattttagtgaacaccttcaatttaggatggcattccagtgaatcactttgaagcggtagcatttcagcgaaaacattcttttatgatagtataatcccaattttctccctacagagaaaattgggattaaaactcccaattcatcgctgctcccctccagcaccgcgcctctcgcttcctccgtctctggtcgcgcctctcgctgcctccacggctccaccccatccgcgccgctcgctgttttcctccaccgcgttgtctctatccccaccggcaccgctcgctgcttccatgcatcgctccgcagctccggcaaccggattagggacggaagggcgcggggaagacggagaggagaggaggcagatgaggctgccgcagccgccgccgctcaaagcgtccagatctgggtcgtcctctccgattcctcctgctttctctcatccagcatgatcttgtggctataagatctggcggcggtgagctcgggggcgcctgatccagcaacccgcccgctgtagtcgttgaagaagagggtgaaaaccctcaagcggctagaggtagaccaaatattagtttttttaattggtatttttatttgttttttaagcttttgttcttgttcttggctttgtggtggtagtattaaagctatgaaactttgggacaattattccaactttgggaggattttgttaatacaacttggttttcctttctttgattctgaggatgcaaacaacgatcggggttcaggacgatgggcgcgatgggatttgttcttgactgttttatttatttcggattcttttcgatccgagtaatcgggtatgatgcgcaggggtggaggggatcgtgagcaatgcggacaattagcgcttacacggacgaaaaacaagtgacgaaaggaaaaatacgaatcttttaattaggttattagttaatataagatataaaaatacgaatcttttaattaggttacccaagtcgggtagacctatccctagcagatctccctactcccatccccgccggctgccgccattctgttgggggtgctgggtgctcctccttcccttctccggcttggcgaggtatgccctttccccgagatctacatccactctctttccttgttctctctgatgattatataaggctgctcacttgatgccttcttgccaaccctgcaactatacgctctcctccttgctggaatcactcattccctcacaatagcagctgtacctggacctaaggtaggcctgttttttccccttcccttggtaaacaaatctttcctgtttattttgattttgattttgatgatttcatccttacttcttggtaacaaatgcttttcgtgttgtttattttgattttgaagttcactccgataatggccctctcccggaggtttctgaatctaatcgtggacaacggcttccctggatccaaatcgctgcgctgcatcgacctcacgctctagaatttcttcaacgctactccaccgaatcggaacggatcagagtccaaagttatcgcggctgatgcctgcatccagaagcagaagaataataataaggaggaggaggaggccggcgcaagcagcatggatagtattcaacttccaagacccatcttcaacttccaagcttcaagtgtggcccatcactgggagattggatgcttcccgcttagaggtcgcgaggtgctctgcatcgaccagaatgggtgttgttttctcttcgacggagacacacgcaacgctgttaccatgcccggcctctgtcagcccaagcgattcccactctccttgtttgtccccagcaccggagttgataatgacagcggcagcctcttcatcatggagtctgttgttaaaccgaagtcgacaagcagtgggccgcgcagcgatcagtttgaggcctttgtctaccgcacgccctcccctcgccgccacctttcgtccacctgccaatccctccctccaccccctttcgtccgagaccccaaattctccaacatacgcaccaagatcacctcgtacgcagtggttagtggtggctctgagatgtgcatatcggttgaaggggctggcacttactgcatggacacagtgaagcatacatggaggcatgtcggtgagtggatcttgcccttcaacggcaaggttaagtatgtacccgagctcaagctctggtttggcctctctgccaagaccaaccacttggctgctactgacctctccgccatggacgacgactgcttccagcagccagagctattgaaaacttggatggagctttccccacccaagaattggtgggatttatccaactctcatcttgtcagtctgggctctggcaggttctgcattgcaaggtttttctacactcgccatctcatgggctactattatgatcaaatagttgataatcgttttgttgtcttgactggtgtcgatgtcgtgccgtgtgtccatgatactagtagtggcattgcaaatggcggcacgggggatctccgaatgatcaagtatgagtctaaacttcacgtgcctaatggcagcggtgagatcgagagagtgttctgaataatttggatcttgcgttcaactctcttatctattactccctcaatctctaaatatttgacgccgttgacttttttaaacatgtttgaccattcgtcttattcaaaaatttaagtaattattaattcttttcttatcatttgaatcattgttaaatatacttttatgtatacatatagtttacatatttcataaattttttgaataagacgaacgattaaatatattaaaaaaagtcaacggtgtcaaatatttagggacggagggagtatgtagtatgtctaaataattttgggactagggctgtaaaagacatctgggtattccgtttggtttggtagtgtgtattatgtcctattttagtttcgtaatttatttctgagatattgatgttttcttgcacctacggtaggaccctttccaaattagtaaggaaccaccgtgct

SEQ ID NO: 6459 - DNA, 4030 bp, Oryza sativa
  unsure (1)..(4030): unsure at all n locations
tatggttananatagatctctnnnnnnnnnnnnnnnnnnnnnnnnnnnnnnnnnnnnnnnngtctagtcaatgaatcacggcaacgttcggtagaaacctatccgtcgtatcttgatggatggcatgttcccggatgacaagggatagagcattcttcttaccgccgatcaccctgcccctaaataaaggggatcggcagcactcctagggggttaggcactctcttcactcaacactcaatacacagataatccaccaaacaactggactagggtattacctatcctgagggactgaacccgtataaataagtgtcaccatttttttctagcatctagcgcaccctataaattttattgccgatcttagaaatcgacacaagtgctaggaggccctcgtactccaattatacttatttcaatttcagctgaaattaatgagctcacatactcctattataagtaaaaacttgccgcattattatgcagtgttctaaggtcatacaatctgcagttttgcagttactgaaatgttcacagattcaggcaactcaatgctcagcaagcaacaacaaccactcatataccaaattagacatttgcaaccaggttctcatatatccctgttcagcacatcagaactgctgaataatgtttcacctttttttatgacaaaaatcaagattacataatcaatttccacgatacagaacctgagaaccacacaatacagaaccacagagcaggggcaggggcatttcacaatacagaaccacacagccttgggggcattttcgcaaacacctcgcggacacaggaaacggtgcagcgttctccactggacgaagccgtgcgacggcgtcccccctcgccggtgacgaagtgggtgactgaccggtgcgggctcgtacgctgaaccccatcaacgagtcgaggccgccgaaattggaggtgcggcgcgggcggagtgtgttcctgacgaccggtcggagcaccgcggcctcctccacccgccgggctcgggatgtggccctgcccgcctgcatcagcgcgccatcagccctgccggccggccgcctccacgcacccccggtcgcagcggcagggcagggcggcctggcgcctcttcggtcgcggcggcggcgctggcggacgccgatctggagcgaggtgcgaggccgtctcaggccgcgtggcctcctgttaggcatttgttttgcctgcgtgcgggcccaagtaaagcagccgttcgattcggtttggacggccaagatgcacgcagtgtcatcctgtgacatgcatatactaaagctgtgtttgtttcaattaagattattgtaatctagattattgagccagattactataagctggattataataagccgacatagaataaattgttacctgtttgtttctctggattattagttgtttgttagctgttagccacctaataatctaaaaaaacacctttagagtggattatcatattatagtaatgtggcttatagattataataagctatcacaataagctatctgtttgtttcaacttactcctaataatctagattataataatcctaaggtggtgattggatccagggactaaactttagtccctgtcatatcggatgaatttggagtattaaacataggcaacttataaaactaattacataaataagagctaattcgcgtgacaaattttttaagtctaattaatccataattagtgtatgtttactgtagcatcacataggctaatcatggattaattaggctcaatagattcgtcttgcaaattagtccaagattatggatgagttttattaataatctacgtttaatatttataattagtgtccaaacatccgatgtgagagggacttagtaaaagttttagtcccatctaaaaaggctaaggccctgtttcttccagcttgtgattattataatctagattattgagtcagattactataagctagattgttataatctgtattagaataagcggttagttgtttctttcctagattattagagtctagattattgggtttgcaagtctaaagaggaagtggggtggcatggtgggtaatttttcactcaataatctaaaaaaaaagttcacctaaatgagcttatcagattataataagctgagcttcaaattataataaactaatttaataagttatctgtttcttttagattactcatgataatctggattataataatccagaactgcaaaccacaccccaccccccccccccaaaaaaaaaaaaaagcgcaaagcgacgggaggtcggagcgagcagagaagaacgcatttgattcagaaatctccatttgaatctctctcgtctcccctcgatccctagcttcctccctgacaccatgctgccgtcgcacctcaacggccactcccccctcgcgcgccgctgccctcgcctctccgccgcctcgccgccagccaccggggattccgatgcggcggcggcggcggcggacgctccgctggcggagcacgaccgcatctacttccagtcatactcccacatcggaatccacgaggccatgatcaaggtaagccgccatgcccacatccgtacccgattcagtcgccctcttcgtacaaaccctaaacccccacaacccctgggccgacccgtgttgtgagtccgaagtcgcgatttggtggggatgacgtgtgttccgtttccttgggcaggatcgcgttaggacggatgcttaccggtctggcatcatgcaccaccagaagttcatcgacgggaaggtcaatgtgctcgccgaattgggggtggatgattattgcgtgctgttgggattggattacaaatttcggtgattgatttcgaaactttatgctatgcaggttgtgatggatgtggggtgtggaactggaatactctcggtgttctgtgctcgcgctggtgcaaaatgtgtaagctacaaaatccctgtgctgagatgattggccaatttaaatgcatagcataatgtttggatcatgcttgcaaaactaatttgaccgtgctctctcatccagtgaatcctactttagtgtaaagaagtacattttgtgctgattcagaggtactagtatagttttgcatgcttgcaaattgagcagcgataagtgttgtaagatggatttttttcaatgcttcattttgttgtgctatacaaaaggaaaaaccagctcagttcttgtttgtgaaagaaaaacagcttttaattttatcatttctatgtcctaacaaaagtgacatggatctgtgtgtgctaactaactgatggcagctgtgtttttccctgattcaactagatgttaagtcttgtagtatatggcactcttaacgtatttttctgttttcactggtccatttgtctgccttataacagtgaactttttccatgtgtattcaaatggacttacaggtgtatgcagtggaagctagtgaaatggcaactcaggtaacattattttttaggatatatactctaatattaaattgtattctttccatatcttgtttgttgttcttttgttgtttatgtgtggaccatttttttagttatacaatataaggacatagaatacacggttgcaaaatgacagcactcaagtgtattcatgaactaggtgtttgtagtggtatccataacaaagattgacagtgaagcttcctactcatcttctataaaataccagttaccagttaatactaccagtcacaactcacaagagagtatataacaatatattaaaatagtgtattgatcttgatctttgcagatattgaatattagtgtcatatttatagtaatctagcggatcatactattttgaaaagtaactactcttatgggtatgctgcggcaaataaatgtactcctttttgcgcaggctcgtgaaattgtaaaggcaaataatctggatgataaggtcgtcgttgttcatggncgggtnccgagacgntgtctaccngcacgg

SEQ ID NO: 6460 - DNA, 2239 bp, Oryza sativa
  unsure (1)..(2239): unsure at all n locations
tctgagtcattattgtttgaaaatatatttacattagtatttttacatctttactttttttatctgcatttttttaacttacactgaattgacagtgcaggatgttgaagttgaggataaggttgatgtgataatatcagagtggatgggttatatgcttctctatgaggttcattcttttatatggttgttttttgcgtcacaatttgatattctcttatcttccctagttctatctccttctgatttctctagttctgttttcgtctgatctgcagagtatgctgcctagtgtcctgtttgcaagggataaatggcttaaacctggtggtcttatccttccatctcatgctacggtatataattatcacatgtcattttatttctcatgcatgtgcatataaaataagatagacctagagaaaaaaaatcctacttttgcaaccaatatcttacctatcttacatgtgcatacaaattacagaacagttctaagccttggcacaaattgcagaacagttctaagcctgattaactatgtatccttcttttcgatagctcttcatggcacccataacaaattctgagaggtatgaaggaagtgttgatttctggtctgatgtctatggcataaatagtaagttactattgttttgttattagagccgcattatgcatcacattcaccatctcatgttggatgctgatttttgcacactataacttgatttcgtgcttgtactgctacagtgtctgcacttgtgccacttgccaaaaagtttacatcggaggagccctccattgaaataatcggtggagagaatgttttgagctggccatttgtggtgagtcttcacaagactgttgtggataatacttttcaaataaataaccatatttacctgttgaggcttattaacttctttatgtctacttacaggtcaaacacatagattgatacacttttaaggccgaggagctcaaatctttcacaactaaatacaaagtttcatccatgatgttaggtgaatcgtctcttttcctgaataatattattcctaatgccgaatctgctatttgactcgaatctataaaatcttcttcaatcttcatccacatacagtttatcatatgaaacatcaatgctcagctgcatttttcaatgtttattcagttctgaaactactgatcggtctttgattgctcatctttctgtttatacaccatacatatcctatcttaatttgctgatagaaaatatcttccatgtgaagctcccattcatggctttggtttatggtttgaagtggagttcaatggcccttcaaatcccacagacaaatctccttccgatttgaatccactcgatgttattcgtaagaaaaggcgccgaggatcagaagatccagtggtgctatccacagccccagaggatgagccaactcattggcatcaggttctgatttctgaaaatggtgttatccttaattgatctattcaatatattacgctattcctgctcttcttggtgtaaatgtgtaatatggtcatttcttgttctgcagactattctgtacttccctgatcctatagaggtgaaacaagaccaaattatagaaggctctgtaaaagtgtctcagagtgaggaaaacccacgttttctgaatattcaactagattgcacgtaagttcttactagagattgctattttgtcgtccggctcaacacagttgctcgatagatgttataatcttgtagttacatggattcagatttagccaagctacacaagcactctgaattccttatagcatgctctgttttgaattttgtccatggtgtcaggatgtgaattatgctgcccatatgggcgattgaaatttgcaaggatgataaattgcatacattgcctgcttgtgcctctagcggatcattttgttggattctgatatagaagtccctgtttcctagcaagttcgaatttacatttgtgtagtactatagcttgatttagttcattttgagctttggtgcaagttttgttttaagcagctgtcctgctgtatgtatattctaacttggtacaagttttgtttgtgaatgaaagttatataatttctcgctttccctctctgacgctatgtttgtgtacaacagcacgggaggccaaacattgnnnnnnnnnnnnnnnnnnnnnnnnnnnnnnnnnnnnnnnnngtagtatcaatcaagcgccgg

SEQ ID NO: 6461 - DNA, 2074 bp, Oryza sativa
  unsure (1)..(2074): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaaagatggcaaaaatggagcgaggctgtttttctcatgaaccaaaaaggctccagcataacctttgcctgctgtgacattgagcttttactttcttgagacgcttgtactttagtcattgcctcagcctgcacaaagtgagcctttttttttttgttggtggtgttccaactcaaagcgaccaatgtggttgaattggaccttttggtttcacccaatcgtgaagcaggatgtagacttaagattttctgtcagatagattgacttaataaatctcgtgatattcttctttcgctgcagtaataaactatagttaacgtgcctgtagattaaagctgctgtagccatcgtaaactttaaccccttgaattcttacttcccggtgttgactggtgagtgctgacagtcaggtgctttgagcgtgcagtcgtgcgtgtgttcacgtggatgcgactgacactggtcttaatttactaatcttttccctgacactgctctgtttgaagtttccagataaattatgttaagcgtgatcttacgtgtgcatcatttcccgcagcaaatggctgctagcgttgtctccacatctgcacaggccacaagcccacaacaggtcaggttgaaatgcaaaagctgatgtgctacattattgttcccaggacatcacccctaacgcaagcaaagctaacaaacttgttacatttgtctgcaccaggggctgtattatcatgcatacagatacagtggtagaactgaacctgtcaccaactcaccatgcatggttaactcatcattcttccaacttgcatgcattgcacagttgcagtacatattacagtacttggccatttgacaagttcagaacttcaggaaaggcctaatagctgcactttctctggacaatacttcctccgtttcacaatgtaagtgattctagcattttccctattcatattaatgttaatgaatctagatagatatatatgtctagatttattaatatcaatatgaatgtgggaaatgctagaatgacttacattgtgaaacggagggagtagtatctatctatacataatatgtacggtcatactccgtatgtgcccatacttggcaagcacgtgtgtgccactcgaggggtatacgtgctacatgtggagtagtaaagtataggtacttggtagcctgatagcgagtacgagtagtgtactgcttatatatacttctagcatgtattgggtccgaagccgacgtatccgttggctgagtcgacggtgatctggatcccttcctgctgtatgttccccaggatggagatccccgacgacgacggcgcgaacgccaggcagaacacggtgccgacgacctccaccagcaggttcctcgccggcagcgtcagcacggcgccctggtcgaagtagaacgacacggtcggcacgcgcacgctcgcgtacccgctcaggtcgtagcacgtgtcgagcagcgacaccgccggcgagcgcgggagcgcgcccatggcgccgtcgaacgcgccgagcagcgcggcgtacgcctcccgcgggaggcgcgtcacggccgt

SEQ ID NO: 6462 - DNA, 1955 bp, Oryza sativa
  unsure (1)..(1955): unsure at all n locations
ccgccttgaattgcanatcgtcattnnnnnnnnnnnnnnnnnnnnnnnnnnnnnnnnnnntcgcctatagctagcactagcagatcgtctcgacgtgccttccatatgagcatatacagtcataacatactgctactgcaaattcaatcgacgaccatgaccgggattattcagagtttcagaccaatcgatatcgatacaatgccgggatttgctgagcacaaggtcttcgatccacaaaggagacaagcggcataatcgcataatctcagggaggattattggctattgcagaacgagacgagaggaagtcgtcgttcatcatgtgcgatttactccgtagccgccaacctatgaagattatcataatagtagcttttctgctcgaccacgaccatgcagattggcagatatgcagacagatcgatcctccggtcacgtcagatcgagaccaaaacaaacaagaaaaagcctactgctagtaatttagtgccaggtaaaagaaacatcccggcgtacggccgcatccatgacagtatgcacactacactattctgttctcctccatcttgccggccggccggccgcaactgccgccgttgtcgccggcagaaaaagtactgaattctgtgtaattgtaccaccctcttcttctactactacacatgtgttacctgaagggtgagtagcagcagtagattggattacttaaagggcaaagcgacaatggcttgccggattgtgcagggacaggcaaagatgcggccttccgtggcagggacagccaaggataacatcataaaccaaccctgttttttataactgaacttgagctctgaaacactgaacatagagaggatgtgagaagctttttgttgttgtgcctgacgaacggcgaggccgaaggcatgcaccgaccacatctcggtctcctggctcccgaaccgcacgcagagggctatcctgcgtctgcctcctgctcgcgtcgcggtttcgccataaacaaagctgtggtttcgccgggaggaggcaaagcatggcgagcctgaaagttcttgattccgtacgggtcgaatcgtgttgccggcagagtagtatatgttacgtttacaggtctttgtgtcgcaggatcaacacaacacgatgaagaacagatccagatcagtctctgaattatgaacagaaagtaaggaaaaaaagttaaggtacgtgcgtatgttccgtttctgaattctgacacaagaacagggaaaggattcacaaggctcacaagacaaacaacacatcgatccccaaattacacagaaaaacttcatgtcaatgtggccgatctcacacagaaacttcaggtcaggtggccgatcaattaatgaccatgaacgcactcaactagaataccaaaatacagagacatgagccacgcagttacagatatactccatatactacagatactgagcaatgagaatgaaatgtacagagtagagcaatcgaggtatcaacgcgggcgtcgaagtcaggggggatgcaaatggcaaatggattgagaaccaaggtgctgtctgtcactctgtctacatgcgggtcatgccgatgccgccgacaatgggcgggggcacggcggcggcgtggcgggccttggcgaagaagaggtagtggagctcggcgaagagcgcggtgaggaaggtgaaggcggcgccggcggcgaacacgcccttgcgcagcatcgcgcagcgcggtggcccgctaatcaccagcgtgctgtacttggtgtggtacgcgttccgcaccgaccccgccagcaggcacagctccgcgatcacgaacgtgaacctgtccataaatccacccaccatcatcagctcatcaattcaataaaagcaattttactnnnnnnnnnnnnnnnnnnnnnnnnnnnnnnnnnnnnnnnnnaatagctaaatcaaanggacccc

SEQ ID NO: 6463 - DNA, 4848 bp, Oryza sativa
  unsure (1)..(4848): unsure at all n locations
ctggctttgatgtctaattctatgctngcatgccngcaggtttactctagaggatccccctacggaggcaacgaagaaggggagctagctagctagcgtgatatgcttaattgctgattaaattaccagcagacgatgaagcagaatccggagaaggcgcgccaccggccgggggacagcgcgcggccgcagcagaagcagcgggtgaccaccatgacgacggcctgcccggcgagcagcagcagcagcgccccgatgccgtaccccgtcgccgcgtcggagctgtacacgcagtactgcctgccgctcgtgtcctcgctaaaggtggcctgcatcgttcccaaccagctccctctcgtcagacgacgacgacgacgacgacccatagtatggatttcgctagctatagctcaccgtgctccggcgcttctcggcgccgatggcgaggacgaaggcgagggcgtcgaggacgaacacgaccaccacgaggattatggacgccatggatggattcgaactaatttacgtacctcccttaattaatccaacttggactactgattcgtgcagcgagcgagccaagaggagctctcactttcctcttgttgcagaaagagaggaggattaggacaagcgagctagggaaagatgggggcgtcaaagacgagaggaaagcttagcagcaagtcgagggagatgaggcgatgcaccacgtacactgctgctttggtagccggtgaaggtgacatgtttcactctaaccattctcgcgactttggtggttctgttccactggcacctgcctccggcctctagctgaggctgacgcgtgggcccccccggctcgccaccaaagtattcggcgtggatgattggaaacggtaggccagtgggagtgggatttggatgtgctatcatatgctcatgtactcgcattttggcttttattaaagcaggtgtggaaaatatttttcccctttaatgtgggttagtaattaatttgttttgcaccaaggtcagtaaaggaagcttggtggcgcaggaggaatattttgtttttcctttaactggaccagttatttctaggcacctatgtttttttattatcgaaacctagggtttgttcgctttattaccaaattcagcctgattttattagattttagtagcgttgatgcattttcaaaatttggtagcgtttttataagataatggttttgaaactactagaatttgattatatggtgttggtgaggtagcgtttagtttattaccataccaaatttgaaaaaagtggcgataaagtgaaacggccaatagaattcgttccgatcgtatggcctgcagctgataattgctgtaaaattgcacgtccgaataattttggctgaaaagcaggtacaggaaatatttttcattccatctacgtgggcgagtaattaatttgtgtttcaccaaggtcagtaaaggtagcttagtggggaggaatatttgttttacctttacctgcgatcggacattaaccagttactcctaagcactgcctcctccgttccaaaatacttgtcgctttaagtttttgtttgtaatttttatcatttgtcttattctaaaaaatatgaaattattatttattttgtttatgatttgctttattatctaaagtactttaagtatgacttatcattttttatatttacataaatttttcaaataagacgaatggtcaaacgttacaagaaaaatgttaaagcaaccactaatttgggacggaggcagtagcattgtaggagtacgtttttttttccttaaaaaaaatcgaaaccagtactgtgtgttcgaccgtcacaacgtctaagtccctatcgtctggcttcatagttaaaacttttttatatatgctatttgcagtttaaaagccaattttaaaagataaaccatagtaaaaacctcagatcaacactaatatcaagttttaaaattcagattttaacggtggtcgaaaggcaaatgatgagcttatgctagcaaagcaaaggtagttccaactacacgcataagaaagggtgtaaccacagatgcaaagctgagcgctcctattgctaagaagggcaattaactagtagtgctttgctttcatcgggcaattaactactagtgtttgcgttcatcggccaactaacaagaggttgattgaaaccagggataacataattaaaaagttcatcaccaaaaataaagcgtaattaaagaaagtaagagcaacacagggacagctgaccgcaccggacaaccaaacatccacctcgtttcagcttttcttaccgcgaaaaaaggatgccggtggtagtgcttgctagttgctactatactttgtttccgaccgaagaaaagctcagagcataatgttataattgattgggccttctttgtagcttcttctacttaatgggccagaagagagtctatattctttagattgggctgaaaactcggcccattatctcaggaagcatctagaagatgggctgcatccaaagagccgacccgtcctctttccagtggcatcgatctcgaggtatgtttggtgcagcttcagcttcgtcgctcaaccaaacaattttaacttcatttaaaattggagcggagctgggtgaagatctatcacaaaataaaccagaggtggagctgaatttatacagtttcaaagctccacttcagacccaacttctaaagctaaatttaggagtaggagttttaccaaatgcctatttggtacagctccaactcctaaatttagctccaagagttgagtctggagtggagttctggagctgtctaaacccagctccacaactctagtatattttgtgacaaaaaaggctccaaataggccatacatattggtcttcagtatacagcactacagcacagctagtcagccactgtatacagcctacttacgtatggtcttatccaaatgtacatatatgcaaatgcaattggctttgaagcctatcatgattcagtccaagttgcactaataattggtcatctctgtgcaggttaattatgcgaaagagaatcttaatcccaggggctttggttgcagtattgcacacggaagcaattgtaccagcgcggaagaatcagatgcatccatggatgggattatggaaggagaaagtgatgctagctacttaccagcaggtgatgaagcagaagccggcgaaggcgcgccaccgccccggcgagagcgcgcggccgcagcagaagcaccgagtcgccaccatgatcatcgcctgccctgccgccagcagcaccagcgccccgatgccgtaccccgtcgccgcgtcggagccgtagacgcagtacggccgcgcgttctggtcgacgttcacgtacgccgcctgcatcatccaatcaacacacacctcctcgatcgtcagcacgcagcagatgatcgatcggcttcgtctccggcgacggcgatggcgacgacacatgtatgcatcaacgcgttcgagagctctcaccgtgttccggcgtttctcggcgccgatggcgaggacgaaggcgaggacgtcgaggacgaacacgacggccaggatgattatggacgccatggacatcgaatcgcagcaagaatcagtcacctagctaagcttcgaatatagttcaatttgcaggttttgtggtgcaagcaaagctcactttcctgtggttaatcggcagcacaaaatgtggattaggacgagagaatcaaatgatcagagctagctggaggcgatgctgctgctactgctaagcagctatccgtgaggttgacatttgaagacgtgacatgtttcacttcaccccgttcccgcggctttgtattttgttaagttttcctcctgtggttgacgagtgggcccctccatgatgaactgatgattaaccctgcgatattcggtgtccatgattggaacttacagatggaccgacgaatactcgaatctcagctttaaaatatggaaataatttatatatcttcattgtggacgaagaatttgattcattttgattaaattgcactgggatgatgtgccatgtaacaacaaagaaaacagagcaacacagtgacatctgaccggacacaagcctgggaaatatattactgggccttgtatgggctgttcatctaccaatatgggccaacctgggaagtgggccgtgctctatactgagctgggccaacaaaccaaccaacatgtagaagtctagaagagggcgagagacatggaaggcgaattttttttatttataattttttttattaaaagttttacaaaaataattttccattttgaaaattgacggaaatagtcgcctaccgccctctgggagggcgatttttaaaaatcgccctcccagagggaggttaaaatgacgtggaagacggatgttcgctctttggcgatagccgttaactgaatatgctggcggtccttttgtctgccctagcgagggcgaaccttttcgggcggggggcctgattaaagattatgctgaagggttaattggtaagatagagactactgtgtgccaacacacttgaacatttgaactggtccttgttatacatattgaaatattcaaaaattatgtggtcggtaccaatggaaggtatgcttagatagttttttaaacaaaggttcttttccccatttgtataatttgggtggtgcaggcgtgctttaatttcattgtaacttgattaaatcaaatgaaacattgcttcctcgtgtcctgaaaaataggtgattggtaatgataatttttatccttgaaaggatacatatttgc

SEQ ID NO: 6464 - DNA, 7898 bp, Oryza sativa
  unsure (1)..(7898): unsure at all n locations
cgaagaaaaatgcgaaggggtagcaatgtggattatcatcgggaatacatagacggtttatacgtgagtgtgtatcaagaaccaggccgaaaacntgagtatgtcttatggccattagtgatcgtctgatctagaagaacgtgagaacccaacagtactggattgacgagaggtagatttctttaaagagacggggaaagtcactagatatagtataggagtgaagaagatagataacccgacttgtacaaggattagaggagagtgataaaatgtatggggcnagggaaagaggaaagagtggtggtgttttatatatataaggatcaggaaaaggagagagcgcaaggatttttacttgtggtggaaatatatagaaggatttggagggaacgcacctataccaaggcaattgtttatacaaggctcacactaaggtggacgcaatactatatggtatacgggataatggcttaaagagatccggaagatcaacggagtttgcattaggaacccagtccagccctcttggaggccaatcctgtagcgtcttgaagacctccttgcaaatgggcggcgaagggggagcatggaattttgcaggcggcccccttccgccctcggcgagggcgattttgtactgtgcggggggccgcctgcaaatgggcggcgagggggcatggaattttgcaggcggcccccttgccgccctccgcaagggcgattttgtactgtgctctatattttttttatataaatatcaatagttatcaaatctttttatattgaaaactatacaagattaaaatctccaagattggtaaaatacaattttattattttttagggcatatttggattgttaccgtacaaatattttgttaatgccaaaatataagcaagttttagggcatatttggattgttagtgccaaatttttcttcactaccaaatatttggtaaggtaaaattgcatttgatcatatttggtttgctgccaaaatgtaaaattgtagtgaagaatgttgtacataatctcaattctagattacgtattaccaattaataggcttctattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtacccccacgaagtagtctcggtcacggtgcgtgggatacgcgtccgtgacagcggcaacgtgcggctctggggcgtctggagtgaaggtcacacgcgcacgagtgcgaggaaggtaccagtgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctttggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtcacaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctagaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcccacctgcttctgactcatccatatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccggactcctcgcattacccagttgtacacttctgccaaattggttgtcattatgccataccgagatccatcggtgtcgaacaataaagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccattacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaacaaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatatatagtacaaatgcaaaagatgtatgggagcatacctgtgatgaagtgagcgaaccagcagggcttcgccgctccccttctgctgccctcccctctctctctttcgntttttttggatttttagtgaatataatgaaatttcataggggaggggctgggctttataggggggaggcaaaaatcgcccttccggagggcggcaagggggccgccttgaaaattccatgccccctcgccgcccattttgaggcggcccccccgacagtgcaaaatcgccctcgcggaggcggcaagggggccgcctgcaaatttcattgcctcttggcggccatttga

SEQ ID NO: 6465 - DNA, 1717 bp, Oryza sativa
  unsure (1)..(1717): unsure at all n locations
cgcgcatttgaaaacctattnnnnnnnnnnnnnnnnnnnnnnnnnnnnnnnnnnnncttgctgctcggaggaggtcggggggaaggagcggcggcggaggatctcgggcggagtcctcttatcgcgattccgattcagaaacgctctgaatttggtttcttctccatgttgagcttcatgagccctattagtattttgtcttgtttggtggtgaatggtataggtaggggagtttccagtgcttgctatctgcgcccccattactcttttaatgttgcctgctggttaatgcccaatggagtttccttctctatatatatattgagaaaattcatagttctgagttctgattgactggctcatatagcaatagcagatctgtttttgactgcttgaatgatggaattgcatattatggtagggcttctgttgcataatcaggcagagtttaacatggttgatatcaacccagattctgacggtgcgtgtggtctggtggcaatcctagagacagtaaagttgatgatctcatcataagagatggtgagttactactagagtgcttttgctacctttgccttcattgatgggtgtttggatttacggaatttacttggtgctcactttttttttctcagaatcacaagtatttcatgaaaacatctagatagggtttgcttggtactaactcctctctagtttattcctgaattagataaccggtctgatcctcaggagccatcaagaaatcctggcatttggcaatgcaccatttgcgaacacggaaatgatgcaaaaaaaaaatcatgtgagcaatgcggtgttcttcgatatttctcgctgtatttcaataatgcccttgaagttgatggcagaggtatagtgtattccttgttgttccattccctggtatggttagttttttgttgcactgttgacttatggctttgattagatatatttatgttttctagcctgttaatttatttatttttctatcatgacatccagctaaacggagagacaagcattatgcggtatctgtactggcaagaactcttttctcaccatccagtgccaagtcaaaagacgttgttctttctggtggctttaaagctagcagaaatgcaacaggaagtacacgagctacgttggatgcgctgcataagacatacatgacccgtaaagaacgccacattaacataggtacactgcatttgtacatcaagcgcttttggtaatttgatttgtttaatttatggcattatccaaattcttgtagttatatgtacttgctgctatatataaaccagatatttaatgttgtatgattctatatatgctagtcatttgcatagcttaactctcaattgcctcattgtgcatctggtgtgactaccattttgggtgtaaaattttcctgtttcaaaaccaagtgactgtctgaactataagcttagctagcctgccatggtccttctgcaaacaaacaaactgaagcacatatgtgggaggtagcttacaggtcttgggagtttacagggttttatataatttggtttacctgaactttgaaatatgaagatagtcagtggtaaattttaacctacttatgaatgttccagtctttcccctgaattanggtaagcatttcaagtgacccgttgtttttccaatgggagatccatattgttgacctattgttcatttatttatn

SEQ ID NO: 6466 - DNA, 2967 bp, Oryza sativa
  unsure (1)..(2967): unsure at all n locations
nggtagcaatcagttganccgtgtttttccaatgggagatccatatgttgaacttatgtttcatttattattagacttcctgatggagaaatctgtaatatgactgcatatcttcatgttcacagtgcctttcaagtttgatacaccatctccggatgacgtggtcgctacaggactaaaatcgtcgagaagttttagaaaaggtattatctctgcattcccccactcccatgtagttagactaactcagactagtgaaaaggatgcatcttaacaacttaacattaacatctatatgtgaaacctttattttcttttctatgcgcgagtctttgtggaaccttttcagttaattagtttgattagagtttatgctgaatgagttagtctggtcagatagagaactactgtgtgccaacacacttgaacatttgaactgttccttgttatagatattgttattttcaaaatttatgtggttggtaccaatgaaaggttatgctaagatagttttctaaacaaagtttcttttccacacttgaataattttggttgtgcagtgcgtgctatagttccatagtaacttgattcacatcagttgacacagatgctccccatgtcactgaaaagagggtgatggataatgatagttctacacctgagaaggatacaactgcagactcaaatttgcctgtaaagtcgaatgaattcggtgaaagtagtgagagtgtttctgttggtagtcaaaatgaaacactttgcttggaccatgagctacagcatttgagtttggagaggaagtcacaaaaaagtaaagccaatattaaaaagccagtttcttcatccctgtacaagccagaaccatggatgctccagcatgaagatgaaggcatccctagacaattaaatcttgctattgtaagcaactacatatctatatatacacgatatatttgatgtatccatcattttgcttattacttgtttgccttctatctgcctatctttatgaataactcaaaccagaaacatgctaggttggccatgtcgattctgggaaatcaactctatgtggtcgtttgttacatgccctggggaggatttcaaaaaagcaaatgcataaatatgagaaggaagctaaagaaaaggttctcttattttaatgattgatgttatctcagtatgtgccttttatgcatcttgggagctgttcatataaacgtttcttcttccaggggaaaggatcatttgcatatgcttgggcaatggatgagagtgctaatgaaagggagcgtggcattacaatgactgtcggtgttgcatactttgacaccaaagattaccatgttgttttgctggactcccctggccacacagattttgttcctaatatgatatctggagcaacacaatctgatgcagctatcctagttattgacgcttctataggatcatttgaagcaggtatgggcatcaatgggattggacagacaaaggagcactcgcagcttgttagaagctttggcgtggataacttgatagttgttgttaacaagatgaactcggtggaatattcaaaagagcgatttaattttatcaaatcacagcttggtgcttttctgcggtcatgcggttacaaagactcagcagttgcctgggttccaattagtgcaatggagaatgagaacttaatgacaacagcttcagatactcgactatcatcatggtaatagatattccctatggtaaacctgcatatcccttgaccttaaaacctggtggttgttcgccaacgtaattgatgcatggtgtcaggtatgatggaaattgcctgttgaaagccattgacacattaccgcctccttctcgtgatgtttcaaagccactgcgccttccaatttgtgatgtcttttcgtcacataagctggggcaagttgcaattggtggtaaagtagaggttggagcaacccgaagtggttctaaggtatcaccctgctgttattctaagcacatactacaatacatttgtctttgtttcttatattgccttagtgcgagatatttatgtatggttgaacatcacttgtgttctaactatatcttttgcactgttttcgttgtcctaccacttttccgtctaaataatgttgtgctcaatgattaaataactatgcttttgcctgtaagatgttcaagcagtttcctgatttcatgggactcttggttcaaatcctcgccatgccttttggggagttagctgtggtgaaaactattgagcggaattcctctagttgcaatttaacaagagctggggacaatgtcgctattggtttgcaagggattgaccctagtcatatcatgcctggcggagtcatatgccatccagattatcctgtgtccgtggcttcttgcttggagctaaaaattttggtcctagatatcactgtaccaatactggttggcttgcaggtaagcaaaagaggggagcatatctcttcaactgttcatgcttcatttattttttaaagagaacttcaggcctaatatcgacaccttacatggtcgctacccatgtttctagtttgagctccacatccatcatgcgaaggtgtctgcaagcatggtgaaaatactgtcattgctggagcagaagaccggcaaagcctcaaagaagataccacgatttctcacctcgagacagactgctgtaatcgaggtaagcttacagcagatggatggggtagttttgttgctgatatcatgtttgttgtctctgtaacgcttggtgttttctttcaggtgaagctggagaaagaggtatgcgtggaagaattctcaaacctgaaagcgctaggccgagtgttcctacgatctcagggaaacaccatcgcggttggcattgtgagccgagtacgacagggggatcctctagggcgcccccgagcggttatacagttntcaatcccg

SEQ ID NO: 6467 - DNA, 744 bp, Oryza sativa
  unsure (1)..(744): unsure at all n locations
agccttgaattgaanatcgtcattctcnnnnnnnnnnnnnnnnnnnnnnnnnnnnnnnncatcaacatgaactaatctatcacaagttcacaatgtcacattttatgtaaatgcatttagctacaaattaattaaaacaatgttgggttggtacaatgcctttttatatatttgatagttacaaattacgacaagtcctacatgtcttgtttttgtcaacaggaagttgaacggtcgttttccttttggggaacctctgaaggtgatgctgtccacccagctgagtgtatgcaccagttgcttgagcaagtacggcgccataaagtaaacattgatgggaacgtttgtactgttatggtcactacattagttcttgaggtatgcttcaactgcttgtctcatgctccagtcagtcacttattatggtgtaacttaggccctgtttgtttcaacttaagattattgtaatctagattattgaaccagattactataagctggattataataagccggcatagaataagctgttagctgtttgtttctctggattattagttgttagccgcccaataatctaaaaaagcacctttagagtggattaccagattatagtaatctggtttatagattgtaatacagtattatctatcataataagttatatgtttgtttcagcttactcctaataatccagattataataatcctaagctgaatcaaacagggccttagatgtttttg

SEQ ID NO: 6468 - DNA, 3398 bp, Oryza sativa
  unsure (1)..(3398): unsure at all n locations
tgcagtgcnaggtagaacgcactcggacccctctcagaataggattttcttttcgtttccaataacaatttcagtgcaagcctagaatagttgtacatcttttgcgttgcgaggtagttccatctcattccaaggcctgttgtgatcnnnnnnnnnnnnnnnnnnnnnnnncagtcacaaagccaatgaaaatctttccaaatcaaggatccccagtcctcccaaatctctcggcatgcacacggtctgccagtttactagactcgtccccggtttgacgttctccggttcctctcccttccagaggaaagtccttctcattttgtcaatcattttgatcacccactttggggccggcagggcagtgagatagtgcaccggcattgccgtgaacactgacttaacgagagtctcccttccaactgatgagtaatatctccccttccaacccgggattttagatccaattttatcaagcagtgggacgtaatcgattttcctcgacttgcgcagatgaaggggcagacctaggtatgttgttggaaaggatgataaggtactcgggaagtgctggattacattgggggcattcaaatgcgaacatgcaatagaagaatctgagtcttttgtagaaatatggtctttaagtggtgttcattaactaagaaatcatatcgaactctatctttgtttatgcctaaagtttgtgttaaaaaaaatctaagtagtactagtcagatttctatttgtgttttaaatttatccaaaatcactatagaaaaactcaataaaactggcagaaaaacgtctcgtgcagcaagcaaaaatggcccaatgccccaatccgattcgtggtgcgaccttgaaaaattttgctggtgggccgtcggaaaatgttcgcacgcaaagaaacgagcgcacgcccattttctggtgtggaagtggaacagatgctgcttcctctgtgtagtgtactgtctgttgtgccaggctgctcccttcgtttgcgtaatccgttcgtaatttcatttattggcgtctaagaaaagagaacgagcttttctccttgctgttatctacgcccaatacactcatacgtatcgtaagcaggttttaccaaaccgtgtggttatcatgttttcgtggttaccatggtaaccgccgaaccgcggggtgcgtggtgaagagtcatggcagagtttgcaagttgatatcccgtgtttactgcttagtaatcagtaatcacaactatgaccaagaagctcataagagtgagatgctacttcgttggcatgctacttatcagctcatttctttcccttgtaccagatgttccgcgttaccgagcttcacctctccggggccggcgccggcgccgaacagggactcgatctgctccagcgacttgccgctcatctccggcacgaacacgtggacgaacaccacggacagcgccgagatggcggcgaacgcggcgaaggcacccgggacggacacggggccgcagaaggaaaggaacgacatgggcaccgcgccgctggtcagcctgttcacggagaaaccgagcgccaccgcctgcgcgcgcaggcgcagcgggtagatctccgagctcagcaccatgttgatcggcccgatccccaccgagaagaacgccacgaagccgcacaccgtcaggatgggccgcccgatcgccgccgcccgcggcagcgcgccgtgcgcgagcagggagagcgacgcggcgagcgcggccaggcacgcggtgatcccggccgtgctgacgtacagcagcggctttcgcccgacgcggtcgacgaggacgatggcgatcacgatgaacaccgcttggagagccccacgccgacggtggcggcgagcagctggctctcggtggtgatgccggcgtcccggaatatcgtcgggctgtagtagaccagcgcgtcgatgccggtgatctgctggaagagctgcacgccgatgccggtcaccagcatgcggcggatcaccggggacggcctcaggagctcgcgccacacggccttgccgttgccggtggccgtgacgcgcgccgcctcctcgatctcggcgagcctctcctgcgcctcgtcctcgccatcggtgaccttgagaagcaccgcgcgcgccttggcggcccggccctgcatgacgagccaccgcggcgactccgggatcaccagcagcacgaacgcgacggagatggaagggacgatgccggcggcgagcatgactcgccagttgatgtggtcggggagaccggagaaggcgaggttggagacgtacccgaggaggatgccgaggctgatgaagatctccgggaacgaggcgtacgacccccgcagcgtggccggcgtgatctccgatatgtacaccggcgccaccatgatcccgatcccgatgccgatgccggccagcagccggcccatcatgagcacggcgaaggacggcgcgagcgtcatgacggccgcgccggcctggaacacggcagcggcgagcccgatggtccatttccgaccgacggcgtcggacgtcctcccggcggcgaggctgccgaggagggagatgaagctgaggcacccgacgagcacttcttgctgcacttcactgatgtggaggtccttctggatgaatatgatgcagccactcatcacaccaacatctgaaaattaacagccacgatgtaacacaggatttgacaatttgtgcaaagatatttcatccatttgaaagtttgatcgattgttcacgagacaaacaatgtcaatggctgtctgagagagagactcagataaagattaacaaccataacaagtatctgaaccaaattaccggtcaaaatttacatttcatctgaatctgaagcagaatgggctgtcagtgatgataacttttcaaacactttcatcttctaaaagcatattaacatgacatacaatccccatattttactagctgcaaatcttgctttaatcagaaaataaacccctgattatgtgtaatacaaccaaatctgaatcaagaacagtcaaattcaggagaggggctcaccgtagccgagcaggacatggttgagggaggcgaagacagagcaggcaaagacgtatctcccgctgccgccgccgccgcggacacgaacgacgccgccgccgccgccgccatctccctgctcatccgggagcacgtcgtccatgcgcacgtacttgctcttcctccccaagaaatccggaaggctcctcatgccgccgccgttgcccgtcgccgcctcggtggcacgaagccccattctcaccgtctttcttgtgctgtgctctggctatggttggctcatcctcttctctcctcttgcaagctccaagaatgtggcttgtgaatgggaaaaggac

SEQ ID NO: 6469 - DNA, 3640 bp, Oryza sativa
  unsure (1)..(3640): unsure at all n locations
ccggcttganttgccntttgaatatcnnnnnnnnnnnnnnnnnnnnnnnnnnnnnnnnnnnnnnnnntttgcaaaaactatttttacaaatgaatcgttgccaaaacttatttcaaatctgactcttttgctcaacgccaaattgtgtagcgttgaatttagacacctcagcgccaaatagcatgacgctgaatgtacgttggcacgctgacttagtctcccatccgtcgtggcaccgcattcagcgccagctaacgtggcgctgagatgtctaagttcagcgccacatgatttggcattgagcaaaagggtcagatttgaaataagttttggcagcggttcatttgtaaaaatagtttttgcaaaaagtcaaattgtcaaaatttgtatcaggaatctgcccacattttcatggttgtgttattgtgtattcagtagtaaggcttagagtgaaattttggagctgtggtcagtcattttggcatgaacttgcacaattgctgaattgcagagtattaaacttgaggtatcaccttgttctgaatattcactcgagataattgctcttataccatgtggttagatgtcaaacttccatttggcataaaatttcttctatttgctaaaatatcatataactcactggaaattcgctctttttcaatgaatttgaataattcagttcagaatctatttacattcactgtaatggtttcatggatgtgcaagtgtagcttactagcattaccaactgtgactgattgactggcacagtggcaccaacatttacactgtatgattcgttgatgctacagaggattctgaagttggaaaagagtatgagatattttctttcctattagtgctctaaaacaaaacaatttggtttgcaatttgcattcaccgcaacaccagtatctagtaatactgttaaaacccacctaaaaaaatggccaagttcacattgatccatttggtcaataactcaagatcctcatcccttgtgcaccaggtgctcgccgttaccgagctccaccttttcccgcgccgcttcgccgtcgcccgccgccgcgccgaagagcagctcgatctcttcagcgtcttgccgctcgtctncggcacgtaccggtagacgaacacgacggacagggcggatatgacggcgaagaccgagaaggcgccggcaaccgagatggcgcggcagacggacaggaaggacatggccacggcgccgctggtcaccctgttcatcaccgcgccgagcgccgccgcctgagaccgcagccggagcgggaagatctccgagctcatcacccagcagatgggccctatcccgacggagaagaacgcgacgtcgccgcacacggtcaggatggcgacggcgatgccagcgctcctggacgccgacccgtgcgcgagcgcggcgagcgtcgccgcgagcacgacgaggcaggccgtcatgccgaccgtgctgacgtacagcagcggcttcctcccgacgcggtcgatgagcacgatggcaagcgcgatgaacgccgtcttgaagaacccgacggcgacggtggcgacgaggagctggctctcggtggtgatcccggcgtcccggaatatcgtcgggctgtagtagacgagcgcgtcgatgccggtgatctgctggaagcactggatgcctagcccggtgatgagcatccgccggatcaccggagacggcctcgtcagctcctgccacaccgtcttgtcgccgtacttgccggcgctcgcgacggcggcggcggcccgctcgatctcggcaagcctctccttcgcctcgtcctcgctgtcggggaccttgagaagcacctcgcgcgcctcgtcggccctgttcttcatgaccagccaccgcggcgactctgggatcaccagcagtgcaaaggcgatggacaccgacgggaggatgccgacggcgagcatgacgcgccagctgacgtggtccgggaggccggagaaggcgtagttggagatgtacccgaggaggatgccgaggttgatgaagatctccgggaaggaggtgaaggagccccgcgacgccgccggggagatctcggcgatgtacaccggcgcgatcatgacgccgaacccgatgccgacgccggccagcagcctcccgaccatgagcacctcgaacgacggggcgagcgtcatgacggccgcgccggcctggaacacgatggcggcgaggccgatcgtccatttccggccgacggcgtccgacgtccttccgccggcgaggctgccgaggagggagatgaagttgaggcacccgacgagcacttcttgctgcacttcattgatgtggaggtctctctggatgaagagaatgcagccgctcatcacaccaacatctgggaacaaaaggtttattaccacacagaaattgaattatatatgcattttgtgtgtaattatcttaaacttaatttttgcccgggtgcaatttcatcttaatgaaatcaattccattatcttaaaagaaaaagttagttctagtcaaatttttagtgtgttgctaaaatgctgtcgaaaaaaaaaaagctactacgagctagctgccgttgactgaaattagcatcgcgatgattccaaataagtggactattcgatatcagtagtgaatagaaatccatctgaacaaaacattgtgatactagttactactgattcttgattatgaagaaactgcattgctaattactaaccagttaactagtaaccgtagtttagactactcaacaactcctactaaacgccacaaggtaacagacatggaataagctggagagtcgccatcaaagaccgaagactaatgaagaagaaatagtcaacgcgattggccaaaacatttcctactccttgtgcaggatcaccaagaacttgccaagatccaagcacgcgtatcgaaattctccatcgattcagccaacacgaacacatatacgtgcgagagagattcatgtggaaacggaggagattagttaccgtagccgaggaggacggagttgagggaggcgaagacagagcaggcgaagacgtagcgcctgctgctgtggctccggcggacgcggacgcctccgcctccgccgccgacgccgtcctcctcctgctcctgcggcagcacgtcgtccatgcggacgtacttgctcttgccgccgaagaatccagggaggccgccgccgctggccgccggcggctcggcgccggggagccccatgccttctgcttatctgatgcgctccctttgctccgtcttcctcctctccggcgagtagagggcggcgcttcgaatggtactaatggtggtatcgcggattgctggatctgaggaggaggaggaggaagaagaagtggaggcagcgagagagattttataagtttctaattctgtccgcttttgagttttgacacgcgatttgctgttcaacgccaaagcggaggaggtcgaattttcaaatgggtcattttgtgttcaagcccttgtactactcgtgatttctgacaagggtactgtgggctcttggggcattgggctgggcagtacttgcacttggggatcctctagaaacgacaagcaggcagcaagcagagttttatacaannngcccac

SEQ ID NO: 6470 - DNA, 9999 bp, Oryza sativa
  unsure (1)..(9999): unsure at all n locations
cgcgcgccattagancanctcgtcgnacccaacaaggactctctcttcttgatcaaaactcaaattctcaatctacaattgtagtagttagcaatcaagtccataaagctcaaaaagaagacaaaattgtctggcttgaatacagcttgagcgacagcatagtaatatcagttcatcagttaccttgtgtaacactgcaatatagattgatcgtccaacaacggcaataactcttcaagcaagagaaactagctgaggatacagaggtccaatctaactctatgaacacaatcgatggcctacaacacaagtataaagggcatataatcacaaaggttcctaaactgttgcatttcatcatcacatttcagtatctttcgaattcctgatccaatgtcaacattgttgtctttcttcagagaagcttcccgcttacactctggcactctgcatgtacaggcatttgacaatctgagccggaaggtgcttgctttggcacgacaacaaacttcaaattttttggagcacatttatgtatgtgtagcttgagaataggacaaacaatctcctgaacctataaacacaagcaaaatgtcagtttcctgaatatattgtaaaacacacaagttttgagaattttgagccccttaaatgcttcatttctttcccatcatgcagtatcacacaaaaaacaagtctaacaatgagttctcaaaaatacaaacaaccagtcttacagtagtcaaagaaacaattgagattgtatatgttggccatgactttttttgggtgtcaaagggatgattcttatgaggtactacgtctatattgcaaggtagaaacttctttttaagtgataattttgaaccacacaatatatatagtacttcctagaagtagacaacatttaagtagtgaaaacaaaattttcaacttaccaaacccactggcttttgtgtgaagccattgcctcaaagcttctggaagggctattattaacaagagtataagttggttgttttgagcttgaggagagggtggaagatagccaaatgtcaactggaccactgtacttgcgaaaaatgttcaagcttacctatccaaataaacaggcataatccaggttagcttcttcaaattaatgtattcacagggaattgtttagaggttaactagcctagtgccaataaaaatcatagaaattagccatcaaatgagatagacacatcaagcaattcaaatctatgcagagaaggcatgtgtagtgttattgttttctgtctttacttccaacgaaaatgatgatatcaatgcatttaagcacgcaattcataaattcaagaaagcaatgcacaggctcttttagactctggaataagtagagtatatggcaacgtgaagaaaataaagctaggatatcagggaagaattttacaagctcccatgcttcaatgtgtccttgcccgttgtcacgcagaagcttgctgttcatagaaaaatagatttattaagactccaaagaaaaatgctagaaacaccctgcagaaatatgctacatatgtgtaatctagactgtcataagtgaaagaaatgtaagcaaatccggcattaaatagatggaataagtgcacatcaccaaccaagagctacaggccatagtcatgacatacatgaattagccaaactgttcaattaaagtgtgaccccaaaacaacttatattatatatgcatgaaagggatgagatcatgggagagaaagagagaacccttacaaaggggtgtggtgatgggaaaggggaggccacagttatgttgaagttaggtaatacactttctttcggcagaacatgttgtgacttgacaagatatgtaacttaacaactatgtagatattatagaagcttgtgcggacaagctaacaatataaaatacatcagtaccagaaaatttttcttacaagagggcatcaaactcaaacagttgttattctaaaaatgctaaacaacaaagttgaactaaccagattccatgatgaacatcgcaatgatttggatggcctgatactcctcgggaatcgaaggcaacaatctaaaatgacaacaaatattgcaggagtaaataggggaatcggaatgaacaaaatgcaaaatttccatattttgaggtctagaaaatcaggacgaaaaaggcatttcacttgcacaatcatatgatgtactcaacctgggtacctgtttgcagcaacaccgcactgagatttggaacagattaactaatacagttttaaatggcatataatacagataggcgcacttgatgctcctgtttcttcactatattttttatttttaaagttgttcagaacagtaaagctcgaagcgaaacataatacaggaaagcaccaaagttgatagagtatagatatgaattattattactgggagatcatctgaatcttgacatggaatcattaccgtgtcgatattccataactgggattgtgccagggtaagttctgctattagtccatgatcccaatttttatgaaatccatcctacaaggtacattgtgtaaacttaagtatatatttggaacagtacctacatacaagcaggtcggcaaaaatgagctcataataaagcacctgcagttctgagtggtccaagactttaacttgctcagctggaatctgtaaatacatgatccatttcaacacatttttcaatggacaaccgaggtcaaaagaccctctccaaggggtataatggagcagagtaggacttattaccttaagagtgacacaggcaaggtagagttcctctttgcggatatttccaaggccatcagcattgcctaatatggggattaaattgacaatcagaacgaccgactcagatgaggtttcttatccaaataatggcgcccttaaagagtagaaatacatatgattgagctgagacatactggaaaagcgaaatacgcacataggatcagagtgtagacgtcttttaccttgagacaagcacaagatatgaatgctgtgaccttttgacttgaggaaaagaatagtcggagcaaaaaacctgtatcagcaacatgacaatcaatcagaatcaaccaaaacaaatactataaacaagatttcccctaaacagttccacaaaataataaaaagttcagctgttcacttagtttcatttctgtaatcatcctgcttttgtaagaactttgtttcatttctgttaaatggaaatggagggagaatgctcccttagctcaaaaaaaaaaaaactgttcacttgttcaggaatttcatcgagcaggtaccgtgcacaggagttagcctattaagcttcattgttagcggttactggaactgtagccccacgatttacacagcgaggctcgcaaacgataagagacatgaggaggaagaagcagtacatggattcgtcgtcggggtgggcgagaacgaggaggacattccggctcatcctgtcgccgcgaggaggggagaggaaggtggagttggcaggcagacacgccggcgaggaggaggagagcacccgccccagagaaaccgcccacaggagcacggcccccgccgccatgagcatccagatccacgccatagccttttccggcggccgcgcgcgccactcttccccgtgcctgtgtggctgcgcggtggtggactggcctctcgtcggtctcctcgagttctcgccgacgcccagctcgccgccttcctcccccgtggcgccaccgctcgccggtgggctcctcgtcccctcgacgtcgacgacttccggcgacgaatacggtgtgacagcgctcatggcgtgagaagtggcttaatgggccagtgctggtcggcccatttaaatgaagaaacgggccggttggattgggtactgggccttgcatccggcctggagcccaccatcctgtttctaattttcgtatggattaattaaggatcgtattaatgtcatttcaaaccatactattttcttaagtaaagttaacaaagatacgcattcatttagttttttaaccaaactttggtaaatataaaataaatcatgtcaaaacttgacaatattatcaaattgccaaaatttggtaaggtttattttggctcccctaaacaagtggttaattacttaatttaggtggacaaatcgataatgtaagcctgtggttttattgcatgatttgtcgggtaaaaaaaaattactaattgtacatcacttgacaggcctctctcactgaaagctgaaaccccctaaaccccgaagaaattaacagttgaaacgaatgggtaaataataaactcagacgaggccgacgagcttctcgctgaggtcccagagcttcctggccttctccgggtcgctggcctcctgcgagagctggttctcgaacgacgccgagtccttgttccagctccagtacacgccggacttggtcaggctcgggtcgcccaccacctgcgccagccgctttccggactccgcctccgacacgaaccccttcgtcacgaaccgctggaacggcgggaacagcagccggaacagcgggatgtgctcgcggaacaagcccgtcgtcgcgatgcaccccgggtacagcgacgcgaacgtgatcccggtctcctcgtggaatctccggtggaactcctgcatcgtcagcatgttacagatcttgctgtccttgtacgccttggcgccgtcgaagctctccgcgccgtcgatcatcgccgacccgttctgcccgcggagcccgccggcgagcccccggaggtcgcctagcccggccttgggagggacgttgccggcgagggtgttggtgttgccggtgatggagccgaggatgatgagcccccgcgacgggtagtcggatttcttgaggtcgtcgagcatgaggcgggcgaggaggaagtggcccaggtggttcaccccgacgctcatctcgtacccgtcggcggtgaacgtcggctgccgcgccgtcggccggtagatggcggcgttgcacaccagcgcgtcgagcggcatgccggagcgccggaagttgtccacgaactggcggacgctgtcgagggaggcgaggtccaggtgcatgacggtgtagctccccgccgccatccccgccgccttcgccgccgtcgccgccttcaggaagtcgcggcacgccatcaccacgtgccacttccccgtctccgccagcgccttcgccgccgcgagcccgagccccgacgacgcgccggtgatcaccaccaccccctgccgcagcgtcttcttcccgtccgccttcgacgtgcccgcgccggggctcgccaccggcgccgccggcgtcgccaccgccctcaccaccagcgacggcttcttggccttctggctcacgctaaggaaccccggctccttcaccaccgcgctcaagttaccctgatcagtcgtcacacataatccaatcaaaaacttgttcaaaatgcacaaacttcacacaaataaatccatttttgacagaattcaacaatgcagatgatttttgggtgcgcattgttaccttcttggggacagagagagcagagggcaggagtgcggcctgaacttggagagccattggtgtgagtgtttgagtttggagtgagctcaagtgtactatgtttctggtgtccttttgcttcgtgttggtgaccagcaagagtgagttccggagggtatttatacacggacccgaggagcgaggagcgccacgggctaaggataagggggtgggccccccaccacgctggacgcctcccagccaatcgcagctcgtgcctcggattttccgctacgatttttttccttcgagatattgtcctgtgaaagcgacacgtggtgggatattttttcgtaaccgacacgggggacagcgacgtcgcgggatcttctgcgcatggctgcccgtaacatatggtgacgtggcgttgtgtgattgggtcgtggctatcgcgacccgtgtgcggtgtttgggcgtggaggacgggatgggagtcgcaaataatgcagcatgggaggtgtgggccactgatgggtgggaccagatagggcagatctgtcgttttgcgtgggaagatgacgcgagttcgtgcccatgtgaacgtgcggtaaacgactggctgtggcccgagacacgtaggaaaggcccattgggtctgtgctgacttggcaaccgacgtggcacgatatccgttgcacttttcatcgcctcttcttggtgtcagcatcgcagcattggtaagattttcttttcattgacaaatacagtacaaaagtaggtgttcataaggcgcgtagactcatccctataaacacacatatgcacactctatcctataaatatattgaaaaactaagttgggagattgacgaaatcaccaccgacggaataagatttaaatcagctgaggatagtgtagtactccctccattactaaaagaccatctttcaactttaaccagttactggttaatctgaccagtaacttgacccaaatttcaactttttacgctaacgcataaaagaattacacgtcaatatattagcaaggaacaaatttcacttttcaagttgcaacttgcaggtagtacgaaactatttctaatctctgtccaaaatgtcaggtaaagtggtaatggcttgcatgaaatgcgtacaccagtctcagttctgaaatgtcttactagcagttaagccaagtatacttttttctaggtgaagttaagggcatgctcagcttacttggtcacaactgcaaacacaagagagtttttgctgatggttatcgctgttgcatttgtgttgcgctgcagctgcgaccaactcaatcatgcaaggcctagcaagtacttgatgcggttgtgcggaatagtgcattgtctttttggttatgcttatccgcatagtttattaacaaccaaatagtatatattataagtaaaaatttatacatgtgtctatagcaatttaaaagcaaacgccataaaataaaaatacgatgaaaaatcataaaatcatatcaaattaaaaatttaaatttaaattttagcttacaaatataagcataagcaaaaatgataaggctattcgatccagaagctgtctctcggcgaacaaaatgaacacctgagagacaaaatgaacaaaatgaagcaaatcttctaattaagcccaatacgtttcatttccaggaggcccattgctatgggccccatcacttcctcatgcaggccacaaaaacctgggctaattacccacaacaaataaagcccaattgcccatgaggccattcaacccagagattcaaccaagatgcatgacgagttgccctctggtcgttatcgtcctaatcagacggtgcctattttagcttccttctccatcaggatctcgctggaaagtccaacttacctacatcagtatatgacatttttcattcacatcaatcttagcaagcatgacataatttactatatgatattatagaccgtcgtacgctcatactaatgtgattatctgctgatgatggacatcgaccagcacactcgtccttatcgtttgaccaaaatgacctgatccaactaatcatatacatgcgagatcctgtgtactatagtaatgtattgtagcgctaattaaattgagatgatgggcgaagaggcgtgcttggtcgagagaggtaggatgcgtgtgtccacgaacaatagaccagggttcagcttaaaatgtttaactagacgcatgcagatgcagaagcttgcgagttgttcatatgataattattaattcagaatatattacagctgatcgatcgagctggtagctactgtagctagcatgcggccgcgattccgatcgatccatcagctgggcgtcgccgtcgccggtaacattggtcggtaggacaccggattttaaaaatgttgatggtttctgaagcaacacccaagtgttaattattggagtatattgtgtgtaagagtgacaggtgctaccaaaaaaaacgctgttcaatctcccgtaggagcatattactaattgctagctgatgatctatgattaagctctgactgacttctcgggggtcagcaatgctcgaagctactagaatacaattccgttcccagcaacttgtgaacttttagctagcgatcgaggaataaaagctagatgatcgagcaagttctgaacattgttgggttggtgtgtgcatgacatgtgctaatcctaactgatgtaattgggatcggactatgtgcattcgtggccagtagaattggaaggctccacggcgctcgagtcaaggcgcacgcccgggcatggtatggtggtcaggcatcggcaaacgacagacaaggcagccaggcagagcacgttgtgcgtactctatatccaccgaaagctagtgcgtgccgtctatgttctgtattgacacaagtactatctttctattctaaatatatatatttatctttctattttaaatatattgtatatatcgttgttaaattttttataaatgtttaaccatttattatatttatttttcaaaaaatataaaagatatactccctccgtcccaagaaaaggcaaaccctgggtttccatgttcaactttgactgtccgtcttatataaaatttttttataattcgtatttttattcttgttaaatgataaaacatgattaatattttatgcgtgacttgtctttttaattttttttataattttttcaaataagacggacggtcaaacgttgggcacggaaaccagagtttgtctttttttggacggagagagtaagttgcttcatccgttacacaatgtaaattattttagtatttttcatatttatattgatgttaatgaatctaaaaatactggaatgacttagattgtaaaacggaggaagtatgtttgaagagccttcagtatgtaatgaattaagtcataagaacttaaataaaaaatatcagccgcacgcgcacgctcacgcaccaccttgtttcgcgggccgagcgtcatacaagggagagcgtgatgcgtgtctctcgcataacgacatcgttacgttcacacgaataagcagcattcacaataggcgatggcaatcacaggataaaaaacacaattatatatcagtccaattgttcgggctcgtatggagaaaccgcgctctcagtaaacaaaccaagccaaaaaaaaaataagattctaatttgaaactaacatcctctagtaatttactatgggctacatacggcggccgaagtatcaaagtagactcatatcagttgacggggtgttgacaggttaattattttccaagtttagtcgcttcatggttgggggataattgatcaacccacccggtcagaaatcccagccgcagagaattcagattccaatttactgcttttcacgagctacagggcggcagcgcgctgatgacaaaccaaaccacggatgcatgcgccgatccgacgagatgcactgcacgtatgcacgcaccgtggctgcgtcggccgacaggtcgcggtgcgcgtgtgccccgcgcggcgagcagcgggcagcccgagctggggccagcagccgacgcgctgcactgcactgcactgcagagaagcgagcgagcgagcaacgcattcgattcgattcgagagtaggagaagcaatgcaaggcggggggcgacggtgacagcgcaatatttcgcggaggcggggcccgtcccgtggaaaagccgccaccgaccaagaccccacacccgcatccgtcctttttccccaactccaccgcccgccaacccagccacgcacacccgtcctcctcctcagcccgcgtccccatccatccatccattgcgccgagagatcgatcgatcgatcgagcgagcannnnnnnnnnnnnnnnnnnnnnnnnnnnnnnnnnnnnnnnnnnnntcaatngcgcg

SEQ ID NO: 6471 - DNA, 5266 bp, Oryza sativa
taatgtgtgattaattaagttgtaattattataaacttaaaaaatggtttaatctaatattttagaacaactttcatgtaaaaagtttttacacgaaacgcaccgtttagcagtttgaaaagtattacttttatctaaaaatttatccagctttagttggagattcgaacagggccgtagtagaagatgagcgaacctggctggctgccacgcacgcagacgcaggaatgcgtgacacgggcgtgcccaccgtatagtgtgctgctgaccgatcgagctggctggtcatccagccgggatggatccacgccagccaatcccagtggccaagatcactgtacgatttacactgtattctgcatgactactagaggcaggagcagtacgtccacggtccacgtacttcgtacactaggagcatgcatgcatgctggtagactggtttgttggtacctagtagtacatgtagattgctcgggtgaaaatgatagacgatcaaaatccccaccaatcgtgtatctcgttaagttaaaagtagtactgtaacgttttctttatcgttttgttctagctatgtgtaaattctgtttttttctccagttttttttagtgtcgtattgcgctaaccaatagctaaacgattttgctagatatttatcatcaaatttctccccctaatatttgtcagatgtaattacagtacaattgtagtgtaacttgcatgtaattacagtacaatcgtagtgtaattacactgtacctataatgtaacttcgaagaatctctcgataacatgttatttcagtaaaatagaggtcgtgggaacaaatcctttcacatatgtgtgtgctgtgatttttttcttcctcactagaacaaatcttgtaacagatctaacgattcaaaattacgtgaaacttacatacaagttacactgtagttacatacaagttacagtgtaattacatacaagttacagtgtaattacattacgattgtactataattacatctgtcaaatttttagtagaaaatttgtcgacaaatgtatagttggtcccatagctaaatcggatatgaaaattttcaactgaccgagaattgttgagttttttttcgaacgcgcaaaagaattgcatgccaatatattagtagaaaaaaagagtgctacgcactcaggccccgtttagttctccaatttttttttctaaaaacatcacatcgaatctttggacacatgcataaaacattaaatatggataaatgaaaaaactaattgcacaattaggagaaaaatcgcgagacgaatcttttgagtctaataagtccatgattagctgtaagtgctacagtaacccacatatactaatgacggattaattaggctcaaaagattcgtcttgcggttttcaagcgagttctgaaattaattttttcattcgtgtccgaaaaatccttccaacatccggtcaaatatctgatgtgatacctaaaaattttcttttcacaaactaaacatactcagtcaattgttgagtagaaatgctatccttccgaccgttttcatccctgaacgcatgtacgtctggtgcggtgcgttgctctgctcgtgtggccagaggcaagaggcacgcatcgcgaaccgtgtgtacagggctagctagcttagcgaggtggtacaagttgaggaaagcttaacgcacaaggagagtatatctcgctgcgtcaggcgcgggctccaccggcggccgcccgccaccttccattccttccttcctcgcgcctccgtctatatatagcagctatgccaagctcgctcgcctagcctagccggtccacgacgaaaaccaacacatcaccaactgctcaggcataattgctttgccgccctccaggtcggactgactgctacgtctctgtctacgtataccccagcctcctcgtcgtcgtctcgtactaggatcttgctacaaatagccggctgcttgctagctttagcttcttccttctcccgagagagacgatcgagatcacgcgcccacagaaactgcagattaagcggcagagattgtagatagcgcgaggttattaaggccagcagtctgaccgcgcgcggcatgcccttctgctgctgcaaccgaccaaatggctcctgcgggtgcctcctccccgtcactcgtgctcttcggcggcggcgccaccgacttcaacaagcgcccggccgattccgacgcctcgccgccgcaccaagtcaggtaattactcgggtacatacttaattacacttgcagatgcagttgcatattagctgtggaagtgtgtagggatatacgtgggttttagctagtgttgctgtttctggagatttgttgagaatgtagcgtggctcgctctttctactttctagagtttgtgtttagccgttctctggcataagtcggtctgactgattgtgttgtgtaaccacaatttttttattctaatatactacgtgtaatcttttttgcgtgttcccgaaaaaaatgaagtgcgtagggatcggccagtaatgggaatgtggtttttatttgcaaggagatcgcacggggcaccagtaaaaaaaccaccaccacctggagtgcccgcgctgccgatccaccaaccccaagttctgctactccaacaactccagctcgtcgcagccgcgccacttttccagcgcctgcccccgttactgaacgcacgggggcacgctccccaacgtgccggtggccggcgcctctcaccgcggcggcggcggcaagcgccgcagggtctccgccgacgccgacccttcctcggcgtcgccgccgccacccacgacttccaccagggacgcgtacgccgacctcccagccggcttcccgttcctcagtgacggcgccttcctgccgcagttcggcctcgccggcgttgcgccggccgcgttctcttgggcatcggctgtccctgacttgtacaactgcgggatcgcgccgtgggacgatggaacggcggtcaccggcgcggcgtgggacaacttcgccgacatcgccggccttgatctcagctggccgccgccgggtaactgacgaacagtacacagctggtcgctcgtgttttggggggctccggttttagcaaagcagcctcaagtagtgcgttcttcgatcggtatgcaggtagtgtgttcttcgatcggtatgaagtatattttgctgagctagggattatgatataattattgggaatgtaattaagcagctcaattatccaacgtggtgtttgcagttttcttctctcaccaatttcatacgcttgcacaatgatgtggtgattatcattgggatcagtgaatcgtgatctgtagctggaagatgtgtttacgtatgtgcagtgttaatgacaataataagagtttgttgccatcaagattctagcatgtgctcctagtaattaaatgaactgtagaatgctgaacagtgtagttcaataaaagccatactgggagggaagattgcacaatggattatcatggagttagaaattatcttcatatatcaatcagtgtataaccaagaaacaatatatgaacaaacaaatcgatgtattggttgttaaccatacaattacacaaagccttgtatcaacagagggtaaaaaatagtgtggtgcttagcaagttggattgagctactggggctcccaacctgacagcgaaacagggaaatcttttagctagtaaaagaactaggtgaaatggagaaaaaactaacgatatctatacagtaaacaaacggacatctctgaatattctcacactagctttacacttgaaccgggaagccgaaattctggaacaccctaatttcaccaccccttcctgcagtgacaatcaccaatccccaagctgaccggcgctgaacatccaaagctccaatgcaaaggtcggatgagcagtgaccaggactgctcttggcagacgattgtttctcgtcaggccaggacgttgatactccatccgctggaggattgcttgtgcttgcaacaccttcacaaactgggcgcttggtgcatctattgacagtgccattcagatcatgctcactgttctctacaggggcatcccgacccgtgttcatcactgcatcgtctgaatcactgtttctgctgctacgggacccgaatgagccacgggattcagcgccgggccatgtgatagccacagtgacatcatggcaatggaaatgctcatatgagttggttacatcaactgcactcctgcttctgctcggatgggaagtattgtcatgcctccagacatacacgtgggagtcctcactggcacagaccacatatttcccgtttggagctacagaagcggatatttggctacttgtatttcggaaccctggtgaaaagatcaaataaaatgtaagtgaaacagtataaatactggcctactgagtgagctaatgcaccaatcaagtgcacagttcttgtgattagggcctggtttagttcccaacttttccatcacatcaaaactttcctacacacacaaacttccaacttttccgtcacatcgttccaatttcaatcaaacttccaattttggcgtgaactaaacacacccatcgggggaaattggggaaatggaacctatgatttgatctgtgaacatgttaggaactgaggtaaataggtgggatgtgggggttttccaaagtatgaatcacttgaatttgggttacttactactttaaatcggccaggttccttctaggtgttctacatccgtcaacgtctagaggatacacaagtacagtgaatgaagcattacctttaaatttgtgaacgagttcatcaccattaacaacacggattcttgaatctgcagaggtaatcaggacttccgacgagcttccaggagcaaactgtatgaagtagagatatttagcatgtacaagaggcatcaggctaacatctaactattagagtacagaccactctttcttaacaaatgtccgccacgcaattatgcactacctggaagccagttatcttcttctggccagacttcttcttcctgattcttagttctatctgacttttgtactgaagcttcttttctgaaaagacaaaataaatgtgcaagctcattattgagggaaggcaaactctaaagtctctactcttgtttcctttgagatcatgctattttatagctacacaaataggaactcttagctagaacctaagattagat

SEQ ID NO: 6472 - DNA, 1865 bp, Oryza sativa
gggtatttgtgattcaggaatttgaattagattaaattctctccctccatccatagatgattggaacccattagctttttttacccttcttgaccggttggtcttattctaaaatttggtatgaaatacattgttctcatatggatacatgacaataatttcaacagtgattcatatgatataaaaataattaagaaaaccttaaatttttttgattaagcggaacggtcaacaatgattaaataagtcaacggtgtcaaattttttggcatgaaagaagtatatggaaggagctccccccccccccaaaaaaaaaaatccaaccaacatacgaaggcaattaaacaacagatttgttccttaatgttgcagttgcattgacaacagatcaatcaggatgacaaaaaagtaagggaaaaaacagatagatcacgattcaattatactatctcagtaaaatcttccgagtaaatcacaataacagtcctataattataaaggctgagtagaaaaatcataacaaccaaactaagttatgcaaaacaattccacatacagatctttatagctgaagtgtgaaaagattaggatcaagtaagagtgctgtttcccaggttacgaggcatggcaatgatacatatttcacagacaggccaatgaagtcaaagaatagaccatcctagcaagttgaaacaaattcacgcctagtgcaagaatctttcaccagtgcaaaactgtagtgctcaacaaccactcaaccaatttcacttttctatcagcaagatgtagccaaatgttgcatgctgaagcctacgctcaattactatggcaaaatgacaaaatgcattgttttccaaatagcccgttgatttgatctttagcctttttaacaatgcgggccttactgccgtactaaacatcatcaaaacaacaaacgacttcttttctgtcctactatctagacaacactaaaacgaaacataactttttccttgttgccctgaagaacaaggcagtgtgatggtttattattgtgattttttagaacatatgccagagtgccaaaagttatgatttaacagtttaacattcaatcgaaagatcacaaagttcgcacctgagatttggaccatgatagatcaagaacatcggcggcgtgacccaatagagagcatactggtttatctctgaacccaaacacacattcaggcacaactagatgatcagagccaacagacttccggctgctttgcatccttggcctcctcttcttctccacaaaacccccgtcagcacagctcaatgacaatgttgccagctccggcgatccattcccaacagctgcaagaaacgggctgcagccaccaccgttctcccttgccaccgtaccttccccgagcaattctccctttctttctccctctgatacctcccacacatggatgacacggtcctcgccagcgcttgcaaggtatcgtccatccaagctgaagttgatacaccagattgagcccgaatgggcagccaattcttgtgtcatgaacagcccggtgagctccttgcacgccttcccatactgccgcaccctgaccctccctgcattgcgcgagccgttgccgtcaaggctgtcatcggtggcggagctcaggcgccgcgcttccctctccttcttctccttctccttctccttgtccctctcatcggtgctgctgcgcccgtatgcaacgcttcccgccaggtgccggatgccacgcagccagccttcaggcttttctccgggcttggatgcttgggcggcctggtcggaagtggaagatgatccggctgtggtgggccggcgcatgaactcttggaagaatgggaga

SEQ ID NO: 6473 - DNA, 735 bp, Oryza sativa
  unsure (1)..(735): unsure at all n locations
gcgccnccttgtgtttgncttccanctcggnaccctttattaagaaccacgttatctttcataagttccacatcattcgaactactactcccagtagtttttaacattccatcatgaaactcatcaggtatatcttgcctggcagattcagaaaccaaatcttttcttccatcctcctaaagcaatgttaataaaaaagttcacattatgatagcgtaataatcttgtgagtccacaattttggactaatttcaaaatatgagtagaatatggcatgccaagaaccctgaaaggcatatatacctgttcaaggccagaagcagtaggtgtttgtgtatctcgtggtgggccagaaaatccagagtgattgtcaccacttgatccttcatcgtcctcatcaatatccctgacagtactaacaaaccaagaacttagcaatggcttatcaaggtcactttcgaaagacggttcaaaataattttggtgccagctatttgagagatcaattttgctgagattttaaactatgattttgttgggcaattactatgcagttgtaattcctggtagactacaatacaaggctatgcaaaatccatgtgaacaacccacaaccaaaatcagcaacagaccgagatatgccgcctatgtcaaataaaataacactacctaaaaaggtaaaagatgccagtggcaaaatgcttcttaacttaccacaaaattaaaccggccctn

SEQ ID NO: 6474 - DNA, 651 bp, Oryza sativa
  unsure (1)..(651): unsure at all n locations
gctgtccttgatttacatcttactnnnnnnnnnnnnnnnnnnnnnnnnnnnnnnnnnnnattttaggtcttacacatatgttttctttcctatcaaattcccaaggaatttatttttgtctctgaataggcattagttcggtcaacaaagttgttctctcaaaggaaaaatgtcagcaaagctgtgttaagtgttctaagctttgttcttatgctgcaggatactttaacatcagaagaagataatgaaacctgtagtttgtgtggcacccagctccattccagtctccctgtcagtacattatatatgttcagtctcctttaacgtttgattcgctttaaagttggggacaatttactaggacatacctgaattggtttggggtcaagggtaagcactacaccagcctgctccgttattctctgattacagtgagcaaacgataattagaagtgcttttactgatgcagaaattgatataagcaaaagtatagccattcataggatgcaacattctgatgttttgaacaaaacaaagatgatggctttcaacaagcgatttgtaagaatgtcaaggtggatcacaaaatgtgcacatgtaaacgtcttggcaataatatgcatgcagggtgcagagcaggnnntcaaccg

SEQ ID NO: 6475 - DNA, 851 bp, Oryza sativa
catgacaaatttataaaaaattttggagttccatcaatgtatacttatttttatacacccaacaagcttctatttaaatgtttagctacatgttcctatggatgccctgatgcccaaaatttaatgaaaaatgataccgttccttcttctgtggttagtggtcatgtctataatctattgtacttgaaattaaatggttcttgatatctgaaatgtatatacgttcgcaagaaaattgtattgctgcgaattctaagttctgccactttacgcagaatctgaatcacaaaaatattgtgaagtatcttggatcattgaagacaaggagtcacctccatatcattctagagtaagcagttcacaatcctcatgacagtttcttgatatgattatacctattaggctattagtttttttttttttttagcttggaagttttaatcctcatgggatgattgcaggtatgtggagaatggatcacttgccaatattatcaagccaaacaaatttgggccattccctgaatcattggtggccgtctacattgctcaggtgaatatgatgattacctgcaactttcctgtttttgctatgtccggtattaatttttttacatatcgaaccaggtgctggaaggacttgtttatcttcacgagcaaggtgtcatacatagagatatcaagggcgcaaatatattgactaccaaagaggtttattgctgcatcacatacatatttaccccttttgtgatgacttgagataattgcaaagggaatatcttaagtatacaaattttggaaaaatggtttgaataacattccttgaagctggcgtcttcatgcacttctggt

SEQ ID NO: 6476 - DNA, 1198 bp, Oryza sativa
  unsure (1)..(1198): unsure at all n locations
naccacgaagggttgcccccattccaaggctcccacaaaaagctatttcttgcaacagaaaaaatttttttttttccaggcagcttacccagcgtattcaccaattttttcgctcttggattctgaacaactttttcctgcaaaagtaaagaatggtccatattaaattgggcatagggccacgaatgtcaggtgtttgtgctgcatcagatatctggagtgttggttgtactgttattgagctactcacctgtgccccaccatattatgaccttcagcccatgcctgcgctgtttcgcattgttcaggttgattacttgcagctgtttacttcccctacattttcaaaagtcacaatatccattcacacatgagactatgattacatagaaagtttttatctatggacaataggatgtgcatccaccaataccagaaggcttatctcctgagattactgattttcttcgacaatgttttcaaaaggttctgtgtcgtttctggctatatcttttaagaatttaatgattattttatcaaattgtttgctgttctgacttcaagaagcacctgtaggattcaatacaaagacctgatgcaaagacattattgatgcacccatggttgcaaaactcaaggcgagctttgccatctcttcgacaacctgttcaatcaccaaggtagctcacatttactgcctccttcttttcaattgctattcattgtaaatgataaaccaacaataatagccataaagatacaaacaggacggaaaacagaaaaatatagctccatagcttgtcatttttcagtcacctgatcactataagtctataataatggttgtatattctgcatattaaacctgtactggtcaattttattcaagcattgctagagttattcgtttagcaagtaggatgtgtacacaactacacatgtccaggggttaattgcagtactagtgggtttaagttagttatagatgcaacttcctgtgagagatgttccttctggaggtttgccactggaatttcttatagttttactctctctgcttttacatagtacatatacgtataatcccatttttttctttatgtgcctgtttaaattttgtggttagctaagtagcattttgccacttgcatcttttaactttttaagtagggtncgagctagctgtcaacaagggacg

SEQ ID NO: 6477 - DNA, 1001 bp, Oryza sativa
cggttggaaccctgcttggcccccacgcccacgcgtgatcgtcttgtcacatctaatgaataatgtatctcattgagttcacatatattgcagtgaaaacgacgctatataattgacaatctgaaggcaacctcttcatattttttttcccactaccacaccacacacgaaaatagaagcctattaattggtaatacgtaatctaaaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatatttatataaaaaaaatatagagcacagtacaaaatcgccctcccccagggcggcaagggggccgcctgcaaaattccatgccccctcgccgcccatttgcaggcgggcccccgcacagtgcaaaatcgccctcgcggagggcggcaagggggccgcctgcaaatttccatgccccccctcgccgcccatttgcaggcggccccccggacagtacaaaattggcctttcggaaggcggcaagggggccgcctgcaaatttcgttgacggcccgtatcctatagcgaacggccgtttgtcacgttatttccgccgccttttgggaggagtaatatttagattgtttttcgaactattaactgtgttatataagtttttactacttactatttatcattaattatcatgtccatctatgtctttccatcctaccaacttagttcgttttactcatttacgttctatcatcgttctatgcattaccgctcctacgttcttatttaatatcctcttcatacgctatctcgtcgcttcgacgcatgtcca

SEQ ID NO: 6478 - DNA, 989 bp, Oryza sativa
  unsure (1)..(989): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctagaaaggcatgaaagtattttgccattactgcatgcttcaacagagaggaaaactaacggcgaacttgacttgttaatggcagaatttgctggtatgcttaattcctctctcttcatcactcagcagttatgattaccatgtcttgggtcatgtgggctatttattcatctgccttttatgaacccaatatacacagtttttgttttgactgttctaaactctgtttgtagaattcgtatagcagtatttaggactatagaatactgtgtgtagttagtgcgaggtggttaggtacgagggaacaacctttctttatgcacttattgttctttctatttcatgcagaggtctctagacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggctcgacgttcgctgcaggagcgtatt

SEQ ID NO: 6479 - DNA, 751 bp, Oryza sativa
  unsure (1)..(751): unsure at all n locations
cgtgtagttggagccccnccattgancccccnatgaagatccnacttggtacccatatcctagctgtaaatggtttgcatgccatatttgttgattgtttttttacttaacaaagtgctactccctccattctttattttttcactaacgaactttcaaacatcgagggatgtaggtagtattaacagtgcaatgcatgctttaggccaagtagccggattagccatggctgaaagcctgaaactgacttaccaggatgttggcaaatgctaatcaaatcctttgaggctttaaactggatatgatttcaactaattctgtgggggtgttctcaacaggataaatatgtgattgcgaatgcctcctctctctctttttttttcaataggactccattttatgagttaacattaatggtcctgttcctttcttatgtaaggagtggattaaattttggatactcatggcatgcttttcaaactgttaaacgatgttaaacgatgcgtttcgtgagaaaattttctatatgaaagttgttctaaaatatcatattaatctatttttcaagtttgtaataactaaaactcaattaatcacatgctattactatctcgttttacgtgaaacacttaatttttatcttcataggatgcaaacaccaccattgaatcgcctttatgcaaccgtgctatgctggagctctcctggaatcgaatactcctagtcctagccaacctgtgactattctgtc

SEQ ID NO: 6480 - DNA, 747 bp, Oryza sativa
  unsure (1)..(747): unsure at all n locations
ctgatgtctttttgaacnccactctgtacccatgaaacaatgctgaagacaaaatatgtccctggtcgtttatcataccgccctattagttttgctatggaatatctggaagtgcctcaacaacaaagttttcagcaactacgacaagacgctgtgcggaagacctccagtggtcccatcgcagcacaaatagttttagctggcaatgtatactagattgggggaacaaatttctcgcactttgtaatatataggaccctttagcttccactcaggccctcatcccccgtacctcttcacaatatgtatgtaacttggtacaaattttgatcaataaaatgttcaggctggtagaaagccatccttaatttttccttcgaaaatttatgccacaaatatcccctcaataagtatatcatgattaagatggcaactactatcaatatcactcttgacattcaatccaatgacacaagggaatcatgattccaaacgttcacctactgtcatggtgatacctacatatgcattttgagaggtaagtagacataacaaacattaaattggtcaggattgcatacccgaatctcaggatccacaactacatactgctttaagagtttgtcaccaaaagcgcgagaaacagcaagcacaccaccaacacgccatgttcctaaggaacaaaataccatcattaggaacacgatcatagtccattcatatacaaaataagataatgtagtgctc

SEQ ID NO: 6481 - DNA, 6020 bp, Oryza sativa
  unsure (1)..(6020): unsure at all n locations
agaggagaacaaagcacaagcacagcggcaggagagagcgaaacgaagaaccagccacacgcaagcaagagaggcacaggaggcaagcagacagaaagatacacgacgaaaggacacggaaacacgcagcgcaaaagcagaggagacaggagacncgcacggacaagacagcacagaaaacgacagagagccagcgaggaaaaaagggagagaagcagggaggggacaaaaaaaaaaacaaccaaaaaacacgaacgagaaaaaaaaaaaaaacgagaacaaaacacacccaagaaaaannnacnnncnccnnnnnnnnnnnnnnnnnnnnnnnnnannannnnnnnnnccnnncnnnnnnnnannnnnnnnnnnnnnnnnncnnnaangggggccccctgtggcggcggcgtgatctgaagatgagattggagcccgaggcgcggtgttcgaaaacgacctgcctgccatgacgaccaacaccaagcgcgcctacaagctccgtatcctcgcgaattcgtttccagtatttttgactagtattttttgtattttttttcgaggtacattgtgtctgtttgaccgatccatcgccactgtcgcattcattctgctagctgggcgatttagttcttcaaatttaacccatcattttattatgcttttatctcgcttgcccctcgttaagataatgggggatttagtgtttgctcgattttatcacttaagctgttgctgatcactagttagtagtgaccgtggttatgtctgattgtcggacaagtgggattactgctgctttgtgcttatgaactgcctgaagattgcaacatgatttatttgggggtgattttgtgggtgaacttgcgacattggaatgccttgacttgcgtttggcgtagaggagtttgtggcgcattcatccaatgtcaactgcctcaagattgggaggaagacttcacgagttctcgtgacaggaggagatgaccataaggttaatctttgggctattgggaagcccaattcaattttggtaagtctctattgtcctgttctgactagtatgcctactatgtaaaatgtggttctatagcaaaacaggcaagtaagtctacccaatagtcaatggggcatttaattaaccaccagatgaaaatttcaccattttagctcttgtcgacttctccagcatcactttctgtatgttggtgttttattaactaggggctacttttatgtgaagtgtcaacctactaccttacatgtgttcgatcacagtgggtctagctactggaggtgtcatctgtgttgtttcagctgatggaatactttatttgattaacttctttttgttgttatacagagtttatcagggcacaccagtgctgtggagtctgttaattttgattccacagaagttttcgtggccgcaggagcagccagtggaacaataaaactatgggatttagaggaggcaaaaagtacgtgaatgcgaatgccttttgctgttgcatatatacctgaccacattccttgtctatatgtgaatgcaaatgctttttactatcgcatgtatactgactacattctgtgtcctatcttatttgattagcaccacttgatttgttttgtatgcagttgtccgcacgcttactggacataggtcaaactgcatgtcagttgatttccatccttttggagaattctttgcctcggggtcactggacacaaatctgaagatatgggatataagaaggaagggctgtatccacacgtacaaaggccacacaagaggtgtaaatgcaattagattcacacctgatggccgctgggttgtgtctggtggtgaagataatgttgtgaaggtaagaattgtcaatgcctaataatctttcaaatcatacactacatcgttgtgctgattctgcggtagattctgctagcgtgaagattttagcaaacaggttgattttcctttagtgaactcaacatgatgatgatgaatttgccttacagtaaattttccatagaacttgttttttcttatggtaagtttgccttggcagctctgggatctgacagctggaaagttattacatgatttcaagtgtcatgaaggccagattcagtgcatagatttccatccccatgagttccttctggcaacaggttaggttcagatgttacaatgctaatctgacacttagtcatcaacttttctttgacccttttggttgtacagcgtagtctgttatacttaactcttgggcttccttcgtttagtgattagaaacatatgctgtacatgctagtatagtagtatttgaaaataatttaaatggtaaactgcaattcaccatattatggctataaatggtatgtgcccatatatatattgtgaaagtcctggcagttttaatacactccccttttttgctgtccaacaatgccaaacatcaaattgtcttgttctggcattttttaaattgctatgtcagtacatcggttattatttctttgcgaaatatatatttttgcatattttaatgacctatttttgaaatgaaagatttgcatgaatttttaagatattggtatgttataatcttttcctccattgaaattgtgtgcaatacaacaatgtagttagaaatattttgttcattggtgtagaataagaatcccatttcagttatcatggagatgcataccatttttgcagcctgggcactgttcgaatataactgtttatgtcagaagttgtgcttgcctcttttttgtttcctgtacgctttgctactaaagattcattgtatgactcctgtttgcctcattcaggttcatccgataaaactgtcaagttttgggatttggagacctttgaattgattgggtctactggacctgaggtatgtaaaaccttggggtttcgctataaagctttgttatgcttgcaagaccggatgacttttagtaggcacagatttctcaaccaaaaaatgttggaggacttcttgaacatgtaaaggagtgcttcaaatgtttgtcctcatatttgttctttcttatattactccattacactaacaactaatcattagtttccaacacacaggctttcttttaattttttaatcacattaactgcatggttttcagccactcattggttgctgttcgactactcagtactttaggatttgtgtcactctaattttggtagagcatagaagcaccaatctagaattaaatagcatactgcatagttctcttaagtcatgacatcattgattatattttaattcttttgtgatatttctctatttggtgtgcccaaccatattttactatgtcgtaatcagctctcaacagcatgtcataacctcattatctcctcaaaacatgtgggctacctgttctagtgcatatgctagaaggctcgcaattacatgtccttatacaatcacctgtgcttacctaattctatggtccatttgcttatggcatagcatggcctttcaacattcaagtgtagttagtgctttatatgctgctgtagtgacaactagcatatatacatcaagattagcacaggctgcccaaagttcctgagaacctcaaaataaaagatccattatattacttgctgacgtctctatttgaatatcagacaacaggtgttcgatccatgacattcaatcctgatggaagatctctgttgtgtgggttgcatgaaagtttaaaggtatggtcattactttctcatgttacagcatggcaacaaatttcttctccatgtttcctagagataaacttctcttaatctaagcaggttttctcttgggaaccaataagatgtcatgataccgttgatgtgggatggtctagactgtctgatctaaatgtccacgagggaaaacttcttggttgttcatttaatcaaagttgtgttggaatatgggttgtagatctaacggtatgtttctggcttccctgctacagttctaacaccaatatattattttcattgaagttccccatttgtttttagttataatgtactaaaaaccatcaattttcagcgtcttgagccatatgcaacgggtacttcaacaaaattaaatggtcattcagagttgaaaagttcgtcaagtagcactatgccattacaaaatgacagtggttcaagggctaacattgggcggttatcagttctacaaaattctgagaataacataaagtcttctacaggaagattatcagtttctcaaaattcagactctgcattgaaagagacaaaatcaacaacttgtatgtcactgattttctctgtctttacacgtttatattcagttgaaacacttgatatgcctaatgtgtcctttatttatctgttcttaccatattgaagcaagcgggttggttccagtcacacctcagagagctggtaatggctccagtaccaaaacagttggaaattcaacctttgcatctagtggcaccaacctgaagagaggttcactgaagagtaacaactcttctagtcttcagaattttagcaaaattgatgtggtgcctgtgataataccaagaactagctcaggaccagagctggctactgattctaggagtgatgctgctgatgtgggccctgttctttctaagagtggtagaagaatagagattgcaaatgattctaggaaagaaagttctgatgtggcagcagctgttgttcccagaacaaactctagaacagaaatggcctctgattcagcacctgttgttggtcccagagctaacttaagaatggaagtaagcgctgactcggcacctattgttcccaagtcaggcagaaggttagagtcttctgttgaatctaggaaagaaagtactgatgtagcatctgctgctgctccgaagactagttcacggatggaagtggccccagattctgcacctcttctttttaaggcaggcagaagggtagagtctgctactgattcaaggaaagaaagtgctgatgtggcacctgttgttcccagaacaacttctagaatggaaatggctccggattctaggagagaaatttctgctggaagaatgtcaccgtttagggtccaatcaagatatagtgaactacgaaagttaaataatgccaaagctgatgcagataaagttgatgcagggagcaaaaacagtgaaacagatgattttacttgtcaaatataccttcctcgaaggaatggtgttgttttttccccaaaagggttttctggaattttctgaaagaaacccgggaagatgcaaaacctggtgtgattgacaggatgggatttccaagttctgctgaaccaaatacacaccgcagtgagaattgtatgccctgtaccctcaacttccataccggatttacacactgctacaatttagttcaaatactattcaacaacattaatggtgcttgatttccttgcctgtctgtatattttagtcataatacatgagtcttttggtactgtagatttcaaagctcatgtagatccatcgaatctttatgtgatttaaaccatagttccatgtccttacactcaatcaagaataatgttagtaactgaatttatctgtttgaggtgttgcgttgtatagttagatatttgcatgtttcgtggtcatcagctgagtctgattaatcaatactcactttgctacatgttacctgggaaatgtatgggttggcatatcttatgttctgattcttttgagaaacatgctctctgctcttgttgagttattatcctgtgtttcggcgaaaaaagtctcttttctttggtaaactagtaaattgtaactgctttgaacattggtactctttttgtagatgtttctagaatgcgtaagccaagagataactgctatattgaagtttcaagagcaggtaaatgttttactacccttaggtgcttgcaataatttgttcagctggttttaatcttgaagtatcatgtaggaagaacaaggca

SEQ ID NO: 6482 - DNA, 720 bp, Oryza sativa
  unsure (1)..(720): unsure at all n locations
gtgtgcatnnattaggatcatcttctcnnnnnnnnnnnnnnnnnnnnnnnnnnnnnnnnnnnnnnnncccagtttctccttgacaatgctggttagttccttaacacagtcttcaacagtaactgaagtactcgatagcttcagagattcgaagaagggaagaacgacgtccatgactttcaccccttcccattctttcaagctctcgagagccttacctgcttctgcatcacttctcatcacataaggaagacctgtcttcacgccataccgtaagcgatcacacaccactttagcacacaagccattccaaacgtcttcaagtgtatcccatctgtgctttccttccttgcgcagccgcagagcagggaacattacaggtcccagcacctcacggttgaatgcaacatttatcccgctcacaggcatcatcgcaccaagtggaactgtcatcacagcatccacatacgttgtgttgcgttgatttctcttcacaacatgagtcattgggtcatagtctgcattgtgaagccacagcccacaagagagcatgcactcaaccccctcgcgcagactaaatgggtatccacggacaaagtcagcccctttgcggaatggatcatacaatgtgttgaaaaagaaaggtgtagcaggtgtcttcagattggacatatgctgtgcaacttgcataacagtcaacccaccattgtccttcgctgg

SEQ ID NO: 6483 - DNA, 923 bp, Oryza sativa
  unsure (1)..(923): unsure at all n locations
acttaacttttcgcagcctaagaagaggcccttctcagggacatgttcagtacatccatttttggcatgccaatgccccatcgatgatttcttttgaccggtgatctacacaggcgctttcacaaacacaatcctcaaaatccaacactttgccagttgttactaacaagcaacgccgttcctgcccatgtgatcaccagcagaaaccatttgggccccgacggccatatcttctgtaatatacaatgactagttagaataatagctgaagagaagtagctgaaacaaatttgaaagactgacaaattttcaatcaaaacatactgagtcacatccaaaatttctcaatgtttgggcagaatttgaagttccaggtttcactctttctaattattgggttgtgtataaaaaaaccaaatatactaatgtggctaatactcatcacccttcaaagatactatttaacagtgcaagtagagtctgccagtaacttaccactttcactatctgatgcatcgtcaagtctggctatagcatcgagtaatgactgctcctggtcctacaaggacaaccatttgacctcacaactctcagacgaaggatatctataaggagcttttctccatcatacataattctgtagaaaattgcataacaacagacaagccaactcacttgcaaaagtttcttggccttttcgatctcacccatatttggattggacaaaaccctctccacctgggttggaacatacaatagtgaggtaaaaaaaccaatatctgaatgcataatatctgatctcatgagaaaatttacctctatgacaacacttncgagtgtaggtacatcaatgtgaccaatattcctgtaaattccattttgngagggagcactatcttagtaggctcatttcgagaaaacct

SEQ ID NO: 6484 - DNA, 736 bp, Oryza sativa
  unsure (1)..(736): unsure at all n locations
tatcatgaaaaattctgctgccccgatgctgtgcactcagggatccaccctccctgtctaaactccctgcaaaatattgcgaaggataaataaattactaacgaaaaaataaaatggttggtttaaacatgtgcatgaacaaaaattgaatgattgtatgaagacctcattctgcggatggccacatcttcattaactttgtttaatagttccctgtgttcatcatcagagactcttaattctttcctgagttcagtgatcaaactttctttttcctggacaaaaaatatacattttttattctcaacacaaaaaaggcatgtgcaaagaatggctactaaaactgttagcacaagattcttttttttatacatacatacccaggatatagcatcagattgcactttaaatgctctaagaacaccagtgtacgcctcttgctcaacctgatgtatttcactctccaaatcaccgtgcggcctaatgtaagaaaatggcataacagatgccctgccattcgcactaaaagatcgcactcttaatcctctattttgtgttggagggagatcgtcgtcagtccctgaaattttgatagaatgaacagacaagtcactataccatgaaattcactatatgagaaaaaagacataaatattttgtgaactacagggttnnnnnnnnnnnnnnnnnnnnnnnnnnnnnnnnnnnnnnnnnngatctatcatttcatggcgcg

SEQ ID NO: 6485 - DNA, 1297 bp, Oryza sativa
atacctttgctctgcttgcagatctacaccaacagaagagggaccagctgatactgttgaatgtattactgatccaaacgtcctgacaagcttcaccaacaattccagtgaaacacctaagtgcctgtgtagatttagcttttgtaagaaatacttttaattgcaatttaaaataaataaatgcatggcatataagatgttaagccaatcagtgcagtacggtacatacatatgaataaattgtctctaaccatttctatatactcccccaacaggatcataataataccaaaagcagcggtaagttacctgtcagttttactctccagaaggtcagtaaggacgggcagaataacagtacataaatctagtgtgattgtttcacttttctccatcagaacacttgcaacatcagcagatacctgcacttgccagaaatcaggttgttataactatgttgtttagtgcactgcacacggaagagaaatgttcaaagtactgacggcatgatcagacatcttctccattgctgcaataatgccccgtatatcatttctttgccacatttgatgaacaatctgcaagtcacttaaaatagtcagatacagcattcgagcaattgcattttgaaagcctacagattttagtattgaaaattctgagaatgcaacagagcaatttagctaattcaacaggtcatatttcagtataaagtatacaagtatcaacagcctgtcgtacactagaacactgcaaaataggacacaacgtatgcctacctcttttttctccatatctctatatcttattaatcaactcaaataccattgagaagtttgagaataaagatactagaagtggggggggggggatcttaaagaaaatgcaaagtaccatactgacctgcaattttgtcaaccgagatcgagttgagcttagaaatagctcatgctgctccattagaacagatagaacatcctcatcacttgctatcgttggagtttcagcagcttgatgatagctgaactaagcacccaccagaccagaacctgcctgcaaaactttccccaaggcaatgggagctatatagtgggtgcttagttcagctatcagggttgaatggaatccttctgcgtttcatgtaattttcgcacgctttcttgagcggatcgcacgagtgcgcttttgccaactccatgatgccgctcgcggtgtcgtcgccgatgaagcggcacaggttgctcgcgcacatcagcttcagcctctccatgggtgcaaagtggaattcaatgccgcg

SEQ ID NO: 6486 - DNA, 1359 bp, Oryza sativa
tgtcatgattgctcatcctgctgcctgcaggtcgactctagaggatccccctcgtctgctcgtgccattttgtacttaaaacaaggcgcgattccggctgtcgatacggcagagttatcccccaagtttctttatccaaatcactcaccaatccagtgacaacgctagcttaattggttagtggactagtatatagtagtactgtatagctctcgcgtgttcactcctcagtcctccctgtagtccaacgagtcaaatttgaaggcttcactgagcctttgacaatggcgccgcagctgccgctcgaggtggcctctgctcccaagctcgacgacgacggccacccacaacgcaccggtacgctctctgtcgccgagatttgttcgatctgtttggttcatcgacgagaattcaggcatgccggcaagtagtaaggtgctcttgagctcttctcttctaattttccttgtcttcttcttcttcgatgaactttcagggaatctatggacgtgcgtagcgcacattatcaccgcggtgatcgggtgcggcgtgctggcgctgtcgtggagcgtcgcgcagctcggctgggtggccggccccatcgccatggtgtgcttcgccttcgtcacctacatctcggcctttctgctgtcgcactgctacaggtctcctggctcggagaagatgcagaggaactactcctacatggacgccgtcagagttcacttaggtaattaagtaccttgattaatcctacttcagctaagttagttagccaatcttttcctcaggaagtccaattggtcaaatatagataccacttttggattgtatattgggtagcagtaaattaatggtatggtttttgtggcaacttggcaatatgtttagggaggaagcacacttggttatgtgggttgctgcagtacctgaacttgtacgggataggaattgcttacacaatcactacggcaacttgtatgaggtgaattttacagtttttttttcatacagatcttcaagtagaagattaaactgttgtttgttcaacctgtgcttaattaacttgttcccgttgacagggcaattaagagggcgaactgctaccacagcgaaggccgtgacgctccctgcgactcgaacggtgaacacttctacatgctgctcttcggagcagcccagctgctgctgtccttcatacccaatttccacaagatggcgtggctgtccgtcgtcgcggcgatcatgtccttcgcctactccaccatcggcctcggcctcggcctcgccaagaccattggtatagtagcttgattgttccatttgattgatgccgatgtcacaattcagcagtgctta

SEQ ID NO: 6487 - DNA, 2890 bp, Oryza sativa
  unsure (1)..(2890): unsure at all n locations
tatccatgtgtcnagcacatgatgatacatttttatgaatttagtttttgtttatcgttgcaacatgtttctgattctaaacatgtgcatgttagtgagaaaaaaactacagtaaagcctggtatcctgttagtccatttgttgctgttggtactttcagaaccatgcttgtatgacaaacaaaaatatcaacttatgcaattctcttcttgtactttctcttcatatcttaacaggatcagttccgcgattatatgcatcttgaagctgcacggcgagacttaagattaataattgagaacaaacagcgcattgttcttgcacatgcaccttcaggttacaagtaagatattctatctttgttagacaattgttgccatctactcgacctattctctttcccccctacattttaggtacatcagaacctattctgaactgtgtaatatgtgccaatttatgttatgccttctagctttctggcttgttggaaacttgattacttggatcttctctgattcatgtgttccattttcctgtgaccaattgcatggtcctagtgaaaagatcttaatataatcctgtactgaacaccatttgatagatgacctaattatgatgtatcacaaaactacagatttaacactaaatttatcacagaagtacaaatataaggtggactatcgcaaaactacagatttagtaacaaagttatcacaaaactacaggttttatatcaatttaatcgcaaagcttggacattataactcaaacataacattaatgctagatatttcaaccccaatgtctatagttttgtgataattttataataaaaaatgtggttttgcaatacttagccttaaaactgtagttttgtgataaatttattgttaaatctgtagttttgtgatacatcaccttacatctgtagttttgtgataatttggccaaagtatatgtaattttgtgaaatttactctaattatatatctattcatttggttgcctatattcccccagctgtctcaatggtctctgttttttgtttgattggttatgtttgttaaaggcatagcctgaaggaagttttggatagcccaagtgtgatgacactaataaaagatacaaaggcggcgcaggaggtaagccatattcagaacaagatatatcactaaatgccctaatgtacacctatggtgctttctcaaacagttcccccatgttgatataatacgcactaaggcactaagcacattcaaaacaatttctaagtacagacagcttctcatatttgttttctgacgctcttatatttcctttctaatttgcaggtccaagctttgaaggacttcttcaacatgcttacaaatgtaaagcttcttgaagaaaaactaccttctaacagttggattgaaatatcctactccatccgtttcatattgtaagactttctagtattgcctatattcatatatatgttaatgaatctaaacatatatatgtgcctagattcattaacatctatatgaatgtgggcaatgctagaaagtcttataacctgaatcagaggtagtatcaccctagcgtatctggccatgtgttcaggacttctattacatgcctggataggcttaggaagctgactagtgaataactgagctaacagaactccactctatgatttagttccacgtcacgctaccgaacaaatcgatatagcaaacaacaagcagtatttccccaatttccagacgcacttatccctgttgaggtcgctgctgcccgtttatcaactcccgacagccacatttcacgtaatcgcatacatcatcttttttcctttggcacacgttatgcatcataagaaaggcccaaaaagaaaacctcaccatgatgatgttgagatcctcctgcgggatgttctccaacgatacttgcttgatggccacgaagtctccattttccaggtcaagccccttgtacactcgcccatatgctcccttccctatttcatctccgagcatctgcaccggcccccacacccccccccccccccaccatgcacacagtcagtgagcgaaaccaaacccaaaattaacaccaccagaacacgaattccacccggatccgaggcggtaggctccggaacactcacatatttgttgtcgagcgtcttgttcttgtggaactgcgcattgtgctgccgcgacgccattttgccccgccccccacacacacccaccccgagatcgggccccggacgccgccgtccgcggcgggggcggccggatcgggggtcactggcggaacgggaacggatccggcgagcccgccgcgagggccatttaggttttaaggtttgggtgggaagggaaatggaggttgaagtggaaacatgacgatccaaaacaagcacggtggcgattgtaaaaataaaagacggtgaggatgaatggggggctttttcccaattatttttgtttttggcgcgcgtgcggaaatgcaggagcccgaagcgttggttccattggtgggggctccccttttaaaacgggggttatacccccccccctccccatattaagtcccccccccacctttttttntttgttgttaattttattttggaggttgggggtaagattaaggggccccccccccttttttttnaattgaaaaaaaatagaatttattnnngagttagggatatttttacaggattttttttgcgccctctcttgtgggcgtgtgggatctatattttatagtggctctatgaagggctttaatcagggttgatacaatttatttgtttacataaccccttggggccccaacatttcgtgaatcttataaccgtgtaggagctattgtgttgcgggcgccn

SEQ ID NO: 6488 - DNA, 692 bp, Oryza sativa
  unsure (1)..(692): unsure at all n locations
ggatttnnnnntnnnnnnnnnnnnnnnnnnnnnnnnnnnnnnnnnnnnnnnnnnnnnnnnnnnaatttttcaaggctgttgcacgccgagatggtcgtacagctgcagaacgtacactgaggttatcaaaacagcaaaactgcccaaatccaaaagccttcattgaggtaattattatttcttgtcactggtctgtttcttggcagtaacacctctgcttttccttgttgaggtcctcggtgcaccctttagtcaagataattatattgctgctataataggtggtatatgcatctttaagatatgaattgatggcaagatgtatttgggcactgtaccttgctggaaagcacctgggatgtttaaattttgagtaaatttcataaaaccccatctatatggtccaagatgcagaaaactatagtgcttttgacaagtggcacataacctcgtgtaggtactaaagtttcacaaaaccacaccgttaaccattttggcatactcctatatcaaaattttaaaaaccggatataacagttatacgatggattaaaaaactcataaatttgagatgtgattgtataaccccatcaagtgtggttttgtgaaactttaggaccataatacctggggttacatgccacgtgccaaaatcactggggttttgtgcaacttggacaatattatgtggn

SEQ ID NO: 6489 - DNA, 694 bp, Oryza sativa
  unsure (1)..(694): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaatagcagaacttaccctggcacaatcccagttatggaatatcgacacggtaatgattccatgtcaagattcagatgatctcccagtaataataattcatatctatactctatcaactttggtgctttcctgtattatgtttcgcttcgagctttactgttttgagcaactttaaaaataaaaaatatagtgaagaaacaggagcatcaagtgcgcctatctgtattatatgaaattaaaanctgtattagttaatctgttccaaatctcagtgcggtgnnnnnnnnnnnnnnnnnnnnnnnnnnnnnnnnnnnnagagtatntacaatgcattcaagccac

SEQ ID NO: 6490 - DNA, 784 bp, Oryza sativa
  unsure (1)..(784): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaannnnnnnnnnnnnnnnnnnnnnnnnnnnnnnnnnnnnnnnnnnnnnn

SEQ ID NO: 6491 - DNA, 1438 bp, Oryza sativa
  unsure (1)..(1438): unsure at all n locations
gcgtgcccttgtttgttctccanctcggtaccccacttcccgagtaccttatcatcctttccaacacatacctaggtctgccccttcatctgcgcaagtcgaggaaaatcgattacgtcccactgcttgataaaattggatctaaaatcccgggttggaaggggagatattactcatcagttggaagggagactctcgttaagtcagtgttcacggcaatgccggtgcactatctcactgccctgccggccccaaagtgggtgatcaaaatgattgacaaaatgagaaggactttcctctggaagggagaggaaccggagaacgtcaaaccggggacgagtctagtaaactggcagaccgtgtgcatgccgagagatttgggaggactggggatccttgatttggaaagattttcattggctttgtgactgnnnnnnnnnnnnnnnnnnnnnnnngatcacaacaggccttggaatgagatggaactacctcgcaacgcaaaagatgtacaactattctaggcttgcactgaaattgttattggaaacgaaaagaaaatcctattctggaaagacaactggctacaaggaatgtgccctaaagatatggccccaaacctctttcaacttgcaagaaggaagaacaaaaatttaataactgaacttgatcacaaccattgggtctactcattcagagaaattgacaatggtgaagtaatccaagagcttgtgcatctcggcagccttcttactcaaacacaactaacgtcagaaaatgaagactacataatctagaagagaaatagcaaaggtatatattcagcccaaagtgcatatcaattccaattcattacctgtcaacatgatcagaccttcaaagccaactggagagcccaggcattacccaagcaaaggttcttcggctggctcatcctgcacaaaagagctctaacagctgaaaatctgctaatccaccattgggaatgtgattggatatatcccctttgtagaagcgcctgtgaagacactgaccatctttttagggagtgtgatttcatttagaaccacttggagtcctagtggcggtagnctcagcggcatgcaaaactgcgattaaattcaaaactccacccgcttgaatggattgatggcttttagctcatggaaccaaataaggcttgaatcaaaaacgaagagttgggaattctggatcanaaaccttggtgacacggtttggcctacaaataaatgctaaggtcttcaagcaacaagagccatatgcacaccaagcggcccagcagatcggggaagacattcaagaaaatgagtttgtttttcagcctccttgatgaagtctgctctactgctttctttctttctctattgcggggatcctctagagtcgngctgcnggcaagcagattgtgcattcaatgcgc

SEQ ID NO: 6492 - DNA, 17967 bp, Oryza sativa
  unsure (1)..(17967): unsure at all n locations
cntgcagcatcggagtaacttatggtagctctacaggaacgcccgaaccttgactgcagatatggaaatgcattttatttctaatccctggatctgtctatcctgtatttatctttttatggagatttgcgtcaggatggctatgtatcagctctcagaacattcagcttagtatcacagcaattgtactctttacttgttttcacctggtacaagtagcttcagtggatactttgtgatcataagttcagaactgaaagcgtaactgaatgatggatatcagacacgatttcttccctgtggatactctgtgatcataagttcagaactgaaagcgcaactgagtgatggattatacacgatttctctctcctgtgccatgtctacagaagctgttctgttcaattgcccccaaaattaatgtccaacaagcagcgatcttgaattgctctgacgtaaacaagtcaggatcaacctactactatttacaagatctagatgccgcaatttgcacaaggaatggaaagaaacaacacgattcacaattggcacacatctaaacgtgtgccctctatgcactgtcactcaactcaacatgcaaaggtaagacaagaaacatagacccagcatcagcatcaatcagcctggtgatgttttccttccattttcaccttgggctgatctcggacaccgtgggtggcaccaccgtgctgaacatgtcggaggtgtcggacgccgagtgcttgaacctcgagttgctggagttggtggccttggagaccgtgccattgtagtcgtggatgtagcccggcgccgtgagctcgcgctcgttgatgcggatgggcttggacagcatcgtcaccacctgcggcattgacgggcgccgcgccgccgccgcctgcgtgcagaagagggccgtcttgatgtaccggaggacctcctcttcagggtaatctcccatttctgaatccaccagctccttgagcttccctacctcatgtagctcccatgcctgttaattgtgaaagctaggctgagtttggcagcaagagttggtaactcatcccccacacgcacgtaaaacggagcgactcattagtacataattaactaactttttttttttcaaaatatggattaatatgttctttttaaaaacaacttctcttttgcaaaaaaaaaatagcgtttaacagtttaaaagacatgcgcgtggaaaacgatagagatgagttgggaaatatagctgcgtaattaacacggccttaattgatgcagaggctggaattatacttccattctctaataaaagatttagatggagagtccagcgattacggcttaattggaatgtctctagagcaaatgtctgaaggtgaaagcaaatctctgaattttggatagtaaagatgatagtaagactgaccttctctaggagaatcttatcgtcagccaggagactccttgaactactcttgccacttacgatctcaagtacaaggacgccaaaactgtatatatcggctctcttcgtcaattggccatgccatgcatattccggtgcaaggtagcctctgcattgaacaaatagatcagttcagttactgcaactgcaaggttactttctactcaaacaaactgctaaatgctgaaatactcacgtcgttccagcaacacgggtactgatgtgggtgatattatcagggaataacttggctaaaccgaagtccccgatcttggggttgtaaagcttgtcaagaagtatattgctagccttgatatctctgtgcacaatcggtgacgcaatctcttcatgcaggtatgcaagtcctttggcgattcctatgcatatagcagatcttatgctccaagtaaaatttgcaggttcgctattagaacctacagaacacaagataaaaggttaagcaacaaacgaaatcaatgcacttatatagaaaaatagtcattgtaacatatcaatattcatacccaacaatgcacggtcaaggctgctgttttctaaatactcgtataccaaaattcgattgtttccttcaacacaacagccaattaattcaacaaggttgggatgcttcacattggtaataacatcaatttctgtcaaaaattctcgaacgccctgcctggattcagcagaaagaactttcaccgcaacatctcgcccatttctaatagttccctgaaacatcaaagcattggtaagaatgcaaggactgatggcttcagatttgaaagggatataaccctcaatggactcctcccttccacatataaagaaaaacaaacattaccttgtatactgtcccaaagccacctcggccaattttattactgcggttgaagttttctgttgctgatctcaactcagaataagagaaaagccttatgtttttctcaggcggaatacctgaaagttagttacatttagttaagtaaagcatggaatcttaaaatggagcttcagtactggcattctctagcctaatatgatcgaatctgtgatagggacaatatacatgtttctatttcataaactctgttggctgctatgcaaattcagcataaattttgcaagcaaatacagttcgtaccgctaacgccatgagagtaaggattctctcctttcttggattttggaatgcaacaccaccagctcatatcctcagttgttgtggctgtcttgtacacttcaacatgcagaagaggaatcttcaggaataattattctgcaggaattcattgcgaaacaaccacttagagagttgcaaattgagttcatttgtacattttatatattttggatatatagtacagaaaagggaaaataaaaagtaggacatgactctctttagacagaagtctgcgcaaaacttcttgttagaactgataggtagatgcagatccacccacattagcctgtactagagtaggtcaggaactggagtacaattaaatctcctttttgaaaccgagtacaattagatcttaaatccatcattcctcatgattaaagcacaaaagaacctcatactggcaagctttcaatgataactgattaatcggtgccatgattgtgaacttgcgattctcatgatgaaaagaaacatgacccaaaattttggggatgccaggtgcatttggaccacatagctccaatctcaggtgaatataccagatgttccactggatccaatggccatgtatggcacatgtaaatactaggttagcacctcatccactgaacagttcacatgatttgcaaagcaaacggccagatggcatagctgccaagaacaatcaccaaagcaagctgaagtttggtgatttcttctaacaccatggtccactcgcctcaatctgtatgcttgtacatatgcatattttcatgggagtatcagcatgtcttaaaccattatcatccacttcttttccccaatcaattcaaacacctcataagtaacggatcatccaacttgtttattcagaccacaattccaagaattcttttgttcgcatcccagcggatgattcgacggcatcacttattttcagaatctctgtccgaatgatgctttgccactcaagaaaaactcttgacagatcgtcatctgatgaacacaaactcccagagcatcaccacatcacaggtcaggactccagacgcatcatcagaaatcaggtggagaaactctaggctaaaactagtgtgcgagaaagcccaagaactaggaaatcaagaacacgaggggataaaaacaacaagaggcaagaaatgcttcgagaaagcagcagaaaagtaccaaagaaaaacaaaacgttgaacactatggttacctttcttgcttggcgctctcttccgatgagatcgacggcagaggagatcgaagaggacggagaccaaggaagtttaaagggggaagagaaaggtggttggggctcaattatcagcagatatatctgtagcagctggccagttgagcgaacttgctaacgattgcagtgttgcagattggcaggttcagctcagctcagcacgagcaacagcagcagctgctgcaataaagaccaacagcgaaaatggtacgagggaagaaggagctaccagcacgccacaaaacctaaataaaaagttggaacaaaataatactactatcaagaagatgtaggtgagagatagcagccggctgggaatgaggaagaggaggaggaagaagaagaggtcttcttgctgatgctaattgctattcctacctcctactaagtaattgctactcccactgaagtccctttgataaaaaaaattaaaaaaatcactacttactccgttataaaatataataataaattattttagttttcttgttcctgaaaatattctatctatctcctaaaatataatagtttcttcatcagtattctattttcaaccagttaaagcaacttatcttttaatttcttcacctaattaattttctcaactaatcatattcttttttaagctttggtccttcttaattaattttctcaactatttttttcttttaattttgtctgttgttcacactactttttctaacctcaaattttttttatatttcgaaagagagataattctgtggagcttgcctggatgttgccacctgccgccaggcgtggagctgtcacctgtcacaagaacactcaatagctagtatcctgctaattaccagcgcgcgacgcaatcgctgccgccatcagcacagataattagcattaagccctgcccgatcattctccctaattattgcgagaccaagattattttagagtataattaggtgctactactgctggtattgtatcccaaccaacctgccggtgccagccagggacattgctcgctgccctgagcctgtattggcgcctaacctgatgaatcatatccatcagggtcgtcgcgtactccgaccgcagatcgatcgatcgcacgccggccacttccacactggggattgtctgtggaactagggacttgtttagttaccaaaatatttttcccaaaaatatcacatcgaatctttagacatatacatgaaacattatatatatatatatatatatatatatatatatatatatatatatatatatatatatatatatatatatatatatatatatatnanctaattgcacagttaatcgtaatacaatttttttagcctaattagtctataattaactataagtgctacaataactcacctgtgctaatgatagattaattaggcttaataaattagtctcgtggttttcagacgagttatgaaattagttttttattcgtgtccgtaaaccccttctgatactgataaaacgtttgatgtggcacccaaaatttttttttcgtgaactaaaacaccctagcttgatcatctggaccagcggctgccaacgaacgaggagtcagtagaaaaaacttggtgttttcatcgctcttgtcactacgtgtagcctacgtatgttaacagtacacgaaagaggagagatatttacgtgcttgagaaataattttctacggtcctgtcgtttcgctcacgcttatagttattcttattcgtattacttgttagcaatcaaaaaataatttaagtaattattttatgtgtgtacttgatgattcagaattaaatattgtaaaataaactacgatgaacaaatcatgaaatcagcttttaaaatttaaattttgtcttataggtttcactataagtgaaatgataaggttgtacgtatcaaagctagggcatgttgtttttaaggaattgaagaatggaatgcatgagttattagacggtgtagttttcacaaagaaattttctgaaaaaaatggattaatacctgacctctaaatccaaacagttgtacacatgaaaagaaagtaaactgctttaaatttatattttaactctatgtggtcacaaaatcattcatctaacccgaacaaaaatcaagccctaattagagttaattaacgcaagttaattaatactactacatgatttaactcctcgttttaagtgagctcctgtgttttcttgctgttggcttaggtggactggtgacgagtcaacgactgacatccgctgctatttcctgttttggttttggatgattgctgccttcttgtcaaccaattatgctctgttactgttgatgttcacacgtccatctggtgtgatctgatttgttttgaaggagtctacgccacgatcatccaattgccctattgttgttgttactgtataagactaatgtgactcgtcagaagcgaagagctccatatctctgacggcatcgtataaaaatagtattatgtgttctctcctgttgtgtttttgttgtgttgtgccaaactactacttttcagcgtgacctaatcctttcgtcacaggttgtcaccagccacgagcacgaaatgataatgcatgtcattgatccttctcataaatcaatcgtatcttaaagtctgaaattaacgttttttttatttactactactcagtttaagtgagggtgatcactacctttgtcattacatccattggtacagcacgcgcgagagcgaaaacttttacaaaccctcaattaagcctcatctaaaatgaatacaatgggattttgtttatgaaatgaactaatttctataaaaatcctgtaaaattcctatgttcaaaaataactcctaaacatatgaattgttggaaatttagaatgaaaatgctagaagtattgtcaccaattgtttattaaaaaaacatttgatttctgaactgctagattacatcaaaatttggaatgaaattgctagaactctatcgccaattgttcgtcgaaaagattttctatttctagagtatcatattgcatcaaaatttgttcagggagaaggggaaaaaaatgtacgatgcgcatggaaggtgggtatagaatgcacgatctgcaagacacaaacacgtgtctacaggtcaactgtgtcacacgctgtttttataagttaaataaaagttactgtaaccatactatagttatgctctaaagattttcttttttcttaaaaaagaaaactgttgtcagatttggatagccccaatcaataatcatcagtggaatgagacgtataaccaacgaatcatcttgcggtaacgtagccggccggccgccttcccacggaggccggcaatggtgattcgttgaacattttgatcgattcgccgctgctgacctcccagcgttgatggcgatccaaccatatcttaccatatatccccgagcatccctgctaagagcaaggataatagtgggctataaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagtaagctatatgtttatctgaaagagaaagataaacaaaaaaatagggagtattggctctcatgcaagagttaactgcacacaaactccaagaaatatgcattaaattcatggtgagagaaagagagaggatgaagaaaataatgataaacttatagccaatttactatacatgttagctttaacattgactaatagtaagtagtgagctctactattaaacttgctctaatgctgccaatggcaacactgttagcttccataattactgcgcattatactgcctcatttgaccgtggattttttttctctgcatttctgcctcctgttcgtggccaaaaattcagacaacgctgcatcagacgtgttatagtactcttgttatttagtatttgacttgaaggtcatctaatctaccggtagagaggcacattcgtatgttgctcattatagtggtacacttgttggttagtggtaatgctatccagtgggcaggcagtggcatctccattgcttttcgccattattatcaccgtgactccagctgcttcaccatgtgatttgctgaccgtcatgttggtgcatgcatcaactcttttcccatgtgtttcttttcacataaattgatctgacgatcttcaagttgcttgcagtaatacgtacagttcgtttggtaaaattcagagaggtgtatcaatagtaggagtagaatgaaccttgtgttcagcttccacgcaatgtcctccgacatgacaaatgacagtttatgggactagatcaaacgattatctatttcattatctttaaaaaaatcgacggttcagtcaaaaagtactgcatttcttaggataaattactcgttattgttcgtcgcgatgtgcagatagatgcagtttagtttggttttgcctgcatccacggatgataggtacttgacagaacaacgagcactatgcgactaagttggatgcttcagttttacaggaaaaagagcagaggactgatgttgattcaacctgcagtacctgaggccacaacactttgcctaagtcatgggtcgttgacatttgatatctataattttctttaatctatagcgtcttttactaacgaaataagattttttttctctgcctcaaaaaaaccaagtcaaaaggtttcaaagatgccatcttgcaaccaggtgccattccatgagggcagcggccattcatttttcacgagcttcactatttatgtatagtaccatcaaggacaagttcatttggcgttggaccagcggtgactactcaactctttggcaaagtggcggaccaaccaaatgtaagctttttctttggttggtgattcagcgatgctgctggatgatcgatagtatgctcagttaagggatggagaaccactcgatgtgccccttctgtgcgcaggaagaggagataacaaaccacatccttatctattgcgtctttgctaggtaagtcttgtgcaatctactccctccgtactagtaaaggaaatggtttaggataatgtttaagtcaaacattagaaatataaattatgaataactctcaagttattaagtttgaaaatgtaaaacttatatgaatagatttgtcttgaaaacactttcataaaagtatacatatatcacttttcaataaatatttttatagaaacaataagtcaaagttgtgttttggagaccgtgtcactgtcaaaaacgacttcctttacaagtacggagggagtattgatttttgatggactagctactctctcaccaggccgtcactcagtgctctaagattagtggcaagcttttgcggcatcgccaccataataagagtaggaaatgtctcgactcccttgtcaactatggaaggagaggaatgcccatgtccttgatgatgttctatctcaagtgctgatggtggtggagcagattgtggaagaagggaggcaatgggtggcgacaactgccaatccagttggagagttgttaggcacatagcttagttatgtttagtgtagtttcttcctctctcggtctcagcttaggagctttgttgggtgatcgtctaggcgtgtcactttttttctaatatattaacatgcaagaggtcatagcttaggagctttgctggttgatcgtctcggcgtgtcacttttttttctaatatattaatatgcaaagtttttttacgtgttagcatatatatatatatatatatatatatatatatatatatatatatattatagagagagtaacgtctctgactttttaaaggtgacaagaacagtagatcgcccattggaattatccatagaaagctgatgagtacgatgaattaaagctggtcatgggattggtcaattaatataacactatatgattgccttttttttcctccgcttggtcataacaaaagacagagaattgatacatagggctcggtcattttcttctagatacaagaaaattttgccccgttcttttctaattaagattcatattttatctcagttttcgttagcacacttttcaaactactaaacggtgtgtttcgtacgagaactttctatatagaagttgctttaaaataccaaatatgtggatttgtcaagtttgtaataattaaaacttaattaatcatgtgctaatggcattctcgttttccgtacgccaacttaattttcatcttcatcggttttatgtcaagtcagcatattttactctaccaattactagtggaaggtgcaatgaagctgaaaaaacatgtgaggaaaacctgcagattaaaaatatatttatatagaactgatataaatatatttttaatctttatatagaacatgtgaggaaagcttgtatgcaaaaactttagcatgcatccaagctttgaaattagctaatgatatgggaatgggccacattattgttgaaactgatgctcaagctctgaaagcggctttgttggatgaaacacatgatagaagtgtaaacgctgttatcattagagaggccaaatttttgcttgcaatgaattttaatgtccatcaagtcatgtattgtcctagagaatgtaatcgtgctgcgcatgagcttgctaaaattggtgcttctctgggtccacgaagccaatttgtttggcttgaaggattcccggatgatgtttgcaatttggtagctagtgattcagctggactacctgcttaatggaattgttcttcttcaaaaaaaataaaaatatatttatatagaactggtcaggtgaagaaatgctactacaggccaaaaatactggtgaactattattggacctgagcattattccgacaaaacatattgaagctgaaaacatgggcgaatcacctgtaaattaaaaaatctagaactgggcaggtgaagaattagtgctactataagccaaaaatactggcgaattattgaacctgagcatagaattattcagacaaaaaaaatatactactatatggcatcgtcgaagtgtcgatcgagtcgttgcatatttggtgagctgtgaccctaccatccaatccatggtcgcactcaacgcatcttataaattagttagatatttagtagttttaaatagaccgatacgtgcggaaaagatgcttcttggaatgttgtttgggattcaaatatttaaatgcaggacaagttggataaagtattagcgaccatttctcatctggagaagcagtctctgatggaaatacttaaacgtatgaatggaagcacacgctttcaaagtaaaatctctgatgaggattacttggcttgtctgcatttgatctgaaaaatccatgtagcttttgtggctgttttagtgtgggcggctgcgcacaaaagtctagggtcaaaaggctgggagagatgacaattatttggagagttttcaaccgatacattgtcaaaatcatcccatttctcctctttgaatagttccattttctctctttgactctggaatggagaagaatctttgtctctttcttttgttagtttaccctgataaggtagataaaatcttgcagctgctgttgatttcttcagagagagagagagagagataaaaagaagatttcttaagagcatcttcaacagatgtacaaaattagaaccccaaaaatcccagacaaacgcgagagatcatcttcgattcttgtactggcccagaaatgatgtgtacgcgggtggcccaacttgttcagtccacacggcctgacggcccgcgtgcgagaatagcccagcggcgcaagggagcctgggataacggcctagtacgcggggcgggggatgttccttgatgggccttcgcagcttctcatctcggcctatggcccaccgagcatctaaggccgaaagccgccacagctcacaggtgtgcaatgggcccggcactgcgcttctgcacgatcagatctgcaaaccgtaggtaaagtcgcatcgtcagggtcaagctatgggataagtgccgattcgggtggcttccatttttacgattctcacaaataaatactccgtacagtatcttgccctatctctatgcactgctgctaaatctgacgtactgctactacataggaagaagtcacatccagctacatgaatctggataaaaggtagtacagatttattgtcttagaaaaaatcacatccccagctacatgaatctggataaaagggtagtacagattcattgttttagaagaaatcatatcccctccaccatttttttttgggacgaatgaagtacttgtcacaagcataataaattttatatatctggataagtttttttaagctatttcccttgttttaaaatgtagattcattatattataaaatatcgtatcataataacattttaaaacaggggtaatatataatttgacattaatagtactcttacgtatgaaaaaacttgtctaaatatctctaattttattttgaaacaagccttacttgtgtggacggagatactccctccgtttcgaaatgtttgacacttgatttttagcacatgtttaaccgttcgtcttatttaaaaacttttgtgagatatataaaattatatgcctacataaaaatatatttaacaatgaatcaaatgatataaaaataattaataattacttagacgaatggtcaaatatgtgataaaaagtcaacgacgtcaaacatttcgaaacagagggagtagtacaaagcgagctcatcagtgttcactccaaccgttttaggttgtgtttagtttagcacaaagtttaaattttgattgaaattagagatgatgtaactcgcgagctcatcagtgttcactccaaccgttttaggttgtgtttagttcagcacaaagtttaaattttaattaaaattatagatgatgtaactgaaaagttatgtgtgtatgacaggttgatgcgatggaaaaagactgaaatttaaatccaaactttagatctaaacacagcaattagcaaataagccaaaacgaaccaacccaaaaatgagatgtgcatagccaaacaccatttactatcatgggcaattataagcaacccaaaaaagagaccgaactggattgagtgaagcaaactctttcttattcatcattcatagtatgtaccatgacatgccacccgcgaccgagaatatacattgccgagaggcgagagcccaaagatggacataaaaatttaaaaagaagaggtgaaaattaagtaaaaacaccgcagaaaaatagattggcgcgcttccacgctagctgcaaatatcgctctaataatctgcatgcttcggacggagaagcacatcggatatagagaggaggaagaagaggaggaagagatgagcggcggcggcaaacggcgagaaggccggcggcgagggcaggcgcacggcgacgagacgacggcgtacggagcgccatcatcaggcggcagcgtcgtcccaggtggcggcccagttggtggcgctgccgacgcggggcatggagttgatcttggtgaaggtgtcgaccttgaaggtggcgccgcacatgacgccctcgctgtccacccgcggcatcgccttcagccggttcatcgggtgctcgaagctcttgagccccccctcgctgtggaacatgcaccccaccgggaacggcgcgtacgacttgccgcaccctcccttcacgatctccctctcgtcgcagatcaccaccgacccatccgccgcgatcccccaatacaacggcacctccccatccgtactttgcatcgcgcaaagcgaatgaacgtcaatatataagaaaaagaaaagcagaacaatcagaaactgaagcttaggaactactacggcggctaaacacaactcctaacagcgggaaggggacagggccacgctacactcacaggaagttcaatttgaagcacaaattcatcaattcgattcagaaaaccagtctagtagtggtttaaattaccagggcggcgaagacggcgccggacttgttgtcgaagacgacgaaggcgaaggagccggagagatccttgacgacctggtcggcggggtaggggccgcggtcgcggagggtgcggtaggcctcgatgacgagcagcgcctcgttggtggagcggctgcacagcccgtactgccggatcaggctgctcaggttgtccagcctccccatgaacacgcagtagatgtcatccagcccacagaacatcctgtgtacacacccattaccattattatcgatcccctacgttttaatcaccttaattattcggattcattgcctcatcgattaaattgatttaatttacctctcgtagccagagaggccattgcgggcgtggccggcgacgcaggcgagggcggcgccgccgccgaaggaggtggagaaggcctcgatggggtggagggcgtggaagtccctgaggatctcgtcggggttcttgggcttcgccgcgctgctccgcgggctgttcagctccgccggcgcgtgcgccacctgcttctggaatatggccaacattttcttcttcctcttgctagctagctccgacgaatcaaactccggcgccgacgaagacgaaagaacacgtagtactttagcttagcttagcttgagctgctgctgctgttcgttgcgtgaagatgagagacgtgtcgggttggcgagtggaatggaatggaggtgaggatagagatgtgcacggctttatagacgggatttaggatggcacgaacgcgaacgaaaatatcctatccatccctcgctcgcgcgcgctgtttgatgagcgtgttattggagtcagtgctgatgtgagaagccaaagcaagcagcgaacgggataaagacggcgagacgacgaggataagatcatcacgtaataccagttgccgctgccgatgtgacaccagtagtagtaaccggccaccttaaccgtgacgtgcggtgccctcaccccctacggtaccctgcacccaaagcctacataagtaattgtttactacttccgttttaaaatataaaaaaaattaaatagatataacacatactactaatctacatagaaaatttgtttaaatttatagtattaaaatttatccatctatataaatcttttatattacaaggcgaaaggagtattacacacctcctcgtgttggttgttgatacggttttcttccgtttctatcgagtcgctgcacgagcactgttttcttgtgaaattcctaccctgcacaagtgaggatgctgtacatggtctacacaaaacgtgattaaaaagaaattcgcaagaaagaaagagcaaagtagaacaaaagacaaactagtaaactgatgtcgtagatctgtagaacttcatgtttttgccgccggggtagccgagtaggatgaccggaggtgagcgaaaaacggaggaaacagcagcgagggacgccttttccgtgggctgccgccgttagtttggcgggagcggtttattatattaccccgtaattattgctcgctgaaccacctgtcggacacgtcatcgcctactcgaactgcgtgctcacgggggccacctctctacggcctccgtggacgcggcgtgccacgtaggctcgcgcaccgncctcacagcctcacccaccgcaactgccacgtgcgcgccgcctccttcccgtgggctggggaggtaaacgccggtgagcgccgagccgtacactgacagggtggggcccacaccgagcgacgacaaaagtgtgggcccggattggggataaggctggcacggtatggtcgctcggtacacgtcacccgcgcgtcggaccggagcgataaggtccgcgcgagcaagcggttgagccggacgcggcaccaacgtgttgtcacgtgtccgactcggcagcgagtcaccttttttttttctctcttttctctctcttggcagggcggcaacgaacgtgtttatactaatagtaatcccaaggttgtggtcgcttgtacgcgtgttaattatggtgattaaaacctggtcaggtcgatcgagcggcgagcgatgagcagttgagcacatgcattggatcaggaggcgtgactagagtacaggtcgccaggtcggtagcgctgatcttggatggccagtagattggccagacgcttatccaggccagagttgttaataatctctatattgctacttagatgtagcttacggctgacagaatcctgctgatgagatctagtatcctctaccggatcatgacagtccaaactgtgtgtttacataagcagtatggaagatgtcaacagatgctgcatcgcaaggagccaaggaacaactcgcatgaaattgttgtactagtgtaagttactccctctgtgtttcatgttataaggcattttgactttagccaaaatcaaactgatttaagtcaataatttaatatattttcataataaatttgtcttggcttgaaaatattattattatttctataaatttaattaaatttaaagtattttgactttgatcaaattaaaaaaaaatcttatgacttgaaacagagggagtactgctaagggatcgagtgcatgcaggttgccagttgtaatagttaggaattaaaaacatatttattgttatccgatggtattgtagaaattctatatctatagccttttgcacgcttactactgccacacgctcatctcatgctcgacagctccaggaatactagctagtaagtcagaaacggtcgctttcgtcgtcatactttgtaattatgccattttaattttgctccaggagtacatttctttggcatgtttctatcctacgccgttggattcttgatacttgccaactttccgttctgctttactcgacggagacgtgcgtttcacaagctctgattggtccgagcagctgacggagatgtgactcagcagattaattacctttatttacatatatagcaccaataatccaccactagttaagttaaaactaaaaaaaaatcgatgagggtttaaggagtgtgtgggacagagtcgcactgatgaagattaactttttgtttgaaaacttgatcaagattaacttttatattaactgtcacttttcactggagcggtggtgcacacggcttggccagatctagcggcgcgtaaggtgtggtgagactcgtccatcggcgggcgcgtggaccgctgcgtgttcagctgccacatcgccacgtcgactggtttattcaacggcgtaccgcttcttacagttaacggtaagcatcggtacgtaccctgcatgataaacacctagctagagtacttactagtgcgtacttacaaaattcattagcgtactgtgcgtatatcatgttcaatctgcaccaaacgtcccaacatccacgggatctctccccttccatgtgggaccacctcaaacatgtggagcggctaagagcaaccacaatgtggcaaaaaaccaggtaacaagcatttatttcaagcctactacccagtagtaagcattgtgggaagaggtagtagttaatacctgatatttgtgctattgccggtaacaaccaaataaggggataaactagagtcgacctgcnggcaagcagaatagaattgcaatcaaagccat

SEQ ID NO: 6493 - DNA, 4326 bp, Oryza sativa
  unsure (1)..(4326): unsure at all n locations
catggcttttttgaattggcgtttgactgcaagtagctcatcattattccttgatacctggggtgtgtataacttgactagttgggctatatatattgggtcaacttgatattagatgtgaatgcttaaccatgcttagaaacattagcacactattgggataacttatgattcactattaattaatgatggcttactgatagttcacgatggtcaatcgtgattgggtaattaattatttgccaattaaaacctgataatgttgggttgagagcacatggttttgagagatcgcgctcatgacaattaaggaccggatcacgagtttcggttgtgaaacattaaccgtgccaaccacaagacagcgtgggcaacggctttacctttggtatagcatggttcattgcggagcaccagactgagaagtggcggagataagcccacgggggtcgctggggagtccatgccttgtttataaaggggtgattatgatccaagaaaggtgcgctgccgtggattgcgttgtgcgaggggtattgtcacagatcctttccgaggtaccgcggtggtattgaggcacatggagacatgatgtggtgctagttcttgtgggtacacgggtacacctactgtcagaggtaaactattcgaatagccgtgcccgcggttatgggcaggtctaaaaatgtctttcatgattagtctcacacttctcaccttaataaaagatgctataactggtaataatttgattagctcctggtttggaatggtatattcctggtttggagatagaactgtacagccgggatggttgttcagaatggttgggcctatacaacagggtatgttgtatagcgttggattaatattgtttaattattacttaactgttttattaaattctgaaatgtttatcaaatgctgtttatgcaaatgaaaccctactatgccatcctttgttatcctgtgcacttgcatatttgctgcgtggcttgctgagtatgtcatatactcacctttcaatcattcatcagaggaaaggttctacagtgatgctgatggtgtggaggatttggtgtagccctggtcaagctgcctgtggagtggagtcgtctgcgccgtttatcttatctttccgctgcttagatttttattgattgagaggaactatctacctctgtaatgacattttgttcgcttattaattagagtaataattgtactcaattatcaatttgttattgtgtgcctcggctgattcctggacgagggttcacacacatgtaagcgtttggaattttggatagaaattccgggcgtgacagtacgtgaagtacaaaagctcgcaggccgaattgcggcactcaatcgattcctctcaaaggcagccgaatgaggtttgcccttcttcaagaccctccggggcacgggaaaattcacctggacacccgaatgccaagcagcgttcgatgcgctaaagcaatatctgcaaagtctgctcgctttgatcagcccggcgccaggaagcgaactgctactatacctggcagcttcgccagtggtagtcagtgctgcccttgtccaagagacagagtcaggccagaaaccagtttatttcgtctccgaagccttgcaaggagtgaagataagatacattgaaatggagaagcttgcttacgccctggtgatggcttcatgcaagcttaaacactacttccaggcccacaaagtcacggtgccatcacaataccctttgggcgaagtactccgaggcaaggaagtcactgggcggctcagcaaatgggcggcggagctatctcccttcgacttgcattttgtcactcgcactgctatcaagtcccaagttctaactgacttcgtggccgaatggataccagtgtttgccgctgagcccgagcccgtcgaacaaccctaggtgatgtactccgacggctcgtggtcgcacaaggggacgggcgctgcgacagtactcactttgccagggggcgtgccgattcaatatgccgcaaggctgcagttcgacataaccaacaacgcggcagaatacaaagccattcttctgggcctgaaaaaggcgaaagcattggtgctttggcgcttgctgtaatgccccgattttcgtttgggattaaaaatcatttaataatgcattttctagaaattaaataaaagttagagcaatttaatcaagtgaaattatgggggaaattaaaattttcccttaaaaatcattggccgataatattttgtaatattctttgtcctaaatactctctgaaattttccgcgaattttcggagctcaatagctaattttaaagtcacaaagttcatatcatcaattaaaataaaaagaaaagtaataaaaattccccctctttgtttttgggccgccccggcccaatccccctcctccgccccttggcccgctcgccctccctcctttcccccttccttctcgtgggccggcccagctcggccccccctctccccctaagtctgcataaccccttcctggcctcctctctccttccctcaccgacaggtggacccgaggccccacctgtcagctcctcccccttcctccagccactccgccggcaaccgccatggcaacccgggtcgccccacgtcgccgctaaaactgccgcctcctgcctcccgcgcgcacatccgaccgtgcggacgtggtcgccgcccactcctccaccctctcccccatttttccccaaattttcgctccgattcgagctccacctcgcccacatcgccggcacccattcctccatcagatccgcccctcccggcctcgatctcgagctcctcaagttacatcagttccaatgcagagtcggtcaggttagttttcagaaatcaactatgcaactcgacaccgaagtcaggccagaagcaggccattcaagccagcagttagaactgatgggaaagttagtcaagagtcaatatgttcatgagctaagtgagagtctcttttatgtggactttcctatcctcagctaagggttaagttccaagtcttgctagaatgaaagtgcatcgtcattgctctattttgattgatcgatgaagttttcagttttcaaagccagggctctttgtaaatcggaaaagtgttggttacatttcaaagacaacagttcaattgatcccagtcaggcgaaagtaagactactctctgtaaggggggtaggtctcagagatgagtgttggctcacctcgtcgtcgtttcatttggaggttcaactcagtgcagccatttgggtaatatttgaagaagccaattatagggcgtcaacagaattacaccggtctcaggttatctgattggattccagggtaaacccgtgaggccaagtcaactgttcagcttaggcaagcagtgccaagaacagttgcagttcagccgaaagaccaatcaagcagcctcttaggatacctgtggttcccgtcagaagtaggttaaaataaagtcagaatctgtcattcatgcaagtccacatacaaggtttcatgaaagctttgcaagtttctagtatgcttggtgagctcacaggttactaagggagacaatgctagtggttcagtccaaagaaaagaaattctatgagcactagcaattttggtcaaggtcagactaatcggagtcggtctattcagtgtatgggaagcaacagaacagcaagcttatgcaggtttggttcatcgagcaatcagtcagttgaatcagaaagaggcagcatgtgtcagcagatcagtcagacagcccgccagcaccagctttctttctagccatcccaaaatcttgggacgagattcctgtaaggggggtagatttgtaacgcccccgattttctagaaattaaataaaagttaaagcaatttaatcaagtgaaattatgggggaaattaaaattttcccttaaaaatcattggccgagaatattttgtaatattctttgtgccctaaatactctctgaaatttcccgcgaattttcgaagctcaatagttaattttaaagtcacaaagttcatatcatcaattaaaataaaaataaaagcaataaaaattccccctctttgtttttgaaccgccttggcccaatccccttcctcctccctttggtccgctcgccttccctcatttcccccttctttctcgtgggccggccaagctcggccccccgtttccccataagtctgaataacccattcccggctcttttttcttcctcacgacaggggactgagtatacgttgcataaagcatatagntcaagcccc

SEQ ID NO: 6494 - DNA, 8202 bp, Oryza sativa
  unsure (1)..(8202): unsure at all n locations
cctctccaccggcaaactggcatgaaaaaccggggcgcccccacgtcacgcttaaaactgcccacatcctgcgtcccgggagcacgtccgaccgtgcggatgtggttcccgcccactcgtccatcatctcccccatttttccccaaatttttgtgccaattagagctccacctagcccacgtcgccggcacccattcgtccttcaaatccgcccctcccgtcctcgatctcgagctccccgcgctataaaaatgatcctcgagtcctcctctcccatttcctcatttttcccgagctccctgcgctctctcccgctctcctcacacgagcccaagcgctgccgctcgccggcgaccctccagtcggccgctgccgccgctgccgccgtccccgtgccgcgccgtttgcgccgccggcctcgccgagcgttgtcacaccccgtccatcgctcatcttccccaatccactaccgaaagaccacatccaccccgcacccatttcccccactctccccatgaaaatcggcgccagttaacccctccaccgcaagcccgaggagcgccgtcaccatctcgcctctctccggtgccgtgccgcttggtgagcatcccctccccatcctctctttcgccgcctctcatgccgtcgccgctcgtcgctggcgtcgtcgccggtggtctgggcttggcggtcgctgccgcctgtgtgcattcctgcctggccgtgccactcggccgtccgagcggtctcggccgatccgggccattgggtgcgcggccgagtggccggtcgccaccgtggactcggtccacggtgggccggtaccccttgtgtcgctgacgtatggggcccgccccttcgtggacgcggtccgcgcctcaccccttgctgacgacagcagtccccttttcctttgtaaaaataaataataattgcacaataaattgtatttagttctagaaattcatttaaatggctcaaaacttctaaaattcatatctaattcattcgaactccgaattgggccattcaacttgcaaaattcatctaaaattgagatctacatgtttgtttactttttatgtactgtttccttggtttttattagagtttttcctcgttttgcgtgctagcgtgtagaatccgtcgtttcggaagtccacggtcgcgaggaaaagagttcggaagattgttttgaagaagcaaggcaagtcacacattccccttgagcatgttgatcccaatttataaatgtttgaccatttgcaaataaacatacatgtcttgctaattacatgggatccgggtattacctatctgcttgcttgtgccatgtttacttgatatctgtcctttgtcaaccctgggtaataaatcgactagctcatgttacttatgtgacctagctagaattatatgcttagccatgcttaattaccactagctcagttgatgggataattacagtattagacctttttagtatcagaatgagctgcgtgctcgagacatctagccatgcttcatggtcgtaattatccaactaaaatgcgactgaatggtgggctgtgggtgcatggttttgctagtcgcacccatggcaattaaggaccggttcgcggtatgccctagaagaacttatcgtacttaccacaagccagcatgggcaatggttggacttatcgtacttatcacaaggaagcctaaaccatagagaggtacaacatgtctcaaacaagagtaatacacatgaaaatacacaagatagcacaagtgatcatacaatgggagacatgatagcacaactaggcaaataaggagataagcatcacaatcacaaagataaagagagtgagaggagacaaatgatttgttttccgaagttcggattctccaccgagaatcctacgtctccgttgaggagctccaaagagccgggtcttgattaaccccttgcctcaccaagaaaaggcctaggaagaggtctccggtcttcaagccaacacccctaggtacttctctttggtttcaagtgaccactaagatccccaacttgaacaccaaaagaacaccacaagtgaggcttgctctaccaagatgacatcctaaacctcacctcggattccactcaccgagttttccgtttccttttggaggtggaataacgccctcacaaatttgcccgggtcaattcacaaccttgttggaaactcgcgggcgacacctaaccatctaggaggtcaccctccaagagtaacaagcttcaaataatagcccaacgagataccccaagtgctcaagtcatcctagcgttcaaaaccttctccaatcctcaccaccaccctcaaaatcactctctcactcaagaagtacacaagatttgggtggaggaagcaaaatcacattgggagaggctagaacaagctagggaacacaagaactaaagtggaatggccaaagggtgacctggggacgagatccatatatataacggctaggtgacgtcatctagccgttactcacaagtttgaactggaaacctgccaggaggttccgggtaaaagtgccaggaacatccgggcagcacttatgaaatttttcaacctcacctcggtgccaggaagttccggacagaacctccgggtgggactctctgtcccgagtagagccattttcaaaaacagctcctaaaaatatttcaacacttggacaccactaagagcacttgtgttatctcagaaccacacttggaacccctcttaatagtacggtttttcctaaactcaaagcgaaaaagtaaactagtctaactcggctccaagtcttcttgccgctttgttttggggggtctccaagcatcctagcccactcctaagcaacctgggactaatacaccactaagaatgttatcttcttgcttcaccttgagggttgtcaacgtcaacgccatttcactattgggactattctcacctacacttaagcatattagtcccaaatcaattatacctttgccttgatcaatgcccactttggattttgacttgatgttcatcgaagaaccacatcctcttgatcctcggcattccatcttgcggtctaattgatacggattactcatagcttcaaatggcctcgcacagtccatcatgaccatcatgacaaagccttcactcgtccttcaccaccggattcggtgaatcggtgccaagcctcttgcttgcccttcaccccacgcatggtccattgtagccgagccttgcttgcccttcaccgttttgccataaatagccacttcatactccgcatcatcaatgtcttcacttattcctcattaaggtataatgtccatcttctagccgagcctttctttttcttcaccggtttgccatagatagccatttcataccccgcatcatcaatgtcttcacttgctcctcatcaaggtataatgtccatcttctaacttcaatcttttaacttgatggcggaacttaacctaatctcaccaactcatggaaatagttagttccaacaatgggttgtcattaatcaccaaaacaatcaccgcactcttaggatcatagatattccaatctccccttacaaggcaattctagtacatagatcttttaatctcccccttttcggtgattgatgacaacactatcacaaaataggaatttaaagagaatactctagtatatgttaccattagcatgaaacatatactagagggttggtttcatcaacatatgaaacgagtatacactttcccctttatatctctctctttatacttctccccctttggcatcaaacaccaaaagattgaatgtttgggtgggagcataaagaaaaagaaatcatcaagtatataagaactacacaagtcctatacacttgaaggaaaaatggtttaacatacctttggttttccaaagaggctacaacaagatgaaactctatcaaaagcgttagtttcaatatagcaaagtacaaatagcctcgaggtacacacgtatacaagaaaaacatgtgcaccaacaccgaataaagcaattgaactcatcgaaattccaatagaaagagttggagtccaaagaaacaccaatccaaagcaagcacttttttgttttgtgcttatgaaccacaccaattaatagaagaataccaatcaaaagagataggccttgattatagtcacaattggtaagaacccatatgcacatatagcaaatacattgattagttaaactcgcttaatttggagaaaggcacaaaagcataattccaaaaaaaatattttctctttaatgcatctcccaaaactcacttaaaggagggcaaaaagtatgtcgggcatataatgctatagacaagtcatgtatgcccgaatgaaatgtctcataagccaaaacccaataagtagtgatgatgaagagacatatcaagacttatgaaacatcacaacataggatgaactccttctaaatacgtgcatagcaaagagtgaaaagaaatctttatgcactttcacaaaagaaatgaaggaacaaaagaatccatcctatattatgaaatcaaggttgcaaagaaaatccatagaagcaataatgaagtctaccttgggagtcatccacttccaacatgagaccaaagaataaactcaatttaaaccattagtcttccaaggtatagaataaacttcccctcaaggtgtgcatataaggataaatttaatgcatacatatgcactttactaaaatgagaatcggggaggagtttacactatattttgggtcaaggaggcaaatatcaccaaaagaaataaattgaaggactagaattgtaaagcacactttcataaacctcacatctcaagatgatggtgcttaaccaatctcatccttcttcacccattccttcggttgtcataaatcaatctccccttgatccatcattatctcttttctctatttgaatcaatagaaaagagaaagcatcaaaagcacacgagtttcacaaataatgatccttttgatgtggaggaaaattggatcacttatttgtgaaacctcataatatagactaaattctcccaaaagtaatgcacacatatggtggaaggcaaatttatgtgcattatttgacatttaaatcaagcaagggaatttaatccatattatgaaaggtagctagataaaatataagatgaaaagttaattgaattaccacttgtgaatagcatacctttgagaatgtttcacttctcatgagactaaacataaaatacacttaacaagaagttagtctaaaaaaatacaaaacataggacatgctccccctaaatatgtgcatgcaagcatttgaattacttgatagaagcatgcacttgtctaatgaaaagaaatgaggagtacaccctataatttcaacaatttgcacataaatgatttgcaagaatatacatgtgccaaacattgggtagtaataatgcatgtaaattgccacaagataatagatggcaatcaaccataagaaagaatattcatgacacttgaagcttgtatatgtagagatgatgtaaaagatttaccattggagcatacaagtccttagtagaccgaaactttcggttcatacatgaaggtaatccaatccatgggctgaaaaatctacaacaaaccttggagatagattacacgataatgcacaattttcattgcgggagcattgcccatgtctcaaccaacatgcatgtacaaggatcaaaagaattaagaaagctgaaaatttgaagatgttcaaatttcggaaactcaaaaaataacttagaaagagcattgaaatgacattcaaatgacctttgataatttagacaaaatttggcagtgaagtccaactatagagaatcgaaagtcacaatgtaagctctttccaaatcacaacaacacaacccattttgagatataaagatcacaaattagctcaaagtcaagttttactgaaaatttctacaagttgagaaaagagagaaaaagtctgaaataattcaagcttgcaaaaaagatctttgaacttgagagaaacttctccaaaattaatttcactaaatgagttttcgataaagagaatgacttttaaaacaatgaatttcaaccaaaagattttttatgaagtttgacatttggaaagacttaagatgggttagaaataccaaattgagccaatgttcacaaagaacattaatcaaattgcttaaacccaccatatgcaaatatagaccaaatatgatcaaaacaacatgttggataaatgacattttgttccaaaaacaaaaatttcactccaaaagctttttagaacatttgaaataaaagatgaagccctttgaaacatttttcacaaattttggaccgtcaaataagaattttgaatttttaccaaaagagacccttttagaaaacatgtcatctaaacttttgaacttttaaattttggaagcttgagctaaacgtttttgggccaaaacaaactttaaggttaaaccaatattttaaaacaatgttttgaggcaagttggaccggaacttcctaccaatttgtccggaagttcctatcggccctctttgtctccacagagagtcctgaccggaagttccttgtactttgtctggaacttcctagcagacaaaatcagcacgcgagaactttcaagattttgctcaaaatcacccaaacaaactcggaatttcacgaaatttgaaccacgagctcacaacaacatgggaaatcagatgaaacaagaaataaccaaaatatttaatatttcatcaccaaatttaaagaacttggaaaaccaaaggtaaaaaccgagtttttggaaaaccatcaaaatccatggtgctcgtgtgagggatttgtttgaggatcaccatatgttcgttcacaattgacctagcatcaataaaatcacttttaaaggattcatgtttaattccttgctcgaagaaagataaaaagttgaagttccaacaaaatgacccaaatgcaattttgagcaaaatgagatgttttggagacaatttgatttttatgagtttgaaatacgtccatgaaccaatataaatcacaatatatggttctagtggctaaactcactcgatgctataataggaccaaatatggtcaatataaattttcatgtgaattttgagatcaaataatttcaaatcatttatcatataaaatagatataaataccaaaaagatttgaaatgaccaactctagtggcttgtcaaaaggattatttgcaaaaaccttttcagatacattttgacataaacacactttaaaagcaaaaacaagatcttagcatctagatttagaggctaaaatcatttttgtcgcgtcccaaaacgactctaaaatacatccttgaaattatgcctagaataattaaaatccttgtgaaagcctccaacaattaaaatgtgcaaagttaaaagtcaaataaggcttggaggattttttttatatttcctaaaagcctaaaatgcgtaaataaattttagtggaattttcagagcacaaataatatttaagaagaaataaacaaagttaaaatggttttataaaaagaaaaaccctaaaaagatccctttcccttcccctctccctcttgggccggctcggcccatccctttccctctctcccctcttccccgcggcccattcggcctacttcccgcgcgcgcgccgctgacgggcgggcctgcccgccaccctcgctgacgggtggggcccacccgtcatcccctttctcccgccggtcccgccgcctcgcccgtgccctagcgccgccgccggcgagaatcccgccgatcccgtacgtcccgcgtgcaatcaagaggggggaaatattccccgtgattacctccctctttccccccatttttccctccctctctccctcggattcgttcggaaactttccccctaacctcgccgacgcatcaatggcggccggatctttcgcgcccgttttcccctcattcggacggtctctccccttccaaccctatataaacactccccgtgccttacttcggcgtttacgcactcgccgctcttctattcagcgaataaactcgcgccgtcgcttttctcttcgncgtcaccggcgagctccggccgcn

SEQ ID NO: 6495 - DNA, 4697 bp, Oryza sativa
  unsure (1)..(4697): unsure at all n locations
aggccggcaacagannnattttctcccccttcccaacattatataaacactccccgtgcctccctccaccgtttccgccactgaccgctctctctttcggcgggaatcaagctggcgcagtcgctctctctctcagcggtcacagccgagctccggtccgccgccgtcgtcgccccggaccttctcccgcttcggcgtcgccttcttcgggttcgccgcaacctcgccgacctcgtccacctctccgtttcggtcgccgactgccggaacgccgccgtgcccgtcgacccgagccgcgccgccgcctctctccgctccggtcgtcgtacccgtcgtcgccgtcgacccggggtgagccgtggaccgccgattcgtttcccccttccctcccctctctcgggcgccgctccgccgcgccggtggtcgccggcggcgaccatcggggcacgagtgcgccacctcccgtcggctgtgccggcgtggccgccttcgggcgcgtcccgcggctgccatgtggggcccggccgttagccgcccgcgccctcggatgcggctgacgcatgggacccacggcgccggccggtgtgagccgggtgcacccggtccaccgtggaccgtgaggctgccgcgtgggccccactcctgtggacccggtccgcgcgcccctcccctcggctgacgcaataaatccaattttaaattaaaatttaaatgaagaaattcacaaatattcatttaaagagcatataaccttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgctttaaattattgcattatcgctttatttaaattcccgcgttatcactgttttatctagccatgcctatttacctttgttatgaccttattattattgttattgttattattaccttgttcaccctagattaaacaaaaccccaactagtggacactcttctcatggtaccactagtatgattttaggtagatgcttcgctatttaattaggtaacattaggtggtttttcaactctagactttgggaatattcatatcacctggacactatggaatggtttggttattgtggaattggcttcacaccgctccttctattcaaaatccccaaaatagttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgagggttccagccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgagcaactaaatatctttaaatgctgtttactgcaaccctaaccctttatagtataactcctttgtactcccttgcatttattctgtacttgtgggtgtgtcttgttgagtacggtggttgtactcagtcttgctcaatttttcccaaacccagaagaggagcccctagaagatgaaggctttggtgtctagctcgtgccagccgtcaagcgcatgtggtcgtcgccctagtcttccgctgcttctcgtttgtctttgtgtgtgctgggccttcgctgcccatgtaataatttaactatttacgcttccgcttgataaactctgaaatgtatcaacttttggtgtaccttgcctcctgggacaaggaataatacacgcacgtaaggaacgcccattgggttaattccggtcgtgacaattttcttgccaaaactcatttttgtttgaatcaacttttaaaatacctctcaattaggtgaaggaacccttttgaacaaacaaaaccaagttttcacaactaactttatagatttttactttttaaccaaaatagaattttgaagactattatagcatcaatttaatcaaaacacatttaagggatgcaaatgatatgagaagttataacactccccctaaatgagataaccaaaacattactcaagatcaaatttgccaatcaattaagcaccattaaaggatagacattatacacaagtaataacctacacaaggttaggatatagaaatttcaatgtaaatacttgttaccgagatgacattggttcttaatgtagaacaattattcacatccttgattccattttttgctcattgcacaaagttagttcttcaaggatgagttgagcctccaatgcacctccaagtacctaattgacaatctaagcatattttggtacccaaatcacgttgggtccatggatgttagtcacaagagatttagggacccaaatggcctttgtgctagcatgtagcgaactaatcaccctagtagcacaagtgccatttttggccttcctaagcaaattgtgatgaaatgagaggtttggcttaggaattttaccaatgggacaatttttaccaatatgtccctttgcccggcaattgtagcaaagttgagttttgcttttatcttgcttcttgacttgcttgttgccggtttgcctcttgcttgatcgattgctatgatcatccttcttgtgcggacaaaatccaatttcatgccccttctcaatgcaaccgtagcacttccttctgttgattcttgatgtctttcttggaagtgtggcttcatcatcaatcttgcaaggacaacttgaggcaaagtgtccctctttggtggatttgaagaacttgtgagcaagatcctcattcttgctcaacttcttctgtttcttccaagggcaatctctcacatgatgtcccattttcttgcacttgaagcaagtaatggaagctttgttcttgctttgatcttgccccttgctcttgttgttggacttgttatcttcttgatagaacttggtgcaagctacggttgatcccttctcaagcttcttcagcatgctttcacggttatcttgagaaggttgagcattgcaaacaaatccatgatcgatgtatttatcctttttccctacataatccaagtcacatgtagtgcgcagaaaaatatttgcttgagagcaacaagagttagcacatgtaaagtcaacttgaacatgaggcacataggattttaccgttattatgatcacctcatgagttacttctagcatggcatgtgaatccacaagatttccatgagagcacaaaagctcatcatatttttcttgtaggtccacatgcttgctagtgagctccacaagttgagctttaagctctagattttctttctccaaatatgatttctccatgatgcaagaatattcatccaagtgtgaagatgagcatcttggagatgtaaattcttcacttggccattttttcccacatacttctaccttcaaaagattagttcgacaagcactataggaagtagaagtatccacattgacgctactcaccatttcattacctttaatggagacatgtgttggtgaggaggtgaatgtggcaagactatcttgctcattggatagaatcacttgaggctctttacaaattgtcgatgaatttgagcactccacaagtggttcttctatagcgagctttgcctcatcacactcggacttgtcatatctctcctcgagtgtgttccaaatgagatgagcatcctcaagtggcatgatggattagaacacatcttcactcaaagcactaaacaaaatattagtagcttgagcattgagatgtatgcatttctattatgcttcaaatgatatcatttgatcactaggaggagaaatgctcacatctacaactcgctatatttgaggtcccatgaccctaaacacataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6496 - DNA, 706 bp, Oryza sativa
  unsure (1)..(706): unsure at all n locations
gtggntttgtttccagttattgcaagtgctcatcatgcttaacccaaggcctacgatgattcagaccgaactggcaacccgaccctgggtcccagctcgttccaagccaacccaggccaaccattccacattttagttggtaagcaggttttaagaattaaaacactaacttgggtacattgctcggattgcccataaccgagggcgcgggtattcgaatagattatactctgatcagaggtgtacatctttacccacaagacacatgttgctcacgtgtgaccacgtgccacataccaccacggtttacggacggtagacgtgacatattttccaacccatactagccatagacaagagtaccgacccaatcccacctaccgctggaaccctcgggacaggcaggcaggactgaacccctagcagcaggacaccggacctgtgccatgacatctggactaccgggccggagctcgtgttgccttcatttgtcctagagatgtccatcgacccccgacttcttgcatgtgcatgcgtgtacttttggttataaccagactgatccacaaactaagccttacccactagacatgtggaaggtcggcagtgctttgcaacaggagaccgaagaccggtacttatatggcacgagggctgctatcaaaaccatgcaccccgagccagtctaaaactatttttgggattt

SEQ ID NO: 6497 - DNA, 775 bp, Oryza sativa
cgtgtgaaaatttgacagttggttatcatcttctgattttaaaagaaattaaaatattttgagggcccctaaaagtattgtgggcactgtgctactgtccttaatggagaagtgggccctggttggatccttctcataatttaggcctcagtttaaatgtcacctactccagggttccctaacccccaggccacagaccggtaccacctgaactctgcctcctatcagagaatgctttagattctcataggagcgtgaaccctattgtgaactgcgcatgcaaggggtctaggttgcgtactccttatgataatctaatgcctaatgatctgaggtggaacagtttcatcctgaaaccatcaccaccactgcgacccccacccggggtccatggaaaaattgccttccatgaaactggtccctggtgccaaaaaggttggagaccactgacctactccaaaaggccttccttgaagcctgcatttaaaatatcttctggccgagcatcgtggctcgtgcctataatcccagcactttggaggccaaggcaggaagatcacttgagcccaggagctcgagatcagcctaggcaacatagtgagaccccatccctacaaaatattctttaaaaaatagctggacatggtggcttgctcctgtagtcccagctacagactgaggtgggaggatcacttgagcccatgagtttgaggctgtagtgagctacgattcccaactttgcacttcagccctagtctgggcaacagagtgagat

SEQ ID NO: 6498 - DNA, 72687 bp, Oryza sativa
  unsure (1)..(72687): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggagcgcgtgcgcgtgcgtgcaggtgctcccctaggcccaccacatgtccacacacacaactccattgcaaaaaatcacccacatattttagaaaacctttattaagagaattcgtttcattttttgttccacctagtgtactcacaatatttcactatgtataaatataatgttgtagtgaactgaaacattcttttgcaacaaatcacccacatattttggaaactctctgttaagggaattcatttcattttttattctatcaaaaatagttcatctagtgtactcacaatgtttcactatgtattagatataatgttgcagtgagctaaaacattctttcgcaatttacaaaaatattgtttttttataaggtgaaacaacgtccaatttaaacgattgaaacattttcgatcacttagtgaaacaattccgatatatttggtggaacatcgtgtaacatttaataataattcaatgataagccaaaaaattttttgtcggaatatatccatgtgtggtcttgttttaaagatttaattgcaatgaatttaatgggtcaatcggattatgatttggatagataatttaagagaaaaattagtttaaagtggttttgcacgtatgcgtagcacccgatttttacacgtatgcatcagaggcctaggcctgatcagtagccccctccgataaaagacgttatcaataggtgttagtttgccgttgcaggtgataaatctttcgtacatcacgtgtgccgtattactgctgaaatatacagagccaatatacggcaggcgtgctggcacaccctggcaggcacgatcccaggccgtccggctcatatgcatggctgtatgcggcctacacgtagatacgtgcaatcgggcataatggattatggacgttactagacaggtagtggtagctggtttgtctaaactagctaccactctatctatgagagatcctatccacctatattttaaataaaattttctcttaaactactcatccgatctacgatccgattacaccgttgtgttcgtaacaattaaatctttctaacaagatctcacataattatattttgatgaaaaattataaattgcttttataatatatctaaatcacttttagctttcactaagttacttcttagacatataaaagtaaatttaataaagcctaaaagtaattacatatattatattatagaagtaacttttataatatatatgtaaattacttttaaagttactaaatttacttttatatgtctaagaagtaacttagtgaaatctaaaagtaatttagatatattataaaagtaatttatattttttcatcaaaatataatcatgtgagatcttgttataaagatttaattgttatgaacacaacggtgtaatcggatcgtagatcggatgagtagtttaagagaaaattttatttgaaacctccaccacatcttaggaaacctgccacgtctgtctctctcattctctctttgtctctctttttcttgcacgctaatggatgaggaggatgacttgtggtgggatggctaggacggttttcctggcgtcgagcgatagcgccagatcgagaggcctcttgaaatagtttttgcgatggattatccgttgatctcttcttggtttagcaccggtctgcttctgctgggcttgctagctactatctccgttttaggttataataacgttttgactttggttaaaatcaaactatttaagtttaactaattttatagaaaaatatagtaatatttttaacccaagataaatatattatataaaatttagttatgaaactatgctggtgtagtaaatattattactcttttctaccaaattagtcgaaccgaaatccacaatagttccggttccactaaaaaccagcactaaaaaggatctttagtcccggttggtggctacaacgggcatatgtaatctttagtcccggttgttaacaccaacgagtactaaagatcatctttagtcccggttctaagcctgtcaggcctatcaggccccccgggatctttagtctcggttggtgcccagcgatcttcttcctcctccagcccgagcaagcttcaaaatttctccaaaaaagaggggaggtcataccaaaatttcttgtgaaatttttgtggtgattatatataaatcggaggtgtctagaaggatagtaacttcatcctccaattgtttttttttgttatattacttttggagcaatgtttcacacatttttttggtctccaaaactttgttgtaagttgatgagagagaaaatttgtgtggggaagaagaatatatagaaattttgtttgtttacttaaaaaagttttattctctagcttaaaatataatgaaaattaatcttaaaaaaagaaaacaaactaaattgaaaattaaaagaagtacaacattaatattagtttataacttcaaaaataataaataagaattgtttgttggattattttataattattgtatgaattatgatatgtcattattgtatgactgttgaaagagtttttaattattttatcattattgtgtcattattgtacggaaatttatttatgtatgatttttttcatttcatgtagatggatcggcaatggatgtatgttgaccggcggtccaaagagtttatcgatggcgtgcattattttttgagagtggtcgaagctaacaagcataaggattttatttgttgtccatgcaataagtgtaagaaccagaaggagtattctgcatccaggactattcatttccacttgtttgagtcgggagtcatgccaagctataattgttggaaattccactgttgacggtcgttatcgatcagttttgaccgtcaatattactaaaataaaggagaactagtaatgcttgcaatgcatatatctgttagaataataaacttccactagtattaggtatactaacctcttgcagggaatgacactaaagtggaggagaatcgacatcaacatagacgataaatcaatcggacgatgtcgagaaccagacttgtgtatgaatgggccaaaaacgcagacttgacacgatgaatcaggccaaaattcacaagtctacgaagtgaagcaatagaggaggtagccagccgaagatgggctggtttgggccagcccatggttcggccgaacccccatctccaccgttgaggccagggtttggcatggacgtccaagattgcaccccaatgacggttagagggtacttcggacaattccccttccacaaccgtcataaccacctctatataaaggcttcactctcttcatttcaacacacacctcaagcaatagctctctcatttctctcaagtttagtttagtagtatctagctggtggaatagaaatagaataggagtcaggagtccggaaaccttcggaagagttcgggtatggctttagcagctttcctcttctcttttgtaagctttgtacttttattagaatactcttctatatacatttatggtattgaaatacttttcgagtatatgagtacctactttacattatgttcatgttatactgaatatacggctagcttatctgggagatgctttagtgcgggtataatgtttgcttatgcaattactctatgtcatgacgatgatattagagtagtatctggtagattaggcgtggtgtctagattacgggatatcattatttggggttatatattgcggatgagaggtgggccgctgatggtgacagctcagtacgggtattcctccgcgccagtatataatcctaagttaattttctggggagggtattcctctgtatttagccccggttgtatggtcatgacaggctgtcgtaaggaactcggcagtcaggggtggcttctcgaagtatcaggagggcatcggatagagggtattagctagtatatcagttaactagaatgtatgtatactatgtatattagaagtataggaatatattttctttctcttttctttccacctagcttagataatttattatgagaatgagttgttaatgcttgtgtctcactctacccttagattatgttaacccctgcttagaatatgattatcacaagtaatatataaattattagttgagttctctctacatgatcttcccacgggataaaataaatacgatactgacggagctcgtggctcctcaccgggagaccgcgcaggcccccctttgccggttcggccgggggcttagggtgagatctcaagctctctctgtatgtggaaagatcgcgtgccaggaagaaacgcgagacacggacgatgtatacaggttcaggccgctgggaagcgtaataccctactcctgtgtttttttggtggatctgtgtaagagcaagttacaaaatatcaaccagccctctcctctcccgggaaaatccaaaaatcccccccttctctttgtgggcatggtcctccttttatctcttaaggggataccacatgtacccttccctttttaaactggacttttcttctttacataaatggacggagatttgcacggttgccctccgaacgtccttctgatgggacggcacatacctacctccacttctgccgggggcaggcgcgtcgtgggaacgtggctgtgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtaacacgccagctccagctggggacgagtgcctagaggctctcatcttgacgggacggggcgaggcgtgagtcagaccgccagtcgccacctaaccgttgatctgaccggtctgtgactggtcacagaccggataaaagagcgcgctgcattgcgctgcatgcagcgtgacacgcttaaccagaccgcaataaatgcggttaggtgagccctaccatgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgattatccttctcaagggaagcggtcgggcatgacgccactcataaagcctggtgacaggtgggaccggtctccgtgattgggcagaaacccaacggtctcaaaccacgcatatcggtaacggtgtctgggccgtcagtcatgggcggtctcttcaagactgccacatcacttgagcagcgctcgaatctgggcgtgcagattcgtttcgtctggagatatggtaacgtcgcttcggtcggcgatcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggggcgagatagtgggcacgagaaacgaggagccgggctcagcgatgggaagggtataaagccatcgaggaaaagacttgctcccttcctttcgccactattcccctttccttcgccgtttgcgccctaaactctctctttgctgcgcctcaccttcgccacacacgctcgttctcaaccctctctttctccgacgacatggcacggggctccgctctgctcgacggtagcgtactaccgccttcccgcattgtgggcgagaggcaggctgggctgccgcgccgcttcatgccggaatccgccaccggccgggagatagtgatgctgggcgaggcgcgcccagcaccagattacccggggcggtccatcttcttcctccccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggtggttgctacttccagccgcgggggccagtgttgaatcgctacatcccctgcgccctccgcaagaagtgggacgattggaagagcgactggttctacaccccccttgccaacgaagcgcgcctccgactcccaagccagcccccggcgccggtctccagctggcgggcgccagtagatctgggggatgactatgacgccgtccttgaccgcctggcgggcctgcgatctcaggggctcacaggggccatggtgtacggcgactacctccgtcgccggattgcgccgcttcagcggcgcgcccggagcgcatgggagtacaccgggtccgaggactacatgaggacccaccggggagtcagatgggattgggctcccgatgacttcaagatcgtggtccaaagggtgctgaatctcagctccatggaggcgtctcttattcctcaaggactcctccccctctgctgcgatccagaccgcgcctccattctgaccatcatgatgggggtcggggcctcagaggaggtggctcctaagggccacgacggcgccggcgggagccgccaggaagaatcaaccccaggagggggccgtgcttctgggccccgcgacgggggctcggggagcaaccgccctgccgacgcccgggggaagaggaaacagggaggaacacctcccccatctcctccccgaggggacggggcggtgcgtgccagccgcaggcgcccggagggggccgcgccgacatcacagcccgagacggagcgcaagaagaagcggctccgcaagacgggggagacggaaccatcccggggaaacctgatttcccctccaaggtggtcgttcaaccgaccccctcgcaggttcgtttcacgcctttcacaaccatcttccctttatcccaatcagcaagttttctcttatccaccttgtttgtcttccggttttttcttctgcttcagcgatgtcccgtcgcgttcctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgggctcgccaagccgaagaagctgctcgggaggaggccgcccgggctcgtcaggctgaagaagccactcgggaggaaaccgcccgggctcgccaggctgaggcgatggcgtcttccgaggcggttcacgacaagaccgccggcgcgtcgctcgggcccactccttcgggtgacgctcaggcgacaacctccggggcggctcgcgacaaggccgtgggcgcatcgcctgggcccgctccctcgggcgacgcccaggaccaaacgggtccgggggacatccccgagctcagtgcgtcttctggcgggccgagccgcgtcgcattttctccaaggcggctcttctcctcgtcttctgccgccccgctgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatggtggaggtgggccgtaaggctcaccgccgccacatcttggagcttgaagcccgcaaggcggcgctggcggagatcgcccgagaggtggaggaggagcgagaggccgccctcatcgccaccaccgcgatgattgaggcgtaggactccctccaccttcaacacgggagctgggaggcggagctaaagaaaaagctcgacgccgcccagggggtccttgacgccgccgctgcccgagagcagcgagcaacggaggctgaagcggcatcccgacggcgcgaagaggcccttgaagcccgtgccatggcgctggaagatcatgccggcgtcgtggagatcagcttggcggaccgcgaggccgccgccgctatccgggaggcgacgctggcggcacacgaggccgcctgcgccgaagaggagtccgcgctccggcttcgcgaggacgcgcttgctgagcgggagcgagctcttgaggagtccgaggccgcgacacaacggctggcggacagcctgtccctccgcaagacagcgcaggaggagcaggcgcgccgcaatctggaatgcatccgcgccgagagagccgcgctggagcagcgggctgctaacctcgaggcgcgagaaaaggagctggacgcgagggagcgcagcggcggggcggctacgggcgaaagcgacttagtcgcccgcctcgcagctgccgaacacaccgtcgcggacatgcagcgcgccctggactcatccaccggggaagccgaggccctccgcttgtcgggtgagatagggcccggcatgctttgggatgcagtctcccggctggatcgcgccggtcgggaagcgggcctctggaaaggccagacaatttcgcgttctaccaatctggaaggcctcgccccgcaccttaggaggatggcctgggctgtccaacaactccccgaggagctcgagaagaccatcaagtcatcctcaagggacctcgcccaaggagcggtggaactcgtgttagcgagttaccaggccagggaccccggcttctccccatggatggcgctggaggagttccctcccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcgcattggaatgagcccccaggcccccgccaatcttcaattttttcattttctttcttctttttgtatagatcaacttaatctgcaatcaaaaatgatgaaaaatctctatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaactgcttttattgaaatgctgaaataagaaaagtaaggctgtgcatgtgtggtagcccccggctaaccctgcacacccgaggggggtgcggggttagcccgagcccgaaacctgacacccgacccccccctcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgaggtcgtcgacgcagagtgatcgggccaggacgtggcgctgatggtagcgccgcaggctctgctggtagcgcgcggctcggagggccgcgcgccgccttcgctcttccaagcagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttagcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgcttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaatcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcgtactctgccatattattggtcgctcgaaagtcgaggcggaccagatatctaaggacgtctccggtcggggaggtcaaagtgacccccgcaccggcaccctggagggacagagaaccatcgaactgcatcacccagtgggtggtgtgaggcagctgcgcggagttcgtgctggcctcggggattgagacggtctctggagccggggtccactctgccacaaaatcggcgagggtctggctcttgatagcgtggcgtggttcaaagtgcagatcgaactcagaaagctcgattgcccattttaccacccgtcctgtaccctctcgattatgcaagatttgaccgaggggataagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggccgatcctctttgctaggggccgtatccccggggcgttcttcattcaagtggcctttcggggcgcacttgtcttctgtgccgatgacctcggggtcggaggatgaaaggggcgaccttccctcagtggcctcggggccgtcctgggggttgggggctcctggcatcgtcggacaagcaggcaaagggccaactccggtcgtcaggggcctctggcctccgttcggctcgggggcctcttctccctgctctttcccgggtcgagtcagcacagggttagcctcggggtcaaagggcgttaagtgcggccttcccgcagtggccttggggccctcctgagggtcgggggcacctagcaccgtctgacaagcgggcagagggccgactccggtcgtcagggcccgtaggccaccgtccgactcgggggcctctcctccccgctcgctcccgggccaagttagcacagaatgggggtgcacgaaatgaggattgttttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcacttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgtgtcgcctcatgagtaggggccgcggcgagaagctctcgcctcatggccttgaaactccggcgagaaacgtgagcacacgctcccccgtcgacagtggcaatggtggccccaggttcttggaaacctaggtcatcatcaccgtcatcgatgtcaacggcgggggccttctgtttggcctcacttcgccgtttaccggagggaactgccgcggacttgccctcacggcgttcctgcctcctgtcctcctcacacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcagacttggcagaaacgctgaatgtacgagcgaagggattcatcatcccctcgctgtactgcgtgcaagtccgcttcttcacctgggcgtggataagtgccttgaaagttcatggtgaactgctggcacaaatcctcccaggagtggaccgacgcgggtggcaggttcattagccaaccccgcgcctgtcccttcagggccatgggaaagaaattcgccatgactctgtcgtcacccccagcggcctcaatcccggtcgtatagacctggagaaactcggtggggttgacactcccgtcatacttctcggtgatggtgggccggaaccttgggggccaacggacattccgaagactcgccacaaaggctctacagccgacaccaccagccgggggcatggagggctggtcctcacgtccctgtcgaggtgacactctggacgaagaggcgccctccgttgcgcggggagtacgccggctattacgccgacgctcgatgtcgaggcgggcattcggctctccatgccgatcctcccgagtcggaggtgccgacgagggagtggcagccgaatggcgtgcaacagccgccgctcgccgcgccctccgtcttgacgacgcggaaccggtagtggcggcgccggaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctgaagcgcgccctgaggcgtgctgccgtcaccgtagacgaggaggcgacgctccccatctcgccgttctcctgcaccacccgcgactggcgatgctgcggatttttcgactctctcgagtgcctccccctgcttaggattttggtgtggaggaggtgggggagtacgagctcgacggcgtgggtttggctccccgtcgtcgccactcacactcggagagaggtcgtgcacctttgcttgcttggccattaggctgaacaagaaaaacttggcgcacacggaagagtatgagagctcagaaaacacacgctgagccccctacctggcgcgccagatgacggagctcgtggctcctcaccgggagaccgcgcaggcccccctttgccggttcggccgggggcttagggtgagatctcaagctctctctgtatgtggaaagatcgcgtgccaggaagaaacgcgagacacggacgatgtatacaggttcaggccgctgggaagcgtaataccctactcctgtgtttttttggtggatctgtgtaagagcaagttacaaaatatcaaccagccctctcctctcccgggaaaatccaaaaatcccccccttctctttgtgggcatggtcctccttttatctcttaaggggataccacatgtacccttccctttttaaactggacttttcttctttacataaatggacgtagatttgcacggttgccctccgaacgtccttctgatgggacggcacatacctacctccacttctgccgggggcaggcgcgtcgtgggaacgtggctgtgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtaacacgccagctccagctggggacgagtgcctagaggctctcatcttgacgggacggggcgaggcgtgagtcagaccgccagtcgccacctaaccgttgatctgaccggtctgtgactggtcacagaccggataaaagagcgcgctgcattgcgctgcatgcagcgtgacacgcttaaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagatacccttggaatactctcgggtgaaatgttacaatggtatatctgtgcgcttgcgaatgaactctgtaaccataatataccaggagtatttctgcgccattgctaggaattatatttctagtaatgacgttaagaaataccaacacccacggtgagcaaggggttgaaatggaagaagatgcctagtaaaaaaaaagaagaagatgaagtggagaacgagaacattccgaattgggctcagtacgctggatttgaaggaaatcaaacgggcgaggtggacagggatgctgacgataacgacgctgcggacgatcttggtcagatgttgtaggacgccaaggaggactgtgaaagtgaaaaggaggcccataaattggagcgtatgttagaggaccacagaacgtcgttgtacccaggttgcgagcaggggcacaaaaagttcttgcaatggaaggcaaaaaatggtgttagtgacaaggcatttggcgatttattgaaactcgtcaagaacattcttccggagggaaacaaattgcccgatacaatgtacgaggctaagaagatagtctgccctctaggactggaagttcagaagattcacgcatgtccgaatgattgtatcctatatcgcggtgaggagtacgagaacctagaaacatgccctgtttgtaaagcattatgatacaagattagacgagatgatccaggtgaagttgacgggtagacaacgaagaagagaattcctgctaaggtgatgcggtatttccctataataccatggctaaggcgtttgttcaggaacaaggggaatgctagaatgatgcattggcacgctgaagaacgtcaacaggacgggatgctgagacaccccgccaatggttcgtagtggcaaaacatcgacagaacatttaaagactttggaaaggatgcacgaaacatacagtttggtttaagtacggatggtatgaatccttttggagagatgagcagcggccatagcagcccgttacgatgtgtatctacaacctccccccttggctatgcatgaagaggaagtacataatgatgtcgattattattcaaggccccaagcaacctggtaacgacatcgatgtgtacctaacaccactggtctaagatctgaaactgttgtggaagaaaaaaggtgtccccatgtgggacgaggacaaacagtaggagtttaacctacgagtgctgctgttcataaccatcaacgattggcctgcacttagcaatatatccgggcagtctaacaaggggtacaaggcttgcactcactgtatggatgaaactgaaagtacgtatcttaagcactgtaggaatgttgtgtacatgggtcatcgtcgattccttgctgcaaaccaccctgtacggaagaaaggcaagcactttgaacataaggcggaccaccgtacgaagcctaaacatcgcagcgggaaaatagtgtttgatatggtgaatgatcttaaagtagtgtttggaaaggggcctggcagccagcctatagagagtgaagatggtcacgcggcgatgtggaaaaagaactctatattttgggagttaccctattgggaattcttggacgtccgctacgcaatcgatgtgatgcacctcactaagaacctttgcgtaaacctgcttggcttcctaggtgtatatggaaagtcaaaagatacactggaagcacataatgatctaaagcatatggaacaacgcggcgaccttcacccggaaccaaaggagaaaggaagccattacttgagtccagccagctacactcttagcaaggcagagaaggaaaatatgtttgaatgcttagagagcatcaaggtaccgtctggatactccacgaatataaagcgaataataagcacgaaggagaagaagttcacaaacctaaaatctcatgactgtcacgtgttgatgacacaactgctaccagttataattcggggtatccttccagacaatgtccgggcaacaataacaaagctatgtgctttcatgaacgcaatttcgcagaaggtcatcgatccggatagattagaagcccttcaaaatgatgtggtgcaatgtcttgtcagctttgagttgatatttccaccttcatttttcaatataatgacgcatctgcgttgtcaccttgtcaaagagatcggtatggtgagtttaattttaaaaagaattatcacatggaagatggcgagtgctccgttctttccggtggcgatcgtcggccatggcgatcttgattcttggcactagctcttctgtgcttcttcatgatgaaggaggatctgataactccctctccgctggggggttggaactttgatttcggcaagtcttttgcttctcaagtcttggatctttttggttgccctgtccatttttctccttatttcagttcttctcctttcattctggttgtggattttgtccgcttcaatttccgtttgactgtcaagtcggttgctattgctctacaagcttgtctgggaggaagcccccatggttttagtgtgctttctcttaaagctaattgtttctcattccaagtctgtaacaagaatgtcggcctctatgtcaactccttccgggatttcacttgcaaagattttcatgtccgttttttcttgtggggtaatggcggtccaaattggaggagagaatttgatctttgggagaaagaggagaatgatctttggtcagttgtttcttacaaaaagaaggttcagcattctgtcaatttgagggctaacaaagcagttaagtttcagattaatcattctttgggcaaaaggcagattgataagccatcggttttcaagagattattcctaggggatcctttccctgttcatcagtgttcttcatcaggtactgttgttcctcctctggtaattcagcctggctcggattcaaaatacattgctccttcgcctaagattgcgcattccgttacttctgttattattcctgaagttattgatcattcaagtccgaggatttctccttcggctagtttgaattctggacaatctagagagtctttgttttgcaatcgatatttggcccatggtcatggcccagccaattgtcgtagcttgatccattgccggagttgttttaactatggccattttgctcgtgcttgtctggcccaaaaaccgtctcgtgtctggagggttaagcccttttggaaggccgaacccagtgggaacagtgtctttgtgagcagtgctctatttcttttggaaagtgcctcttcgtctctgccagtctcgccccccccccctcctcaatttccctcctctgcacagtgcttgtcctctcctcgctgtaaaaccccattagcgcttgtgctgccttcctccagggcgcaccttcacgatgctgacttccggccggagttgtttctgctggagggaacaaacattgaggtcccgtgggaagggcgtacccctcgtgcggacctcacgcttcaaggtgttctccccaactctcaccaagagttcgctgccgttgttgttgatcctcagccgccggagcacctttttggccagttgattcaagaagtggcaaacatcatcgagcatcagcatcacattcatgttgttaggatccagaggtatccccttgctctgtgccttgttcagctaccttcggttctggatagagacattcttgttgccagtggtccggttctgctaggtaattggttccatggtactttcgttaggcatgatcagttagctaactggaggaactcgccatacaccagggagggttggcttatgattctgggcatcccgcttaatcttaaaactggggctattattgaacggatcactaatctttgtggggaattcatagactggcactatagagatagagttctgggcagagtacttgttaaagccagatacaaatctgctaatgaggtgccaaactgtattgttctgggggatactatggcttatgggggcaatggtcaaacatggacctttcatgtctatgtgctgaatggagaacccactgatatgctacctggagatgaagacctactgcccatttggcaaatgatgccacctcctcagcagcaccatcatcataataagcatcagcatcacaatgaggaagatttcaatgctaatcacaatcagaatgaagatattgggggacaaccagatgattttggagcagaaccagattgaaaagccccatgattcagtttcagttcaggatttcactctcgacctaactgtcagttcctccaatgagagagagtttcagaacattggttggcagattattccttttggtctgccaatccctgctttacctatcagaagtctgcttgatttgttctgtcaagctgttgcgaatggagtatttgcaccactgcttttggccttacaaccaactcttttcaggcccatcgtaatgtcacctaggtggtctctgactactacttcttagggagtcatgatcaccattccctctttggaattcatggacagcagcccaagccctatcaaacgctgcacgacaagtctgattgattcaagggtggtcaaggctcttcctttctctggggttgttaatgatgattctgagagagtgactgaggttgttgacaaggtggttcagcccacactactacgaaaaccatctttcgtggtggccattttgggttttcgcgggcggaaatcgcagccgccagaaagcaaaggccagtgaaaatgtcgattttcgctagcggttatttaccgccagccaaaatgcatcctcgttggcggccgagaaaggaacgcccgccagcaaagagatgtcttcgctggcggtagccttaggacggccgctagcgaagacatgtctttgctagcggcggacataacgcagccgccagcaaagaagtatctccacttgcgttagccttaggtcggccgccagcgaagataattcgttgttggcggctcacagtgttttaggccacgtggcacgctaggaaaaatgaagtaaggcttctgtggatggacacgtggcccgacagcaaagatatgtaccgtcctagttctggcacgtggcccgccagtgaagatgcaatttttaaaaaaaaattaaaacattattatatatactattttttcttttcttcgtgtgtgtatttcagagtcagacgtggttgatataactaatcgagctatcgatagagtatgttctctttcgcgtatcttagagcaacgcattgagtatatatgaagcagaataatatacatatatataaatattcggaagctcctatatatatgtacgttgacaaattaaatttgactgacgacataacatttacaagtattttgaatgaattagaaaactctagctatattatacgcctggtccagttaaacagggatttgttctccggcagggctaagactccttcgttgtcaaaaaactgcccaagctgatgtgcgcactcacggtggatgaagtagcacatgtccgcctgaatgttctgaatggatgtatcattgagctctctttcagacttggggaattttggaagctacatcagatcatgacagaattaaggaaattaactattcacaataatacaagttagcgactaatttaacaagtgtgtattacttaccttgtcgtaattcgcacaatatttcccattaacccttaggaactcacaacattaatatccacatagtactgttcccaccggttgcttgtgacactttcaacatcaaaataattataaggtataataggttattacatggaaacacacaagcatttatgaaaattaagtagtactgtttggcatccatatatatgtacttaccggccacttattgcggacggatatgcgttctcttgagtttttgcattgtccgcctcgctggtaataccttttaaatgcactgttttgcggatataattaatttacgttcatcagaggttaaaacacgccatgctaatatcttacttacagatcgataattcttagaaattcctgataggtgttgctatctttgtcgagagaatccaagacgatgacttcattgtactttggatagagaagaaagactatctaatggtcgctgcaaacgaaattgttagtcgagccatgattatatgtatatactcttagtgcatatatattacaacttactcaaaggcatatggggcataaacatactccttgtcctacgtagattcaagcgcaatagctacgtacgtagcgacatcgagcaccttttcaagatgctttggtgctatgtaagctttcctctcttcgggagtcatcgccttgatgtgttccggtaacttcttctcgtctagcgtgtatgtgtggttcggtttacttatcctgcacgggtttaggtaggcgacaggctttttcatcgcttcggcttccacgtaattcatcctgccacaatggatgatcaaatgagctacgcatataggtgtaatgatctattaacacgttcaagtgtagcacttacagacaccagatggcaatcaaattggcgtccagccgcttcctacagtagagggaatgcatatcgaagaaatggacttggagtagacaaggaccgctctagaagatgttcacccccacggcaactgtgaatgaatcgatgcctttcatggtgcttgccctaatgtaccaattgtgccatcttcttagttgccacggtccttctcttagttgccagtcataaatgaatggtttgccattctcaaactcatgtggcacgtctggggaattgatatagttgagatagtcatcgaaggtctgtttgaacccttttaattttctattatcaaattcggcatttatgatatctttgtcccttcctcggaatgccgttaccatataatgtttcttggacgcactttttgctttgtgcttgtgcgtccttaccatcactggcacatcggcacgcttaggttcctctggttgcgattgctctggttgatcgggcattggctgatcaggcaccgcttcaatttcacccgtcgctagctttgtaggctctgctctacatccttttctgtctgaggtgatgcaacgggaggctccagtactggaggtgatgcaacttgtggctctggtactggaggtgatgcaactggtggctctggtcctggaggtgatgcaactggtggctctggtctagagggtgaagcaataggactatccctcggactggctacgactggtggacgtgacggtgacaccggtatccttggtggacgatcagttccatccgttgaccctagttcaatatcattcttgtgccatagtatgaattggtcgacggcatctccaaggtacacaatctgctcagtagttggaaagtcgagctcgtgcatccggtaagcctcaatgaccgtccggacctctaccttggcgtagtcatccggaatgtcttggcaatgaaacctgtggcctggtatgaacctcccagttgcaacgagtattttctttcccaccctgctgaccggaatcaagagcttgcacggagtatcctccgttacatcatcgaaaggatagctcggctcaggctctaaaacagcagcaccgtgcttcattttctgactccagtatatattgcattcgtcacgagctgctgccctagcctgagttcattttctgactccagtatatattgcattcgtcacgagctgctgccctagcctgagagtcaatctcttccttgtagcgatcacgcttcttgtaggtatgagcatcctgtttgaatccatccttccagttagtctttgaggaaactccccgtacacggccagagtgctccggtttgcccaaggcataggtcagcttgtcccggtctctatctggcatgaacgtccctgcctgttgctacgtgacgatgttctttatcttgacagctacctcgtggagcttctgatccttgaatactacatccccctcaggggtgaaggccggtgttcttgcacgcacccagttcctgcttcgtgggttgtgatttttcataggaacgggtttcccagccttctccatctcttcatcttgttttgcccatttcttcaccgcttgctggtaattggtcgatcctaaatgatgtggatattcattccttcttgctagctcagccatcttctggctcttctccttttcttctgccgatgtcttaagggcaacgaactcatcccactgggcctgtgttatccttccgtagtccttaaacggcgtgagtcccttctggacatatttcttattttggtccgttttccagtttcaccacagcttccccattgtgttcaacgcataatccttggctttatcgtcgtctgtcccctctggatattcaaacttgctttgcagcgacgtccaacagctgttgtttcgactctctggaactttcttccaatctttccatgtgatctccacgatatccctgaccaccgccccacattggttgctatacttcgaacatgagtcttccggtgacaagggttcccctgtctcactcatccgcgttagcacgcttacttccttcaacaacatgatgtgaccatggctactatggatacgaccattgctcacatcatgaatcaacaagaagacatcaagatcaagtcctccatgtgctgcaatctgattcggccacgtgttacattgctgatttcaaacggccgccaaatctacatacgtgctccgttttgggcccgtgagtacttgatggaaagctctcgaagtcctccttccaacggatccagcctcatctcggaattctatctcgtttggctgcaatcacagaagcaaggtgctgcgtcacctgtattgggccaatgggcttgtaactttgtttgggaccctggcccatgtggggcccatgtggggtgcgccccaatctggtggagcacgacccttggaccctcttggtcgtcctcccacctctataaatagttaggtaccccttcagggtttcttgggttttgatagattaaagtttagccattgctacttgcttgcagcgcgtgtgtcggctagaccgtccgtctgcttgttcttcggaaccccaacttatcatttgtattaaattcctatttgcaatatcagattgctttttatcttgttcttgcttgtttcttcgatttgcttgcaggaatagggttgatctgcaccggcaagatcaacaacccacggagaggtgtatcgatcgctaaggcgcaacacaatgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagttttatctacccataaccagaaaattgccatacaaaataaattttatcctgtacctagccattttgtgccattgcattgtttttatcagtttttgctttgttgagttttgtgttgcattgtcgagtcgtgttgctggtcttagcgtttagttcgtttagagtttcgagttctggtcacgtttcgtaccactgtcatcgcccccgccgtgtctttgttgtcgtcgggacctaggaaaacggaatcatcttgttgtcggggtttcgtttttctagttttcagaagtttttgtcggtcggtcttggagttgctgagttgcatcaagggtttgtcgtctgtattcggccgtgcttgtttctcttgcgcgaggaagaggagagaaagaaaagataacagatctgtttttggaggaagttttgcagactagatcaatcaggttggttagtttccatctaaggccaaactttccaaactctccccacgcgtgaagaccggttagcgccatctccttttgtcgcccactttagctgagtccgactccctccctctcacgtcggtttcgcctgttccgagttgtgtcaaacaccttggtgaatttttgtttggtgtcggtttcgagatccgtttcgaaaaacggaatcagtataaattcagcattccatttttgtataatttttaattttggtttggacttttacagttgagtccttgtaattttcatatttacatttgagtcccagtaatcttgcattgaggtccttgagttgtttttgcagaaaaaaaaaataaaataaaaaaaagaaagtaaggaaaaggcaggaaggtgcataaaaagaaaaaagaaaagaaaagccgcaccaaaaaaaaaaggagagaaaaaaaagaagaagaaagaaggaagaagaaagaaagaaaaaaaaatcagttgtatctttgagctgaagatgatctatcagagtgtgcctaagttgtttctagtgctatcctgtggtatcgcttgtgtctaggctcacgtctctagtacgttctagcctaggaccagcacggtacttgactttgaaccattattcaactttgcattctctgatttgaacatttgctatccctttgctacatatttaagcctacccagagctccacagatctgattgcagccgtacaacaagtgtttgccaaggcatcgatacatccaacctctattggggtgcttggttaagtcggtgtacatcaccattccgcttgctttggtaagaacttgtaagagcttggttaaaagcttgagtgtgtgtgatatttgagctgccactacctagtagttgatacgagcatgcatatttttgtgtgtttcttgtttgctactaaccatggcaggattgcgtaagggaatacgagaacatcgacttctacaccttcgacgagatatgacgacttctccaaatgatgcatatgaggtacatgactataattttgaacaagttgcatctaagttactcttctatgatgggaagtatgattctgttgcatacattgattgggagctagcagtagacaatgaatttgatatatatgatttttctgatgctcaaatgattaaggctgctagtaataagtttacctcttctgcattattttggtggacttatgttagtaataaacctgaaacttgggatgaattgaaaaccatgatgagaaaacgctttgtgacatcttattacaaatgtactcttcgggagaaattagaacatctgaaacaaggtgacagaactgttagggagtacattcatgaatttaaggtctgtatcatctacagtggtctcaaagagtgcaatgaaaatacaacgcgtagatttttcaatgggcttaattctgaaattcaggttttgcttgataatgtgacatataatcatattgggcacctattcatgcttgctcgtagcattgagagtcagatcatatcaaaggcgaggatgcatgaccaatgtgatttatctcctatttctgaatccccaatatacttatgtaatggtgatgtgcaaacattggaggagcaatcttttgtctcccctgttactaacgttttgcaggaagatcagcacatccaagaaaaggagaatggtatacttgagaagaaagaggatgaagcacctgcgatgtctgaagaaagttcgcaaggtaaattaaatggtgctgagagaaatgaaggtgagtattctcaaggtgagctacacttgtccacttttcatgctatagtagagcaaccattagtggaatcaattgctgagttgcctttgtcacaagttgatttacttgctattccttgtgataaagaagagttgtgtgataatgtttcacttatatccatgccacaactagtgaatgaacatgttagttctactatttctttgtgtgctgattctaagcatgttgttcacattgctaatgaagtagaagaacgcgaattgctatcttctttaaatactttgggctatgttcagtttgatgatttttgtaagctcgataatttgaaggagaaattatttgctaaatctgatttgccatgtccaactaatgctatttttcatatctttggcgaatataatgatagaggaatatttttggtgcatagagtttacatttgttcggatttagaacatcttgtagttctggataaaatatgcaagctagagagacatgttactgctaatcatattgtctcgagtttgtcttgttttgattgcaagaaacaggttgttttcaggggactgcgcgaagagcaccatatggaaaaaccgaggacggttttccgtgaagaaggggaggatgatgtgaccatggctaccatggatacgaccattgctcacatcatgaatcaacaagaagacatcaagatcaagtcctccatgtgctgcaatctgattcggccacgtgttacattgctgatttcaaacggccgccaaatctacatacgtgctccgttttgggcccgtgagtacttgatggaaagctctcgaagtcctccttccaacggatccagcctcatctcggaattctatctcgtttggctgcaatcacagaagcaaggtgctgcgtcacctgtattgggccaatgggcttgtaactttgtttgggaccctggcccatgtggggcccatgtggggtgcgccccaatctggtggagcacgacccttggaccctcttggtcatcctcccacctctataaatagttaggtaccccttcagggtttcttgggttttgatagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcaacaacccacggagaggtgtatcgatcgctaaggcacaacacaacgtctcgtacggttgtagtcggatcgtcaacgtttctcccaaatcgtagttatcacaactcaccgaaagatcgggccaacaacagccttgagtgtcgagaggaactcagggttcatcacaacatgttcttccctcgctcgccccttcttttcttgggtttgcttaaagctgttgtgcgcacgacagctgtagcttcagcttcaggttcagttgcggcttgggctttccttttcgagcgacgtggagcattcaactattgtttgcaattaacgtgactttaattaaaatccatagttcgcagttaatatgattggaactaaacatatattatatgctaagtaccaccggttcggggggaacgtagtcggagtcaacttcattgtcgctaccgccctttctcttctttgcaggagaaggatgggggtcactcggcgagtgatacgatccactgcctggttcacttgagctagacgacgaagattcctccgcgactactttcgtgcaaatatcttcctccatgactagctgagtttccttgcccttgtcacccgtgggttgctcttggatgggtttgtccattgatatcgcttgaaggtgaatttatgtaagttgcgaaatggaatcattttcttattgtaaatccgaaaagaaggcaaaatttagatactaattttgtacaacaactataaatattgttatcgccagcaaactccttgatcgcttaaagcaatcaatgaaattggtaacggcatcaatattacaatccaccaaccctgaccatttcaaactacctaattaagttccttaattatcaaagaatgacataatacaaaatgcatggagaattatggtgtttaggtcggttctgtccatggactacactgaccaatccaccataattcgctatgcattttgtattctgtgatggtttgataacctaggaactacattaaatctacggccaatctatcaattcttccatttaagctacatttcaaaccctaaacctaattaagttccttaattatcaaagaataacagaatacaaaatgcatggagaattttggtgtctaggtcggttccgtccgtggactacactgaccaatccaccataattccctatgcattttgtattctgtgatagtttgataacctaggaactacattacatctgcggccaatctatcaattcttccatttgaactaaatttgaaaccctaaacctaattaagttccttaattatcaaagaatgacataatacaaaatgcatggagaattttggtgtctaggtcggttccgtccatggactgcactgaccaatccaccaaaattccccatgcattttgtattctgtgatggtttgataacctaggaactacattaaatctgcggccattttaagctaaatttcaaacaacacattttgatcgccatagtatcaaactaacaaattactcaatttcagtcaaactaacaaatttgtgcatctaaatattcacccacagtcatctcaatgaatcatattcagatatatatatatatatatatatatatatatatatatatatatataaattgcagaaactatgcacgctttcagatcagcaatggctagcaacagcataggcctgaataaaagaaagtgcatttcattttggaaaaaaagtgcagcaatacatatgtacaggtccatttcattttggaaaaaaagtgcagcagcagaacaattccttttcttaatatgttgagcacaagatcaattttgattgtacaatttaaatcacatttgcaacaagaaaacaaaggacagtactcatacatgcctctatcatcgataaaactcagtggctgcacatctattttagttggtgcacaaaaaagtcagtggctgcacaaactcatacatgcctctatcaacacaaaaaaaactgcatccacccaaattttcaccaccaattaacattcataaaaaattcatcccaattcagccatcaattcatctcatatcacattcatcgtccatcaattttcatcacattcatcatgcatcaattcatctcacatcacattcatcatgcatcaattcatcatttcaattttacagaatggggaggaggagcagaggagggggtgtacctcggcttctcggcacggctcaccgtggagtcccagcgcggcggcgacggcggtggcgcggaggaggaagaggcggcggagctggtcccggcatcgacgacgagtcccggtggcggcggcgtcgacaacgaggacccggcggcggcgatgactcccgaggtggaggcggcgtcgacgacaaggaaccggcggaggaagaggaggtcccggcagcggtcttggcggcggcggcggtgggaggaggaggcggcggagctggtcccggcgtcgacgacgagtcccggtggcggcggcgtcgacgacgaggacccggtggcggcgatgactcccgaggtggaggcggcgtcgatgatgaggaaccggcggaggaagaggaggtctcggcggcggtcttggtggcggcggtgggaggaggaggcggcggctgcggcggaaaaaaggagccggcagacaagtcccggtggtggcgacaactcccgacgtggaggaaggaggagccggggagaggtggagctcgatctgccaccggtggtggtgaagacgccggcccgatcgaggaggagaatgcggcgcccgtcggtcgaagaggagttggatctagcggtggcggtgaagagaaggcgcgaatggatctaacgccggcggtgaaggtgcgaatgaagaagctgtgtccgaaaagtggatggcgcgaatgaagaagaagtcgncgacggtggcgggcgctaggaatatcgctggcggcggcgctcgaaattttggcagcctggcggcacaaattttagggttcgcgcgcctccgggacttaggatattttcagccgcacgcgctagctacttataggcgaagacatcttcgctggcagaggaacgcgccgaccgctagcgaaaacattttcgctggcggaggattccgtgggccgctagcgaaaagggttttcgctggcggcaagcttatgtgggcaaagccggccgccagcgaaaaccctttggtcccacatgtcattctcaactgaaaaaataattttatttatttttacacagatatgattaatttatcaaaaaaataaaatatgattttttaatgtttgcgcctgatatttttttaatgcatgcatacaaataaatttataccaaactatttcttgatccaacaattatcatgtcaccatattccatatacaaaaattcatctcatccatcattgtcacacattataatacattaaaattcatcgatacgtccaacatgatatacataatgaattagcatctaacacttttccttacaccttcatttctcatgtatggctttggtgattcaccaattgattcttcgacgcgtaaaatctcgtttcgaaaatctatgaatagtgtcatgttctcatattgattgtatgcctcgacatcttcgacatcatcaactcccaaaatcctttgttttcccaaaataactatgtctttcttcaaatgagatgggtctgtcacatagaaaacttgagcgacccgatcggcaagcacccatgggtcatccttgtggcctacgttgtcaaagtcgacaattgtcagcccaaagttgtccacagacacgccggctgggtgtttcacccattggcaccgaaacagtggaatctacatatttggcccgtagtctagttcgcagatttcttctatgaatccatagtatgtgctcttttgcccagttgtgtcgattgcttctactcgaacgccactgttttggcatgcacttcttttgtctttcgcttttgtgtaaaacgtgtatccattcagatcatatgcttgccacgaggtatacacacttgatggcccatcagttagcattttaattgttctttcttccatggtatggccatctggtagatcgaggttcttgaaccattcagtaaagtgatgcttgtgtttcttcatgatccatctattagatcgacccacatttgttgcttgtaattcatgcaggtgttgctctatgtacggctccactattgtgagttactgcagcacagtgaaatgagcatctttcacttttttgtagtcattgtcgtggattcttttcttcccttttgttcctttcccagataatctaccttcatgtcgaggtaccggtaaaccaattgctttcccatcttttaggtaatcaatgcaacactcaacgacctcctcgattgtgtatccctctatcatggatccctctgggtgggcgcggttccgtacgtagccttttagaatggatatgtatcgttcgaaaggccacatctgatgcaggtacaggggcccaagtgcaattatctgaggcacgatatgaactatgaggtgttgcatcatatcgaaaaatgatggagggaaacacatctcaagctcgcacactgtctgtatagcgaaagcccggagaggacctaactcttcaggatcaattactttctgagatatggaattgaagaaataacacagctttgtgatgaccagctttatgtgaactggttcgactgctctaattgcaatggcgaggaatactgtgagcattacatgacagtcatgggaattgtagcctgaaagcgacatatccttcatcgacactagtcgcttaatgtttgaggagaagccagtaggcactctcaccctatgtagggatttgcacaatgccattttctcctctcttgtcaaggtgtagcaagcaggcggtatgtacacttttccattattaccttcatccacaggatgaagctctttccttatttgcatatccatgaggtccttacgtgatttcagcccatccttggtcttagttggtatgtccagtatagtcccaatggtgctatcgaagacatttttctctaggtgcatgacatcgatagaatggcgtatgtctaaatctttccagtacggaaggtacttaaagaaaatggagtgcttcttgaatggcacgctagggcttgctggcacttcggcatcatttctcttccgcttatttgtttccttcttttttaccttcccaaaaacaaccttcaggtttttggtcattctgaacacttcatcacccttctatggttctggtgctacacctttctcaacagtgctgtcgaaatattctacttgggagcggtacgagtgattctttcttaagaaacgccggtgccgcatctacacttgcttcttcgatcccttaagatacctgtacacggtaccatccacacaaataatgcaacccgtctttcccttgatctgtcccaatagggaaaacagtgcgggcaagtcattgacggtgacaaagataattgcatgtagcgtgaaatactcccgcaggaattcgtcccaaactcggatcccatgttcccacaaatcatgcatatcctccagcaaagactctagaaacacatccatgtcattgccaggttgtcgtggtccctgtacaaggatggtcaacaagatatacttccttttctgacacagccacgttgggaggttgtacatggttaggagtactggccacgtgctgtgtgagctgctcaagtcaccgaatggattcattccatcggtgctcaatgcaaaccttacatttcttgggtcctctgcaaacttatgatactttctgttagattccttccactgtcttgcctctgcaggatgtcaaatcattccatccttttttcacttttcatgaagccagcacatcaattcggcatcccttgggtttgagaacaaacgcttcaaacgatctttcaccggaaggtaccacatgacaagctgtggaatcttctttttgttactgtctttgcatggatcggactcttctatatcgtcaagggcaacatccagatcctcggactggctacggcttgttttgtattgactactcttgcatgttggacatctgtccaaatcctcgtactctttacggaataggatacagtggttaacacacgcgtgtatctttcgcacacccagtgacaaagggcatataagcttcttcgcttcataggtgcttgttggcagggagttgggttgcggaaaaagtttcttcaacagaaccaacaagtcattagaactactatcggaccaaccatttctggccttcaatctcataagctcaagcaccatccacaacaatgtgaaatccttctcacagccctttgcctcattgtacaatagatcattcaatgcctttttcaatgcatcaaagttatccaacccacgggcggacccagcaacaatcttaggttcagcatgacgcaacatctcttccaaatctgcaaaattaccatcatctacgctgacattaccatcatcggcatcatcaactgtactgtgctgaccattgccaccaacaacatcatcatcatcaacaagttctactgcacttcttcttcttcttcttcttcttcttcttcttcttcttcttcttcagctactacaatgacatcctcgtcccagctcaacacttcgtcgtgtactgtagcctggtttggaacttgcttgcttgggatctttccatgatgtgaccagtttgtgtatccctcaacaaatccatgcatcaccaagtgttgctcgattacagatggatcattccaacttttctgatttttgcagtgcacgcatggacatctaatatctttggtcttcttagatgcagcattcttcttagctgctttcatgaatatgtcgactcattcaatgtatgacgcacgatatctctctttattcatccgtgccctgtctgccatctatgcattaattaattaattgcggaaaaaataatacaactttagttagttcaaatattttgaacaagataattaaagctagccaaaaatctgcatatataaaacatacatccctcagacgaattaccaaactacccttctttctcttcttctcttcctagctagctcattcttttgcagttaactaatatataaatctgctaaaaataaacctatcgaaaactagatatatatatggaacatcgatcatgcacaatatttcttgcaaattttgccattttgagctccaaataacaaataaaaaatgtttttcttcctccatgtcaagtattttttgcgatgaaaaatctcaacatacaaccaataaaaatgaaaaaaaagttgacaaaaagagtaggacaaagtacaactaacctctggtacaataaatctttcaaaagattcgagatcaaaaccttgaatgctgttggtcaataccagtgagaggaagcaaccaggctattatcttgaatgctaagctcaaaaatcttagaaggggtcttaaagcttggagcaaaaggttatcaaatctcaacactcaaatttcaaatagtaatgaagttctgacaacccttgatgatctggaagaacaaagacctctagctctgcaggaatggaatttcagaataattctcaaagaacatattctcaagcttttgaattacaaaaatgagttctggaaaaaaagatgtaccatcagatgggtaaaatttggggatgagaacacaaagttttttcaggcctcagcaactgatagtcatagaaggaataaaatctcgcatctcagtttggatgatggaagtatagttactactcatgctgaaaaagaacagattttatatatggcctacaaaaacagaatgggaactcggggctcaatggacatgatcttaaatttgtctgatatggttcgtagaatggaaggcttggagtgtcttagtgagatcccatctacagaagaactggacaggatcattaaaaacatgcctactgatagggctcctggaccagatggtttcaatggcttatttttaaacaaatgttggagtatcataaaacaagacttctatgagttggcttttcagttctttaccaacaatgtctccctcgagaatttgaatcactccttcataacgttgatcccgaaaaagccaactccagaaacagcaaatgatttcaggccaattgcacttcagagttcagcacttaaattcattacaaaaatcttggcaaacagattgcaggaagtaattctgaaactcattcatgataaccaatatggtttcatcagaagcagaaccatacaagattgcttagcctggagctttgaatatattcatcagtgtcatcagtccagaaaagagatgataattttgaaaattgactttgaaaaagcttttgatttggtggaacatgaggcaattctccaaattcttcaggccaaaggattcaattctacctggttagactggatcaaaaatatcttgtcttctgcatccacttcagttctgcttaatggaatccctaggaaaagtttcaagtgtttgaggggagtaaggcaaggggaccctctttctccattgttatttgttctagctgcagatttattacaatccataattaataaggcttcctcaaatgggttactctcaactccaatcccaactagcggtaattcttttccagttatccaatatgcagacgatacattaataatcttgaaagcagatcagagataagttttttgtctcaaagctcttcttaacacatatacaatgtgtactggattgaaaataaattatcacaaatcaaacatgattcccatcaacactgacagtcaaaaaatggaaattttagctggcacttttggatgttcaataggtgccatgccttttacttacttgggtctacctcttggcacttcaaaaccaaatgtcagtgactttgcaccattgattgatagagtggaaagaagacttccttcaacaacggtttatctaaattatggacaaaggctcaccatgatcaattcagttctttcttctttaccaacatattatatgtgctctcttaagctgccaaagaaagtaattttgcacattgatagggcaagaaagcactgtttgtggaggaaacataatgagtcagaaactaggactcattcacttgctgcatgggatctagtttgcaggccaaaaaagagaggtggtctgggaattatcaacctagaaatccaaaacacatctttgttgcttaaacacttgaacaaattcttcaacaaaaaagacctgccttgggttcatctaatatggaataaatactatattggtttggacaagcctccacatgcgcaaattgagaagtgatcattctggtggaaggatattttcaggctaatcccgttatttcaagctatcacatcggtgactgtaggaactggagattctgctctttttcggaaagataattggagcaatcacaatttggaaaatgaattccctgtcttgatttcttatggaaggaatgaagatgtcactgtacaaggatttctgtcagccacagatattggtcaaaactttcacttacctctgtccaaccaagcaattcaagaatggggtaatttaaacaacagattacaaagcttacagattgtcactgaatcagacaaatggtcatatgtatggaactccgattgataccaatccaaaaaagtttatttgatgttctttcagcatcttcaggttgctagaccgatatctatactctggaaaagcaaatgtacaatgaagcttaaagtttttctctggctcatgttgatgaatcgactcaatacaaaggaaatgttgcagaaaaaaacaattcaatatacaaggtggtgtcaactgtttgctatgcagctccatggaaacagagaacatgatacacttatttttcagttgcccttttgctcaacagtgtttgcaacaaattggtattcagtggaatgtaaaccaggaattcttgaacatgatcacttcagctcagatctcttttcaacatactttcttctttgaagttttggcaataggatgctggcacatatggagtagaaggaatgatctcatctttaacaatgttgctctcagcttcgacaaatggaaggatgattttcagaaagagtttgccttgcatatgcacagggcaagagagagggacaaaacagattggcaatcatggatagctaactttacttaatacttctcctttttccctttttgtaaattcttgcatccttgtaactatgttttatttatttatatttaatatagcacagtaggagcctctcctgctgttttcagtcaaaaaaaaaagagatcggtattctcgagccagtgtacctacacaacatgtttcctttcgagaggtacatgggcgttctgaagaagtatgtttgtaaccgtgctcgtccagaggcaagcatcgccaaggggtatggaaaagaggaggtcattgaattctgcgtagaatatattgaagaccttcgcccaatcagggtacctgaatcacgccatgaagggagactacggggaaaggggactcttggaaggaaagcaataatgacggtagacaacaatttattccgtaaagcacatttcacggttctgcaacaatcttcattagtggctccttacatcgaggagcacttggctctagttcgcaccagaaacatcggtaagtccgatgcatggattacacggcatcacattgatactttccccgcgtggctgcgacaacatctcatgggtaacgagacgattaaccaacaactggccttcctggcaaggggaccatctggctcgatcgcgacattccagagatatgagatcaatgcgtacacattctacacgagagcccaagacatgaagagcatgaaccagaacagtgttgttcatatcgatgccatgggacacgatggtacaactggcacgtattacggtgccatcaaggacatatgggaacttgactatggacctctcaaggtccctctgttccggtaccaatgggttaggttgactggtggaggcgtaacgattgatgacagtgggatgacaacggttgaccttaacaaggttggatactcagacgaaccttttgtccttgccaacgatgtaacgcaagttttttacgtgaaggacatgtctagcaaaagaaagaagggcaaaaggcctgacaagccgaagcgccacgtggttctcccaggcaaaagaaaaatcgtcggagtagaggataagactgacgaggattacgatcagtttgatgggcaaccccctttcacggtgacgattgaccctagcatcctcctattaaatgaagacaccccttactcacatagcaatcacaagaaataaacaatagtgaggagaaagtacgtgcggccaaccatcaccgccgatgtattgccgtaattgttgtgtacaagatgtaaactattttggatgtattgaatatccatataaatcaattggtgtatggcatatgttaattatgtatgattattagaatttttaacaaatttaaatcatgcatatgctagttatatatgataattagaatttttaaaagttttaaatcatgtatgtgcttataatatatgattattagaatttttaacaattttaaatcattcatgtggtgtttacatatgattgttaaaatttttaacaattttaaatcatgcatatgctagttatatatgatcattagaacttttaacaattttaaatcattcatgtgcttattatatattatccacttaatttactgtagacaacaatatattttgaaggttttgtcattaattttgtgactttaaatcattttaatgcattatttactattttagaaacccatatgtaatgaaatgtaatatgcagtgcttttatctttagtcccggttcttaatcttaaccgggttcaaaaagaatttggaaatagtgggaaaagatctttagtcccggttggtctcaccaaccgggactaaagatcccggggtatatatatgcctgaggcgcactcgtcttctccaccaacacttagatgtttttctctgatctcggcttctcctttgatgccactgcctagggcatcccccgcgccgacgccgccgtcgtctctcgccatcatctcgctgtcgtcgtcgtcatcaccgccgccgccaccgccaccatatctctggggttgccgccgctgcctgcgcgaactctctctctctctctccaaaccgccgccgcctcgtcgtcgtcgtcattgctacgcctgccgacgccgaccccgactccgccttccgccgatgccgaccccgacgtcgacgcggccgccactgccgacgacgcccccgccgcaccgcgccatgccgccgccgctccttttcgctgccgacccatcaatgccgaacgtgaacgaatgcgaacggacatgaacgaacgcgaacggacgcgaatgaaacgtgaacaaaacgcgaacgaacgcaaacgaacgtgaacgaactcgaacttaacgtgaacgaacacgaacgaacgtgaacgaaacacgaacgaacgtggaggaaacgtgaacgaacgcgaatgaacgtgaattcacttgaacgaaacgtgtgaatgaaacgtgaacgaacgtgaaggcacgtgaacgaaacgtgtgaacgaacgtgaaggcacttgaacgaaacatgtgaacgaacgcgaacgagacgtgcacgaacgagataattaaacgattattaaacttagcatatatatatatatatatgattatatacttgaaaacgtgaacggaaaatatatgttcctttgcgtttagactaatacatttttttgcatgttgcagataagagacttcgtcgtcgtccctcaagccgaagtggtagctaaccctcggaggaatttgcgcaggcaagtgatataaagatatgattatctagagttctaatatacgaaacttagacttagcatatatgattgttagagttttaatataagattattagagttttaatatacgaaacttagacttagcatataagattattagagttttattatacgaaactttgacttagcatatataattatttgagttctaatatacgacacttagacttagcatatatgattgttagagttttaatataagattattagagttttaatataagattattagattattagacttagcatatatgattattagacttagcatttctgattattagagttttaatataagattattagagttttaatatacgaaacttagacttagcatatatgattatttgagttctactatatgattattagattattaatatataattattagacttagcatttatgattattacagttttaatataagattattagaattttaatatatgattattagagttttaatatacgaaacttagacttagcatatatgattatttgagttctaatataagattattagagtttttatatacgaaacttagacttagcatatataattattagaattagcatatatgacctatagaattagcaaatatttcttgtatgaatagatggttgatcgcgatgacgaacagatactataccatacaatcgcagagggaagcagccagtactggaacgaagaagaggggaacgaggatccaaaccagtacttgaacgaggaagggaacgtggagagggatgcggaggggaacgaggatgaggaggctagtggaagtcaaccctccgctagacagaagagggcacacggacaacgaggtgccgcgaagaagatagagggttggcacatcataactgaggtggacgaagacggctgacctagtgccccggcagaagcagccaagaattttgtacgacatagcggttgggttgtaagggataacgtgcctgtcagcaaggtgtactggcgcagaacaagggcacgcggggattatgacagctttgtcccagaatcagagaaagagatgttgtggaccacaatgctcgagatgttcacgctccctgcgggtacggagaacatagtgaaacagtggactcttaagaaaatggcagaacagttccagagcttcaagggagatctctacaagaaatacatcctgaaggggctgacactgaacttcgacgtattcccaaagctaagggatcattgggacgagttcattgcttacaagacagggcaacaagggcaagcgatgatggacagaaacaaagaaaataccgccaagaagaagtaccatcaccacctggggtcaggcggctatagcgtcgcaatgccgaagtgggaggagatggaagcaagcattattgagaggggtatcgaacaggccaccgctaaatggccgtatcgatcgaagttctggtactatgctcacggtggaacgcttaaccccgttgatggctccctgatgttcagcgatcagatacgcgaggctgccagtcgactaacggatgcagtggaagcctcttctcagggcatgttctgacccgacagagagaaggacgagctgtcactcgccctgcagactcccgagcatccaggacaaacacgagggaaaggcgtggttccttggaagattggattcaaggaggacatccacacatacaggagtcggatgaggagcaagagagataccgaggcgaagattgcagatcttgagtacagggtatcgagctacgaggcaagaggaggtggcaaggaaggtggatgaacgcatggccgcacatcggtcccaggatccccagctgtacattcctcctgtaatggttagcccctcaggcaatcgtagcagctgcgcctcaacggggcaggtaggatcacagagcatggacgccatgcaaactcaggatgaaaccacctgccccgttgatgagatcacgcagcggacaccatgtgagctgcatattcccttcaagaacttatcaatcaaggtatgttcgtagttttatgatttatgctcgtagttttatgatttttgacttgtacattccgcaagttgctacttaggttgattactaatagataacctctcatcacgtgaaggtggcgttggaaatggccatcccaacggacccttcagggacttaccactgtaggccggttccagcaggatactcaagggtcgaagttgagctggtggaagccgcgtacgaggacctcgagttggactaccctggaggagacggtgagacgcatctacgagacacaagccacgccattatactatggcgcaagcggtacatcatcctccctaggcgacaagcggcgtctcgtgcaccatctcctccggctccgccatctcctccgccacctcctcctgcaccatctccttcggctcctccggctcctccacctccactgtgtccacctgcacctctcaagacaaggtctcgccaagctccaccgcctgcccgcacaagggcaacgaagaaggcgaaagttgacgccaccaaaaacaaggagtcgccgtacgattgcagtcaagaggagcttaatgcttatgtggcaggagaagtgaagaggcaactcaagcctcggagtcctgaaaagaagatacctgttgacccgagcgtgaagaacttattcaagaaaatgtccacaacaaacaaggaggtcttaaagctatcggactatgaccgaacacttaagaaagcctattacaagaagtccaaactagtcccttagcttggagaacaaccataccaacaggtcgagccgttggtgactggcgaagaaattggcatagcagaattcatttctgacaccagtctaactgtggatcagttgattagaggcgcaccaatcctgaaggcggaagtggcatacaagtttgaactcggtaaaccgcttgtcacgcctgagcagctgtagtccctaccgacacagatgtacaaattccatgaacggtacatggaaatgagtgccaagggtagagagatgttcggagcgaggatcagaaactccgacttcttgcaaggagaagatgttctatggatccatttcaaggatgtcttcgaactataccctctggacaccctcgacgtctctcttctaagcgcattgattttgtaagtatcgttgagttcgatttgtttcgttcaataattaactccttgcatatatgtaaacaataataacttcctttttatcgttgtagaatggagattaaaagggctcgacggtggggggtttacgatactgggttcatcgaccctcggaaaatcaacgccgaaatgatcgacaagtacgagaaagacatagaggacaatctcgtccatctcctgacgcagcagcatttcaagacgttcatactactgccgtacaacacagagtgagtttttactatcgttcgaacaaatttcattcccatacatataacatgtacattttcatatatatatcatcacacgcatattgcagattccactgggtcctgttacttttcgacttggacgcatgcagagtcaatgtctataactcaatgaataaagaggagaagactttcgacaaggttttccaacggatagacatgtaatataattgcatctattcaaaagtcacggggatttttcctattgctattatgcgtatctcggataataattaatcatagcttgcaactgcatgtagggtttgggattggttccgtcaattggtccccgggacttggaaagaaaaacttggatggaggtttaattttctagtgagtacatgcatgatccaaaattatattgaattgaatctctaattacagttaatataagtgtatattaaatctctcgtcctttctcatgtactgtgtaaagcaggactagggaactaacttgtgccgctactacgtatgcgagtatgcccactgcctatcaacccaaatctacaccacacgagagcttgatgtacgtatatataaaccattcaaaatttcattgcgtatcgatttgttgtgtatatatatatatatatatatatattaatcagatttgaaccgaggttcatttgcaccaggaatctccaccgtagatgtgtttcaggattcacacatatgtatcagttggttactgcaggaagtgtctcttcaaaccatttaatcatggtcaaaaggtggtatggtcagatggagaggacagacatgcatgtgctgtattttctccgtgccagaaattcattatgttcacagggtgtctttttttttttccaatcggcacgttaaaacgatatatacaaattaatgatgaatcgagtaatctaattagccttttacgtcagagctataaatgagaaaatcattatgtgtgccatacgtatatggtacatatactatatatatgtatgtgtgatgttagtatatacgtgcagtttctgctgatcactctgtggtgtcatgtgggctgcagggagggcataatcgagaatgcaacctgtaccattcaacctaccaacgcacagccctatatagcagctcaatgaggttggtacatcttgatgctcattagtcacatgatggaacatgtctatgcatacacgcgtcaatcaggtgattggggtgcatatgaactgtggtctatattatccatgtcatatatatatatatatatactagcaaaatgcccgtgcattgcaccgggtaatgccgcgttggataatgtttaactgaatgattttgaaaacggtctaatatgacaataataatcacaacagatttctttttgtttggacaattattccacatatacgtgtatgatatgaacgatgttcctaacacgttagcgtaatgattgtaccatgggaggaacaaatggtgaatgcattaggttactttcatgcaagaatagatggacgaaaatttgtatgattaacaaaaaattctatatttaaaataggtaagtttatcataaaactaatgacaatcacgacagataagattacttttgcatatttactcagtctcatagtggtgatgcatgctttcttaagctgtcaactctcgtgttgcaagcgtgcgatctggtttccaaaatcatatgtcgactcacatggaggaagcaaggcgagtggaagggagatgtccattcagcgccaagcggagcgaagcggcggcgacgcggcctaagcggcatcggcggtgggtggggctccatctctcctcttcctcctacgacagatggtgagcagcacagagcggcctaaacggcaacaggaatccacctctcctcctccaaccggcagcgagcggagcggagctctggtggcgtggcccaagcggtgcctgggagtccacctctcttcctttgatcaacggcgagtggagtggagcggcggtattgtggcccaagcggtgggtgggagtccacctctcctcctcctccgaccggtggacggtgcgtgaacgggggcagcaggggcacggtggtgcgtccacgacagacggcgtgacgggtgttctggcgacacagctgatttgtcgctgctacgctccgaggcagcacggaacgacgatgacaatgaggttaggtgccagatctgtcgccgcctcttcctccgccgccaacatctctgccctaggccaccgccataccatcttctcttcttctccctatgctgccgcttccgccgtcacacgggtgaggggcgtcgcgtggggccatgcccccacccaatgcgtcacttgccctgtgcttcgccccacgcctgccaaattccgacgaaaaacgtgtagcttcatttggctccgcggttttcagtcgggaacaacaggcgtgtgcgtggcgatgaatcttcaatgtggctgctcgggacagaacgcgacatcagtgcactgtgaccgcttaacagctgcaatatgcagctcaagcgaggattcagattgggtgcagctgtaactgcaactgttcctgacgactgcggccatgtttagttccttttaaaaaaatttaagtatacgaacacacatttgaagtattaaatgtagacaaagaacaaaacaaattacagattctgcctgtaaactgtgagacgaatctatttagcctaattaatctgttattagcaaatgtttactatagcaccacattatcaaatcatggcgtaattaggctcaaaagattagtctcgcaatttatatgcaaaatgtgcaactggttttttttcgtccacatttaatactccatacatgtatccaaacatttgatgtgacgaaatttttagaagtttaaacggaagtaaacacagcaacacagctgttaacgaccaaatttggtaatccaaggatcggagatgaagaagaaaccgagatggaattcgagatggaaatcgtcccggaaacagagtgaggatcggctgaagttcgaatcggctacgactaagatcggcagagttcaagtcggacgaggttagccgattgagccgaatccgacaatatgacacaacatatgttgtcggtttaggttgatgtgcttcatgataattgctacgcatgtatagagtcctgagaaggcaactgtatcaattaattaggatattttatgtaattttcttagagatatgtttgggcaaaagtctgccgcaaagacttatggtatcttagagtttgttagagataagagtcgtgtccgatatggacatattttgtaattctcgggtataaatagacccgagccccatgtaatcaaactaacacacgttcaatacaatctcggtgcattgccaccctttttactttcgttttgtttcgacgagttcttactttcgggttgagctgcatcggtttcgatcttcaacaaggggtaaaacttgttatggtggcttgcgttctcgggattagtgcttccatatttatgacactctaatcttttttatgtaattcgtcgagttatcatatatctcacataatctctggcaatatcgctatataacctacaatcggctaacatctgtcagtagaaggcagccgattaggttaaacatcgatgctggcttagattatataagatatccaccactctatgacacatccaacggcttgattgtctagatattattcttcttttcatacttatagctgcattagttgagtttgatcttatgagtcgtgattagaatctcaatctctagcctgcctttgattgccgattagggtagtatcagggtttcagccgatcttacctgatttaactacatttatcttatatgccttattgacatgttaaattcgccctttatgttaatatcttgatgcatttaagtatattaggctttcgtttggtatattttacttgctgtgatatcttaatatagagtggtatcgaagtattagccgatacacgctagatctatcttatcagctatggtataaacacatatagtcttgttattaatatatatttcgatctaagtgatttatactgtctcggcatggcgaccgatctatcgcaatcacttgatttaagtatatatcgatataaggactatataccgttaatatctacagccgatcgagtatatttagttctttcttacttattaatgattgccgatcgatgcatatatgacatcggctcaaagataaatgatatgtcatcggcatctagccgatcagctatcatttatagatttaaccgtggtttctttgtctttgtttcttgttgattgcaggatcaaatcaactggcacgctcgcatacccaaaggcaagttttggacctgcattggagttaagcagatctctcaggcctcgtgttttcacatcaacacgcttttggcacgcccagtgggacccattagaagtcagagtcacaacagcggtctctaatggctgagaaaccaccagcatcactgtcctcagctggcaaagaggggactcctaaatctaaaatcccgaaacctggtacatctgaagttaatgagagtaacatcgtgcccatcactccggactggttgacacccgagcagcagaaggatcttgaggctatgatgcagtaagcacggaaccaattcttgaactcattcatggagacccgcaagggaacagttgttcagaagtataaagtaaaagtaattgctgatgttcccggaacaggttcttccaaggatgcagaagtacaacaggttccagatggtacaactcaatcaagtgataaaggtgttgcagatggttttcaagggattcaaggtgatggctctcaaggggttcaaggtgatggttctcagggatttcaaggtgaaaatcttaaccaagatggcgacactgcatcgctacagtttaacaacttccaagatcggattgactatgccgtgcaacatgctttgattaatcaatctggagtattagtcaacacattatcaaacatggtgaagtcgatggttgatggcttgatagctgaatatcaggctacaggaccggtttatttgccaggaggtgttttcccaaactatcggcccttaatcactaataatcaaccagttgtctagccaattcctcccaatgcaccatcggctcaaccgacagcaccagtatcggctcctgcacctgttgcaccatcatcggcactgggtcaattaattaatcctcggttgttggtgagagagcagccacagtatagtggacaaaatgtgaatcggctaactcaagatcaagttacaactatgttcctaccacctcaacctactgttgacacaatccagcaacagccgattcaacaaacaccaccaaggcagcaggttgtgcagccgattcaacagacaccaccaagacagcaggttgtgcagccgattcaacaaacgccactgaggcaacaggttgttcagccgattcagtagcaaggtttgatgaatgcatcggctgtgtttggaacacctgacgatcagctaaggtagcacgctgcgaatcaagttgtcctagagcatttggtccataacgtgcaaccagatcaaactgtggtacctcaggttattcccgaacatttggtgcgcaatatacagccgaactttcagaattaccattggggcaatttgaattatcagtattagcctccatcgccgtaagttcaatatcagcagggaggaccggctcagccccagtttgttcctcaatacaatcaattcgagaccgtgccacaacaagcacaaggagtgcctcagcaacgaccatgggctgtatgattgcagatgtgatgagagaacagtttaggcttaagccgaaagatgctgaaaatttgtatcggcatccttaccccgagtggtttgagagagttcctctgcctaaccaattcaaagttccagatttttcaaaattcttagggcaggatagtgtttcaacctatgaacacgttagccgatttttagctcagtgtggtgaagcatcggctgtgaatgccttgagggttaggttgtttccattgtccttgtctggatcggctttcacttggttttcttctttgccatgtggatcaatcaatagttgggccgatttggagaagcattttcatagctatttctatagtaggattcatgagatgaaactatcagatttaacagcgattaagcaaaggcatgatgagcatgtgcaggactacattcagaggttcagagagatgaggaataaatactacagcttgagtttaactgatgcccagttagccgatctggctttttagggtatgataactccgatcagggagaagttctcgtctcaagactttgatagtttgtctcaccttgcacagaaggtaaccttgcatgaacagaggtttgcagaagccaggaagaactttaaaagggttaatcatgtctgtccttacatatatggatcagatgatgatgatgatgatgacgactccgaaatagcagcagccgaatgggttagaaacaagaaggttataccatgccaatgggtgaagagttctggaaaagaagagaggtatgactttgatatcatcaaggctgataagatttttgatttgttacttcgggagaaacagattcaacttcctactggtaatacaatcccatcggctgaggaattaggcaagaagaggtattgcaagtggcataattctgggtcttattctaccaatgattgtaaaatctttagacagcagatccaagcggctattgaaggaggcaaaatagaatttgatgattctaagaggccgatgaaggtcgatggcaatccttttcctgtaaatatggtacacacagctggccgaacagccgatggaggaagagcaagaggttttcaggtgaattcggctaaaattatcaataagtatcagaagaagtatgacagacagcaggagaggcattatgaagaagatgatggcggttttgattctcattggggttgcgagttctttagattttgctggaataaaggtatgaggctgccatctattgaagactgtcccgggtgcggcaatgttgcagaaagttcaagccgatcgtataatggaagcaatcggctaaggcaagcaagagttcctgttcatcaaaggttgggcccggtgaaccgagattgtaaccaagaggacgatgaagacaggaagactcaatggtgtccttctggtatttttacaaagaatcagaagagaagggttcaaaggttgaggaacagagagcgttttcagtgtcacagcctgaattttcgtttcaggatttataaattatttaataaattattaatagaatttatattaaatgttcattaatttacaagtgaagttaaatgtgggaaataaaatttcctaaatataaagcatggctggatttaatttttattaaattctccatgattaattatactctctgaaattttctcggatttttttcggagctcaattcctaattttaataatgcaatgaatatttcagtaattatttaattaataaattaatcattaaatggtttggtttcaatattgttaaatactttgagtgtccaagtatgttcaagaattctcgtggaattatttgagcattggaagtatttttaacaattgaaagatcatttcagtgattaatttaattgggaaaagtaattaaaatccccttttccttttcgggccgaaacaggaaaagtttacttgtagtcctcggcccatccttccttcctctctctggtcggccttttctccccaaagtctagtttgagttctcctttaatcaggctgtgcaatagaagcccaatccctgcgccactgttcatcttccagctcaggcagagccgagccagccgtgcccgtgtcctattgccgccgatccccttccaaagtccggccacctcgttgctcctttttccaaattagttgcggcaatggaatcctctcaatctcctcttccttttccccaagaaatccccaaaagtttctatggaaatcctttcctatttcgtggttcaatctttcctttttccagcgtaaaccctagtctttcccaaagtttctcgttgatttgggcccggacccgagctcccgtgcctatataaaggaccccctagtcgtcctctacctatcccctcaagtcccgtcttccgccgtcgccggtcagcgccgccacctccctcggcaccgcaaagtcgagctctatcccgatcgctggttattttgcgccaaatcccaccggaggttgcccgtcgtcgtgaaccggagcgccgccgctgccgccgttgggttcgcgaggaggagaagaagatcgtcctccacttccccgaagctgaaatccaccggagctccatcgtcgccgtcaacccgaagttcgccgtcgagttttgatctccggcgaggccctactgctcatcccgtcgtcgccttcggtcgccgtcgtctccattgggttcgcaggagcaaggtgaagcccggccaccgggttttcttcgccgaagatcactgaaacgtcgccgccattgctgacccgaccccatcgccgcctctacctcgttgccggacgtctgccgtcatcatccatcgtcgcgccgcccctcggtgagctttcctctctccgatgtcgttcatcggtgtagtttatccatagggtcttaatccaaaatctaatttggcccttgtgtcgtcgtcgtctccatgtgttgccgccgggtcaccgtcgtcatctctctctccgatcactttttggttcggtgagacttctattcgtcgtttcgtgttcccattgccacattgtcgctgccacactgccgtgccacactatcaaagccttagtgtcgctccctgcctcagtcatgctgctgcgccgtgccgctttgctgttgccagccaagccacattgccaccgctgctggtgttgcgttgccaccgctgccgcgttcctggcttagtagagccattgctaccgctcggtagccgtctcgctaagtcgtcgttgagtcgctgccgctgctgcgccttgctgtcgtgctctgccgtagctgtgcgtcgtcgtcgctgtgccatcgccctaaccctaactgcgtgactccgccgagtcaccgccgcctagccgaaccaagtcgccctagtgccgccatgtcgcagctgtgtgccgctttaacctagccgccgctttagccgttgctcggtagccaagttgtctagccgtagatgcatcccttaattcctaccggcctattgtttgctgtaccggggctttactgtgaatcgtgtatagctcaccggtttagtcacagccgttgttgagtcgttcgctcgttcgttttaatgaggtgttccccgtgcttcgttcgttcgtccatgttaagtcgtcctttagtttagagccgttcagagccgccggttccgttcgccggtttcggttgatcatttgagtgatcccatgtcacgtagaattgactcgttgagtcagtatctcttgagcttcgcttgcaagattaatctcagccgtccaaaaccaatatatatccgttccctctttttagtggcatattatttctttttaatatatatcatctaccaaatataatctaatctttttcggaggttgtttccaatcttttatcttagttataaatcatttgtaaattgtttaattaatgtggaatagtctttttctttaataggtttaattggaattaaatcttgtaaaattcgtaactaattcatatgaaatcggaatgaggccgttcaagtctcataataaatctaaaatcatgatctacatgtttgtttactttatatgtactgtttatttggagtttcttagtctttttcctcgttttgcgtgttagcatgtagtttctgtcgtttcgaaggttcgcgagtgcgccggaagtgttcaagaagattaattgaagaccgattattgcaaggtaagtcacacagatcccaaacacaattcctttgagcatgttggtcctatatttaaattcgaatgtcaccgggtggtgtgaacctattcctttgttatggccaatttgcattgattaccctatttcttgattacctcgggttacaatttgactagttgagctctatatattgtttcagctagatgttagacataattgcttagccatgcttagaaacattagcacacgattgggataactaatgttcactattacttaatgatggatatttaatggtagctcacgatggtcaatcgtgattggttagttaattaatttgccgactaaaacttgataatggtgggttgtgagcacatggttttgatggtcgtgctcatgacaattaaggatcggttcacgagttttggttgtgaaacattaaccgtgccaaccacaagccagcgtggcaacggctttaccttttgtatagcatggttcattgcggggaccagactgagaagtggcggagataagcccacgggggtcgctggggagtccatgccttgtttataagggggtgattatgatccaggaacggtgcgctgtggtggattgtgttatgcgaggggtactgtcacagctcctttccgaggtatcgtggtggtattgaggcgcatggtgacatgttgtggggctgtgtcttgtgggtacagtggtacacctctggccagagtaaaactagtcgaatagccgtgcccgaggttatgggcgggtctaacaatgtcttttgtgattagtctcacacttctcaccataataaatgatgctataactggtaataatttgattagctcctggtttagaatggtacattcctggattgagatagatctgtacagccgggtatggttgttcaggatggttgggcctgagcagcatgggtgtgctgttcagtgttgattaaaattgatgattaattactctactgttttataattctaaaatgtttgctaaatgctgcttttgcaaatgagccctatattatgccattctttggtatccttgtgcacttgcatatttgctgtgtgacttgttgagtatgtcatatgctcacattgtaataatcaatcaaacctcagtggaagaaaaagaatccagatagagaagacatttggcttataccccagttgagctgcctgagggagtggagccggagcttcgctagaccgtaattccgctgcagttttcttttcttttttaagtatgtaacattgtattattgatgaatctgtatattaaattgtcagtttgtgtacctcggctgattcctggacgagggttttatgcacaaattagttcggaaattactagtgaatttatgggcgtgacattcaggaagttgagcaagaaatcaatcatcagctaaagaagacgaagccaaagcaggagtggcgtgttaagattcaagttcctgcagccgatgaagccacagccgatgaagcaaaaagattggctaaaggaaaaagtgtggtgactgcatcggttaacatggttttcacgttgcccgctgaatttggagtcaaacaagccgatgttgataaagttgaagaaaaatcggctaaattgattttattaccagaacaagcagtctttgagaagccagaagggatagagaatcggcatcttaagggattatatgtgaacggctatgtcaatgggaagccgatttctaagatgatggtcgatggtggggctgcgttaaatttgatgccttatgctacatttaggaagctaggtagaaatgctgaggatttcatcaagacaaacatggtacttgttggcagtatggcatgaggcccttcgaccaaacctgccgaaaccatgcgaccagtaaggattcaagcctaagacgtcaagatcggttggggcgaagcccccatggcgaagactatggagcaaagacggcgaagggcggagaatcgtgcgggtgcctcgtagagccaaagacctcttaggcgaaggatgtaaggcgaagagtgtatgtcgaagggagacgacttcgccatagcaagttcggcctcacgaaggcccagtggcctttgggccaacgatcgcctgacggaccattaggagcccatgtacctcaattacactgtatacccacataaatgtccctttcataagggcagccatgtaaattcccctgtataacctaaaccccagtagcaagaacttgtaatgaggctataaatattctcctagggtcatgtaatagggggatcccaagaaaaattctccattcaatacactttactttctttccaaccactgttgagtaaccacgtctttcgacgtatgcagttgtcgtttcgaaaacagctggcgccgaccgtggagacctccaagcgaaaccactgagagcgaatgccaccgaagagagtcgtgaaggagaaggttacaaggcgaaaggaaagcgaagccggaggggggatggccgccgaaaagggagcagagccttcggcgcccatcgccgaagatggcggagcgccaccggcttcggcaccagcgccgctactaccgtcttcggctcctgccgcctcgttggggcaggtgccgaacacggctgaagcagcgaaggcggcagcggcggcaagggcactccaaaccagggcggagatcctttcgacaagcaaactgctggtgccccaagccgctccgtcgcagctggcagcggcctcgactgcgctcaccgctgtacaagtcaaccctgatcccgaaacacaagccgaagccgacatggaagccatgcgacagaacatgacatgactccaagacatgcttcggcagatgcaagaacagcagcaggcgtacgaggcagcgaggcgggccaaggccgcttcggccccaatcctccagtattcggcaggctacatcccaccccaagtctatccacaagcaccgatccaaccccttccaccacaagccacgcaagcgctagtatacttcgctgggcagccttcgaccgcagcagtacatccgggccctcacgtgcaactgcaagctcagccggtcactacccaagcacactctcaaccgcctggccaagtgtcacaagcgatggcagaaggggcttcggctctgcaagcgcagcttcaagctttcattcaacaatttagccaaccccacagcatttcaggtatagccccttcggcccagccggaggggagtacaggtcatggtgcgcctagttggttgtcgtcgaatcagccgggtctgggggctttgccttggagtcaaggaccgtagttcgacttcaacaatattgctcaggcaccaaccgttccgccgcaagcaccaacactaggcttcgtggcaaaccaagcaccaaaccagtccgccatggcatggccccagccaacattcgacccatccatggcagctcaccaagcatcaccaatcggagctgggcagccgaacaccgtggcccaacctcacgcgcaggccgtgacttcgcctttcgccacaccgtatccgtagcaaggtgccgtgaacagggcagggggcgaaaaggggctactgctgagtgggggaatcaagacccgtccaatcccaccccagttcaagttcccacccgtcccacgctattcaggcgaaattgacccaaaggaattcctctctatctatgagtctgcgatcgaagcggctcatggcgacgaaaataccaaggcaaaggtaatacatcttgctctaaacagcatcgcccgttcttggtacctcaatttagcagctaatagcatctactcatgggagcaattgcgcgatgtctttgtccttaactttcgagtcacctacgaggagccgaagacgcagcaacatctactcggcattcgccagaggtcgggagaatcgataagggagtacatgcgtcgcttcttgcaagcccggtgtcaagtacaagacataaccgaggcgtctgtcatcaatgccgcttcggccgggatactcgagggcgaactcacaaaaaaaatcgccaacaaagagccgcagacgcttgaacacctgcttcgcatcattgacgtgtacgcatggggcgaagaggattccaagcgatggcaagcaattcaagctgagtatgataaagcctccatcgccgctgccaaagcccaagtacaagctcaggtcgccgaaccacctcctctcgctgttcgccagcctcagccggcgaaccaaggataaccgccaaggcaaggccaagctcccataacttggaggaagttcagaaccgaccgtgcgggcaaggctgtgatggctgtcgaagaagttcaagccctccgcaaggagttcgattcccagcaagcaagcaaccatcagcagcccgttcgcaagaaggtccaaaaagacctttactacgccttccacggacgctctttgcacaccacggagcaatgctgaaacattcggcagcgtggcaacgtgcaagatccaaggccgcagcagggagcagctgtcgaagcacctcgcgaagacgttcaagaacaagcacccccggccgaacagcgccaagatgtgcagcgtcgagtaatccaagtgattacaagggccgacccgccgaatcagctgtcgaaatgacaaaagaagatgcagcatcaaatggtccacaacatcacttcggcgggcgaaggggccccacaatatctgaaccagcaaatctctttcgggccggaagatgccgaaggagtaatgttcccgcatcaagaccctctggtgatctcggccgagatagctggcttcgaggtccaacgaatcttagtcgacggagggagttcggccgatgtcatcttcgctggagcatatgccaagatgggattaccgaccctagcccttacccaagcatcggcatcgctccgtggtttcggcggtgagtcagtccaagttctaggccaagcgcaattgctggtagctttcggcacaggcaaaaacagacgcgaagagaaaataatgtttgacgttgtcgacatcccgtacaactacaatgccatcttcggctgtgcgaccttcaataagttcgaagccatttcccaccacaattatctcaagctcaagatgcctggcccggtaggagtgatcgtggtcaaggggctccagccttcggccgcttcaaagggcgatttggccataatcaacagagctgtgcataatgttgaggccgaaccacatgatccggcgaagcacgcgccaaagcccgcccctcacggcaaggtaatcaagatacagattgatgataccgatcccacaaagcttgtatcgctggggggcgacatgggcgaagaagaggttgagaacatcctagaggtgctcaagaaaaacattgataacttcgcctggggccctgatgaggtgggaagtgtttcgacagatctcatcatgcatcacctggcagtcatgccggatgccaagccaaggaaacagaagctacgcaagatgtccgttgatctccaagaagcagcaaaagccgaagtccaaaaattgctcaaggctagggtcattcaagagatcgaccaccccgagtggctggcgaatccggtgctggtgcggaaatcaaacgacaaatatcgcatgtgcgtcgatttcacaaacctaaacaaggcatggccgaaggatgatttccccttgccacggatcgaccaactcgtggattcgacagctggctacgaactcatgagcttcttggatgcgtactccggttaccaccagatccacatgaacccggccgacatccccaagacatccttcatcacaccattcggcaccttttgccacctcaggatgcctttcggcctgaggaatgccggggcaaccttcgccaggcaggtgtacaaggtcctttacaagcagttggggtgaaatgtagagggttatgtcgacgatatcgttgtaaaaagccgcaaggctttcgaccatgtgtccgacctgtaggagaccttcgacaacttacgcgcggcgggtatgacactaaatcctgataagtgtgtttttggtgttcgcgcggcaagttgttgggtttccttgtttctgaaaggggcattgaggcgaaccccgagaaaatcgatgccattcagcaaatgaatcccccgtcgagcgtacgtgtcacaccctaaaaatcctaaatatataaattgttgtttaattggaattatttttaaaaggctagaagagaagatttaattttaattaataaattccaatataaaatggggccagataaaatttcattaaatactttgtttaattctataattcctagatttttctgggatttatttgagctaaggaagtatttttaataaatggaattgcatttcatgaataatttaaattgaaaaaggtttttaaaagtctcttttggctttgggccgaaagtcggcccaaaacctcctctctctttcccccggcccaagtcggcccagtccgcagccgtccgcgcgcgcgcgctcgctgtcgctgacaggtgggtcccacctgtcaatcttcgtcttcctcgcgccgccaccaccgcccgaaccctagcgccgcgccgccgccgtctccttccaaattcggccgcgccttttccttctccggtgaaatcaatagaggggaaatgatctccgggatctcctccaccttttctcttttggaatcatcggctaatttcgtttggaaatccatggattcgaggtcgattcggatcggtctctctcctccgaaccctaacctttccttcttgtcgctggtcgccatgggccttcgccaccgcctccttgcccctataaaaggatccccaagtccgccgctacccgtcgccacccttgccttcgtctctcgccgtcggaagcgccctagcgccgtgagaccttgtgccgttgtcgtcgccgtcgctccagccgtgcttcgccgtcgttccagtcgtcgccgtcgctcggggagaccgccatcgtggtcgtcatcgcgtcgccgtcctcgtccgccccttcgccgtcgctgtagaccgccggagcatcgccgtcgtcgtcaagccgaaggaccccgccgccttttcctcgacgccgccgccgtctgttcatcttccgccgtcgttttggtcatcggtgagttcgccgcgtcgcgctctacgtcctggtgccctccgtttatgccgtagcgccgtcgttcgccggcgagcttgcgctcccgagccgccgccggaggtgacgtcgccgctgacgtcatcgggaccgtccgccgtggcccggtcgtggaccgttcgatctcagccgtccgttttggataggatcgatcccgaccgttcgttcccgcgaaccgctgccgtgcacccggtccaccgcaaaccctagccgctgacgcaataaaccctttttccttttcaaaaataattcattattgcgtcataattcaattaaaacccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgtttggtgattttgctcttttttgcttagattccgacgtttccggagagtccgttttcgcaggagaagaatttgaagagttccaaggccagtaaggcaagtcacacagattccaaacaaccctttgagcatgttgatcccgtttaaagctactgtttctattcaactattgcatttattttcgaatgtcattgggtggaattaacctattgtttgttatagcccctttgttcttgcttactttattccttgataccttgggtgtttataactcgactagttgggctatatatattggttcagctagatattagatgtgattgcttagccatgcttagaaacattagcacactattgggataacttatgattcactattaattaatgatggcttactgatagttcacgatggtcaatcgtgattggttaattaattatttgccaattaaaacctgataatgttgggttgtgagcacatggttttgagagatcgtgctcatgacaattaaggaccggttcacgagtttcggttgtgaaacattaaccgtgccaaccacaagccagcgtgggcaacggctttacctttggtatagcatggttcattgcggagcaccagactgagaagtggcggagataagcccacgggggtcgctggggagtccatgccttgtttataagggggtgattatgatccaggaaaggtgcgctgcggtggattgtgttgtgcgaggggtattgtcacagctcctttccgaggtaccgtggtggtattgaggcacatggagacatgatgtggggctgtgtcttgtgggtacagtggtacacctctggccagagtaaaactattcgaatagccgtgcccgcggttatgggcaggtctaaaaatgtctttcatgattagtctcacacttctcaccttaataaaagatgctataactggtaataatttgattagctcctggtttggaatggtatattcctggtttggagatagaactgtacagccgggatggttgttcagaatggttgggcctatacaacagggtatgttgtatagcgttggattaatattgtttaattattacttaactgttttattaaattctgaaatgtttatcaaatgctgtttatgcaaatgaaaccctactatgccatcctttgttatcctgtgcacttgcatatttgctgcgtggcttgctgagtatatcatatactcaccttgcaatcactcatcagaggaagggttctacagtgatgctgatggtgtggaggattaggtgtagccctggtcaagctgcctgtggagtggagtcgtctgcgccgtttatcttatctttccgctgcttagatttttattgattgagcggaactatctacctctgtaatgacattttgttcgcttattaattagagtaataattgtactcaattatcaatttgttattgtgtgcctcggctgattcttggacgagggttcacacacatgtaagcgtttggaattttggatagaaattctgggcgtgacaagttggtatcagagcccccttgaccctaggttatgccaaacggttacccatagaagccctctaaaaatattggaaaagtagaactgttctcctccccttctcttttaattaaaccaaactaatagcacatgcaattcataatctcttttagtggttctcgttcaaaatttattccagcgttattagtactgtacatctattactgtactaatggctcatttaccagcaaaagttttacaatatggttttatttaatcttgctgcaataaaataaatttagcatgttgattttataactttcttttatttctttggaacctgttgttcaaaagtacaaaatttgtgaccttatttccaactgtttcaacttatcttgcaagcttggtttactttatttacttacctttttctttgattttctaactttattcaaattaatccaaaaacttgtgctattaattggataaatgtcttaactccctcctttcacttgtctttagatgccgtgctacaagcctgagtacttgtttggtgttgagggatttgtccaggagttgcgtacgatgtcctttgccataggatttgggactacccctttttatgcccagattcctcatgatcgtcacgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgctacagtgatcagttggccgacactgagtatctctaccatcctcgcaaccacagggaagtgaccgtggcagctaccttgagactgaaggaattgagaatgatgctaccacaaagcatttggttgagatgctgtgggctatggatgaaacccgtgcagagactgtgttagcagctcaagatcgtgaagaccggaatcatggtaagatttgcaagctataggacaaagtggatcgtttagagaaggaactagccgcattgaagggagaagcaccaccgcagaaggccaggattcgtcttaccgcaaggaagagagctctatttgtccctcgctaccaattggcgccaaaggtccgtgtggtggagaaagaagttaccccagccctagcgaatcctccggtcgtcaacgtaagtgatgatgaaggagaagaatccaagcgcacccattccaagatcgagtggggagcaactcaagatgatgaagacgagccgaacgagccttcaatcaactccgatgcccggaagaactagaatgccttgtcaaacagttgtcttagatcgttgtgttagtttgcttgttttaagtttggttgtgtgtgtctcgcatgtgatttacatcagtggtgggatgtaagtccatgcgtttgtttgctttcgagtgttaggtagttggtgagtttagtggtgtgagagtctttagttttgtaataatgaaactcacttaagatcaataaaagttaaattaattctctgtcctaagtagtttttcccggtttctcttcttgtgatcctgcccatgccagatggtgctcactcgcagcaacgggaatggccccaacaacaacaataacaacaacaatggagagaatcccacacttgcccaagtcctggctcaacaggtacagcttatgaacataatgatgcagcaacttcagaaccagcagaaccagggaaataatcatgcacctcctcagaacaagttagcagaatttcttcatgtgaggccgcctactttctctagtaccactaatcctgttgaagctggcgattggctgcatgccatagaaaagaagttggatttgcttcagtgcaccgatcaggagaaggtctcatttgcatcacatcagttgcatggccttgcctctgaatggtgggatcacttccgcctgaacaggactactactgaacctatcacttggcttgaattcaccgctgctttccggaagacgcatataccatcgggagtggtgtctctcaagaagaaggaattcaggtcgctcactcaggggtctcgctctgttactgagtatctgcacgaattcaatcgtctggctcgttatgctccggaagatgtgcgcactgatgaagagcgacatgagaggttcttggaaggacttaatgatgagctttcttacccactcatgactggggattatcatgatttccagaagttagtggataaggctattcgccaggagggcaagtacaaccgcatggagcagaagaaacgccggattgctcaattcaaggcacaacaagggaatagtcagaggccgcgtcttactttaggaccccagtccatgcgacagggaggttcttcgtctgttgttcgtccgcagcgtcagttcttcaacaacaatgcgggcaacaacatccgcaatcaagctccacgccctgttgcagcttcgacacagcaacagcctgccaagaaggagcaaggcagcaagcccgtggtgtgcttcaactgtggagacccaggacattacgctgacaagtgtccgaagccccgacgcgtgaaggttgtccctgcccagagcaactctactgtaccagcatcaaaggcccgtgtcaatcatgttgctgctgcagaagcccaaggtgctccggatgtgattttgggtacgttccttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcctgttagaatccaaagaccttgatgtcatcttagggatggactggttagccagatataaaggtgtgatagactgtgccaacagaaaagtaactatcaccagtaatgatggtcgagttgtaactgttcatgcattgtcttctgagcctttaaggtcaagactgaaccaaataactttggaagagattcctatagtccgggagtatcccgatgtgttcccagacgatttacctggtatgccgcctaaaagggatatagagttcagaatagatttggtaccaggaacgactccgatccataagagaccttatagaatggcagccaatgagttggcagaagtcaagaggcaagtagacgatttgcttcagaaaggatacatcagaccgagttcatctccatggggagctccggttatttttgtggaaaagaaagatcatacccagaggatgtgtgtagactatcgtgcactaaatgatgtgactatcaagaataagtatccgctgcccagaattgatgatttgtttgatcagcttaaaggtgccatcgttttctccaagatagatcttcgatcagggtatcaccagttgaggatcaaagaggaagatatacctaagacagcttttaccactaggtatggattgttcgaatgtactgttatgtcttttggacttaccaatgcccccgctttcttcataaacttgatgaataaggtgtttatggaatacctagacaagttcgtggtggtctttattgatgacattcttatctactcccgaaccaaagaagagcatgaagaacatcttcgccttgcactagagaagctacgagaacatcaactgtatgctaagtttagcaagtgtgaattttggttgtctgaagtgaagttccttggtcacgtcatctcagcaggaggagttgccgtcgatcctagtaatgtggaatccataaccaattggaaacaaccaaagacagtttcagagattcgcagtttcctaggccttgcaggatattatcggaggtttatagagaatttttccaagattgctaagcccatgacacgattgcttcaaaaggatgtgaagtacaagtggtcagaagaatgtaagcagagttttcaagagttgaagaatcgcttaatatcagctcctattttgattttacctgatccaaagaagggtttccaagtgtattgtgatgcatcccaacttgggttaggttgtgttctgatgcaagatgggaaggtggttgcatatgcatctcgtcagttacgtccgcatgagaagaactaccctactcatgatcttgagttagctgcagtaattcatgcgttgaagatttggcgccattatcttttcggtacttgtatagaggtgtataccgatcacaagagtttaaagtatatttttactcagccggatctgaacatgagacaacggagatggttggaattaattaaggattatgacatgggaattcagtatcacccgggaaaggctaatgttgtagcagatgctcttagcaggaaaggctattgcaatgctacggaaggacgacagttgccattggaattatgcaaggaatttgaaagattaaatttgggaattgtcagaagaggtttcgttgcagccttagaagcaaagcccactctaattgatcaagttagagaagcccaaattaatgatcctgatattcaagaaatcaagaagaatatgagaagagggaaagctatcggtttcttggaggatgagcaaggaactgtatggttgggtgagagaatctgcgtccccgacaacaaagatttaaaagatgcaattctgaaagaagctcatgatactttatactccattcaccctggtagtaccaaaatgtaccaggatctcgaggaaagattttggtgggcaagtatgaagcgtgaaatcgcagaatacgtagcagtatgtgatgtttgtcagcgagtcaaggcagaacatcagaaacccgccggtttgctgcagcctttgaagattcctgaatggaaatgggaggaaatcggtatggatttcatcactggtctacccagaacgtcatcaggccatgactctatttgggtggtagtcgacagacttaccaaagtggctcatttcatcccagtaaagacaacctattccggaagttggttggcggaattgtatatggcaaggattgtgtgtttgcatggcgtccctaagaaaatagtgtctgatcgaggcagtcagtttacttcaaatttttggaagaagcttcaggaagagatgggttctaagctgaactttagtactgcttatcatccgtagacagacggacaaaccgaaagggtgaatcagattttggaagatatgttgagagcttgtgctttagacttcggtggaagttgggataggaatctaccttatgcagaattttcgtacaacaacagttatcaagctagtcttcagatggctccttacgaagcactgtatggtcggaagtgccgcactccgcttttgtgggatcaaacaggagaacgtcaggttttcgggacggacatcctaagggaagcagaagagaaggtgaaaatcattcaagaaaggttgcgtgtggcccagtctcgtcataagagttatgccgacaatcgtcgtagagatctaagttttgacgaaggagattatgtgtatcttcgtgtcacgcctcttcgaggagttcatcgttttcacaccaaaggaaaattggtaccgcattttgtgggaccttataagattgtcaatagaagaggagaggttgcttatcagttggagttacctcaatctttggcaggagttcataatgtgttccatgtgtcgcaattgaaaaagtgtttaagggtacctaccgaagaagctaatcttgaacagatagaagtccaagaggatctgacctatgttcagaaaccaatccgtatcttggaaatagaagagagaagaaccagaaatcgagttatccgtttttacaaagtccaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctacaaatcctaaatatataaattgttgtttaattggaattatttttaaaaggctagaagagaaaatttaattttaattaacaaattccaatataaaatggggccagataaaatttcattaaatactttgtttaattctataattcctagatttttctgcgatttatttgagctaaggaagtatttttaataaatggaattgcatttcatgaataatttaaattgaaaaaggtttttaaaagtctcttttagctttgagccgaaagtcggcccaaaacctcctctctctttcccccggcccaagtcggcccagtccgcagccgtccgcgcgcgcgcgctcgctgtcgctgacaggtgggtcccacctgtcagtcttcgtcttcctcgcgccgccaccaccgcccgaaccctagcgccgcgccgccgccgtctccttccaagttcggccgcgccttttccttctccggtgaaatcaatagaggggaaatgatctctgggatctcctccaccttttctcttttggaatcatcggctaatttcgtttggaaatccatggattcgaggtcgattcggatcggtctctctcctccgaaccctaacctttccttcttgtcgctggtcgccgtgggccttcgccaccgcctccttgcccctataaaaggatccccaagtccgccgctacccgtcgccacccttgctttcgtctctcgccgtcgaaagcgccctagccccgtgagaccttgtgccgttgtcgtcgccgtcgctccagccgtgcttcgccgtcgttccagtcgtcgccgtcgctcggggagaccgccatcgtggtcgtcatcgcgtccccgtcctcgtccgccctttcgccgtcgctgtagaccgccggagcatcgccgtcgtcgtcaagccgaaggaccccgccgccttttcctcgacgccgccgccgtctgttcatctgatgaactactgtacatctagtcatccattnaaccact

SEQ ID NO: 6499 - DNA, 710 bp, Oryza sativa
  unsure (1)..(710): unsure at all n locations
gccgcttcctgccttgcgcctcacagtggtacagtcgttcatcacaactttgaagtagctatcaccagttatgatgggctagttgtaactgttcatgcattgtattctgagcctttaaggtcaagactgaacctaataactttggaagagattcctatagtcccggagtattcccatgtgttcccagacgatttacctggtatgccgcctaaaagggatatccagctcacaatagatttggtaccaggaacgactccgatccattagagaccttatcgaatggcagccaatgagttggcagaaaccaagaggccagtagaccatttgcttcacaaaggatacctcagaccgagttcatctccatggggagctccggatatttttgtggaaaagaaagatcatacccagaggatgtgtgcagactattgggcactagatgatgggactatcaagataagtctgcgctttccagaatcgatgaccttgttgaccacgttaacgagccataggtttctccaagatagatcttcgatcagggtctcaccagttgaggatccaagaagaagatatacctaagacagcgtttacactatgtattgagtgatcgatgtgctgaatgccctttagacttaccaattgccccgcgttcttcatataccagctgaataaggtgccatggattacctagacangtttgtgcggttcttaat

SEQ ID NO: 6500 - DNA, 755 bp, Oryza sativa
  unsure (1)..(755): unsure at all n locations
nacaaggccacggccaccacaccagccaccacaccaaagagaatgttgccacgctgcttggagcgctcatattctggatccccagcaatgtcaatatccagcggcgtgtccaggctgtggcccaggagggtctccagcagcgtgcggttggccagagtctcattgacataaagatggaccaaggctgtgccatagcgtgggggcttgccgcggtcactgaccttcaccaccaggcggtgtagcccatggtggcgccgctcaatctccttctccagggtgatggcacctgaatgtgacccaatctggaagagtccataagggttgccacctgcaatgctgtagatcagctcggcattgacaccagagtcaaagtcctcggctgccacctggctgaccgtctcaccaagacgtgtctggggggtcagcagcttgtgagaggtgttagaaggggcagtgatatagggtgcgttgtcattctcgtccagcacattgatggtgacaccaacgtaagctgagcgaggtgggacgccaccatccactgccttcagctggaaggtgtaggtgctttgttgctctcgatcaaagctcaggctggataggatggtgcctgtgccattctggataacaaagtcaccgttgtcctgctccactgagagctgcacctgggcattctcccccttgtctccatcaatgacagtcaccatgcccactggactcagtgctggcatgttctgataactgctctcaancccact

SEQ ID NO: 6501 - DNA, 771 bp, Oryza sativa
  unsure (1)..(771): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaaaaaaaaaaaaaaaaaaaaaaaaaaaaaaaaaaaaataaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaaaaaaaaaaaataaaaaaaaaaacaaaaataaaaaaaaaaaaaaaaataaaaaaagaaaaaaacaactaacacccacaaaaccccaacccccccacccacaacaagcacacaccccaccacaccaaccacaaaaccacacaactccacaccacaccccaccaaaccacacaccccacaacaccaaccaccacacacccaacccacacaaaccaaccccccaaacaaccccaaaaccatcacccacccacacccacccacacccccccccagcacataaccacca

SEQ ID NO: 6502 - DNA, 784 bp, Oryza sativa
  unsure (1)..(784): unsure at all n locations
ntagcctctggatgattgatctaagggtgcagactacacagagcaataaagcgagtcttctagctacaaactataaatccaccttgcatctcatgtctatcgtttcgtcatgcacgtttctggcagcaatgttgtatattacaatctcaaccatttggataatcaaagattaatgttcattgaagcaacttgaaggcaaaaagatctgcttcgcttaattactcaatagatgtgcaaggcttatagaaatgcgcaaacagccactatatgaaccacttccaattgaataacaaattgtgatttgtgctgctgtcaacggcttccgtgatcgaatgccactagtcaatttctcaatatgaaattcgtaatagaaaccaatttatgcaacaaacaagttgctcattttgactgtggctgacattttcatatatggggattactctattagcaatttgacgatgctaagatgtgtagctgtctagctgactgcattataattttcatgttcagaaagtgctcttccttgaaactcctgagggaatttcttctgcattgaggccattctgggaaaaggcaatagaaggaagggcccgtgtggttcaagcacagcctgatatgcttgaacttgtacctcctgcaacttcaaaaggcaatggggtgaagattcttttggaccacctttgcattagtccggatgaggtatgggcannnnnnnnnnnnnnnnnnnnnnnnnnnnnnnnnnnnnnnnnnnnnnnnnnnnnnnnnnnnnnnnnnnnnnnnnnnt

SEQ ID NO: 6503 - DNA, 916 bp, Oryza sativa
  unsure (1)..(916): unsure at all n locations
cttcctctccaggcatgttttcaagaaagctgctccacaagccggccagaatatgtaaaaacaanatttatatttcctcctcccgcacccctttttctcctcgtggtgtactctatcgtgnaagatatttttcttcttgtactttcagaaggagggaggtaaatcttaaggtgctcaaggtgccggaaatcgaccagaaggtcaaaatttctttcgatttccccgtcaagagtcaaaatttggaattttgggtggtcagatggtttgctatttacctggattttgtgattggcgattgaagttttttccccgatctcgtatgcaggttcttgatgccaccagcgacgagccgtgggggccgcatggttccgatttggcagatatcgccagggccaccaagagctagtgagtagctcaaagctaaaaaaaaaaatcagaacttatttcccatttgtttatgagaatctagcgtgtttcagtttacgacttgggggcgttgcacattttgattgttcgcataatcccattgctttcttgtttcttttccagcggtgatagcgaaattataatgaatgtgttatggcaacgcctggggaacacacttgcgaattggcgtcacgtgtataaggtaataagataggattgattgtgcagtgatgtgctgtttggattgattccttaataacaggatgttttttttccaaaatcaattttaaccaaggggcccgggttttttggggggggaccccttttttgggggttttcgggggatcgagaccttctagcaatggcaccgaacgtgcagctgatggcattggtgacaatagctcacnaattgcnnnnnngnnncnccgctnnnnnnnnnnnncctctgntnncctgggcaattatagnnnnnnnnnnnnnatgctnnnna

SEQ ID NO: 6504 - DNA, 773 bp, Oryza sativa
  unsure (1)..(773): unsure at all n locations
naaatncaacaagatggcatgtctaaaagacnagcattcaaataaaggattttttttccttacaataggaacatcaagatcaggaatgtattgtgacattgagagcatttcaatacagctgtcttcacctctccattctttgttaaggttctggatgaagttgtcattgcatagcaacacagaaacttcaaccttatcatacctcccgacatcacttattgaagtgtctcgtgttttgtagttggaatccagaagcccatctagtgcaattttcatcgccatcggaacatttaattttagaatttctacaatgttctgcattcacattaccagaagcataagtaaacaaaaaacgtcacaaattgaaaatgcaacatttctagcacaccattttattggcaaaatatgcaacagattgctcggagggatataaactactaaaccaaaatcaaccaaggaattccactataacttgatgaataaaatcaaacaacaaaacgacataatccgatacccaaatgcctaagcctaaaccaatttcaaaactgcatcacgtcataataaaatacctgctaacttaggttctgactacctttcttcctttgaaacgaagatttctgactacattgcccacttgtttacctctagatcaaagaaagtgtatgctcagctgcctgaagggtgcaattcgttttnnnnnnnnnnnnnnnnnnnnnnnnnnnnnnnnnnnnnnnnnnnnnnnnnnnnnnnnnnnnnnnnnnnagagatcatcg

SEQ ID NO: 6505 - DNA, 779 bp, Oryza sativa
ctggtttattggatgatatatgctcaatcgttgttgtactatttctaatcaatgtagaaagtcctgacttttactcttgtgatttctgctccagtccttgtatgctaatttatggttagcatatcgtaactgttgtcccgaattggttgtgtttgccattcgctaaaacgaattgcacccttcaggcagctgagcatacactttctttgatctagaggtaaacaagtgggcaatgtagtcagaaatcttcgtttcaaaggaagaaaggtagtcagaacctaagttagcaggtattttattatgacgtgatgcagttttgaaattggtttaggcttaggcatttgggtatcggattatgtcgttttgttgtttgattttattcatcaagttatagtggaattccttggttgattttggtttagtagtttatatccctccgagcaatctgttgcatattttgccaataaaatggtgtgctagaaatgttgcattttcaatttgtgacgttttttgtttacttatgcttctggtaatgtgaatgcagaacattgtagaaattctaaaattaaatgttccgatggcgatgaaaattgcactagatgggcttctggattccaactacaaaacacgagacacttcaataagtgatgtcgggaggtatgataaggttgaagtttctgtgttgctatgcaatgacaacttcatccagaaccttaacaaagaatggagagctgcggacagctgatttgaatgcttctaatgtacaatacattcctggg

SEQ ID NO: 6506 - DNA, 781 bp, Oryza sativa
  unsure (1)..(781): unsure at all n locations
nccgagaatatttaaaccgctccccacgggccacctcgtcggtttcgtcaggtaagaganaaccgtttctttttttggcgaatcgcattcgcgcactaccaaacacaacgcgagctcggaaagctactgatggcgtctcacatcattctcccaaagaagaagaagncggcgctgggcgtgccgttgaagaagacccacgactcgcgggcggcgccagggtaccagcatcagcaggggccgccggtggcgaaggcgctgccattctcggccacgtgcgtgcggatctcccgcgactcgtacccaaacctccgcgccctccggaacgcctccgccatgagcctccccgacgacgacgccgcttacgccaagctcgaggagggcgactacggctacctcctcgatgacgtcccgcacttcacggactacctctccgatctccccgtgagcgccgacacccctcctcttcccactcatccttgtctcgcgctggttgttccgctgccagattcgacgcctgcggtgaaaaaaattgcagtatgcagtgctgcttgagattttgatggttcttttggagacgcggatctcgtgaaagctttagatttagttctgccatttgtgtgaggtggagctttatttggatggttcctttatttttggtgtttttggcgtgtcatgccggggatgggttctggaatgagannnnnnnnnnnnnnnnnnnnnnnnnnnnnnnnnnnnnnnnnnnnnnnnnnnnnnnnnnnnnnnnnnnggcagttcatcctcg

SEQ ID NO: 6507 - DNA, 1686 bp, Oryza sativa
  unsure (1)..(1686): unsure at all n locations
acggatgaatggctcannnnnnnnnnnnnnnnnnnnnnnnnnnnnnnnnnnnnnnnnnnnnnnnnnnnnnnnnnnnnnnnnnnnnncttgagaaaaccctttctggttcaggagcttgggcccattctcccagtagtagtaggaggagggggtccatggagtccacggccatgcgctcttgcagcaagcgaaagcgagggtagcgcgccggttaccgaggcgggagtgacagggacaggtcgcatcggtaagctcagtccgcccgcaaaaacacacacggcgtgggcccgtcccgcagcggcaaaggcagcgtcccttggtttggcgcgctttttggcgttttgggaagcggaggcgttatttaaagcccacctcaggttgtactgtttctccacatatcagacggttcacaaatgatcagatcggactggtggtgggtgctcgtcactgatggtcttatgaacactactccttccattaaaaaaataaaaaactatactaaaattatgtcacgtcccagtcctaggttaatttttttggacgaatagagtataatatatcttaatacaataaatctgaatataagtctatttaattttattatactaaatatataaatatatagccaaaatccattgtatagtcataacaagatctattataggtagatatatgtaagtactacgtaaaaaaggcaattatacgtatacatgtaaaaaaatgaatattaaaatggttgtttcggttctgattatcaatttaacctagaattacaaaaccaaaaaacaacatcttcatttaagtcttggatatatgaagactacaaatatatcattctcttttaaaaagctagaaaataacatatgcttaagaattttttatggagagacttaggtcatgttcttttctcaaaaaaaaatgaagattttaccttggtttcaaactaataaacaacgtgttttatgcgaaaactttctatatgaaagttgtttgaaaatatcaaatatatctttttttcaagtttgtaataattaaaacttaattaatcatgcgcttatagctatcttgttttgttcaaacgcatttttaatataagagatcgtcatatcttcatgtatacttagtgcttcttaagtagtgtttagtcatttaattatatccagactatttgtatttagtgaattcattattagatagtctctccgtcctaacttaagtgcatccaagactcgtagttctaagatatatcacattatattctggatgcactaatactgtgatggagatagtagtgtttattattatatttatacatggtaaacttgtaaaattgaaattgtgaagttggtaaatatatattaatgagtttaacgagccaactctcgagccaagctgagctaggcttttagcctgttaaggttaatgagccgaggcgagctggctcgttatccactcctacatggcacattgtcctagttcatagttactcgtcaatctacgacggaggaaagcgagcaggccgccgccgccaaagagcaaggcgctaacagtggcaaaatcgagtactcgatgagtgggccacgggcacaagatcgaccatggtggcagatggagatagaggaaannnnnnnnnnnnnnnnnnnnnnnnnnnnnnnnnnngataactgcacttgcaaatcaaggcca

SEQ ID NO: 6508 - DNA, 6788 bp, Oryza sativa
  unsure (1)..(6788): unsure at all n locations
ggggatgtttgattgctcgctcgttnnnnnnnnnnnnnnnnnnnnnnnnnnnnnnnnnnnnnnnnnnnnnnnnnnnnnnnnnnnnnncagctgccgctcaagactacttttgctagaagctgaacagaacattgttcatgccgatcaagaagctcagcatcaggaagaggaagagcttcacatggtggatgatgcaacaatgaccctcgagcctatggatgaggaggataatggtttcaacaatgtcatctgcccatgtccttcactggagttggaggaacacagtcactcagctacaccagccatcgatgagtgtgatacagccactcctgctccaggctctgcaatcccacagcaaagcactagtgttgatcaagatggacatctggaaaatcctaacgaaatgggccagattgaactaatggtggaacctatgtatgtggatcacaatgattccaacaatgtgctctcatccagcacgtcagctcaggcgctgttggagaattgtgaagtagcagaggcagtcaatgaaaatgtcgatccagccacccaagttactggctcatctaccccagaacagggcacggatgtcatagtagatgctgaacaagaaaacccagccacaacagagggcaactaacttcaatgccgtcccctcgtctgcaaaggtgacaggcgattctgatttctccccttatggaccaattcgtgccacctatgtatagtgcttagatgccgttgtccgaaggttcagcatattgctgacatattgccctggttgtttgaccatgatgggctccactggaaattttagccgtaattactgatgtagcttacatatctcttgctttccaaagtcattacacttatcattatcaacatttttggtttttttttgtttttgaacatgcattcgattttcaattggaacttaacgctgccaatgcatatactatgttcttatacaaagaacaagaaaaagaaaaggttggaggtaggtaatggcgtaactagttgggccacgcacggcgaaactagtatatgatgccaatgccatgatggtcaatattgctttcatattaaagttttttttacattttgagttgattttttaaaagtcaagatgaaaggggagaccacagttgaaagtttcatatgatttgagttggaagttttatgatttaagttgaaattttcatattaaataagtgctatgaaagggaaaagaagtgtggctgtgtgctaggcgaggcgctagcaatctcgtgggggaagcgaagagaggcccaaaccgctggttgcctgcttggcccatgggtttgagaagaccatgggctcgagcggcccaagaccatggacttgaggaaggagtcgtagtcgtcgtatcttgatgacacgtgcgaccggcccgcgcgctcgtcgttattccgcggcgccatcttcctctctcctccgccctacgcgtcgccccgcctcgcctggccttccccgcgcatcctgcacggagccctaggaggctaggagaggaagaagaacacgcgcgcggggggatagtggatagccgaagcaactcgatcgatctgtggccgcgatcgtagctctcttcttggtccgatctcgtctctcccggcatggatttcaggaaggtgctcgaccagaccgtccgggagatgtaagaatcagaatttttatttctccttctccgccccttttctcctcctggtgtactcctatcttgtaaagatatttttcttcttgtactttcagaaggagggaggtaaatcttaaggtgctcaaggtgccggaaatcgagcagaaggtcaaaatttctttcgattttgccgtcaagagtcaaaatttggaattttgggtggtcagatggtttgctatttacctggattttgtgattggcgattgaagttttttccccgatctcgtatgcaggttcttgatgccaccagcgacgagccgtgggggccgcatggttccgatttggcagatatcgccagggccaccaagagctagtgagtagctcaaagctaaaaaaaaaaatcagaacttatttcccatttgtttatgagaatctagcgtgtttcagtttacgacttgggggcgttgcacattttgattgttcgcataatcccattgctttcttgtttcttttccagcggtgatagcgaaattataatgaatgtgttatggcaacgcctggggaacacacttgcgaattggcgtcacgtgtataaggtaataagataggattgattgtgcagtgatgtgctgtttggattgattccttaataacaggatgtttcaatcattacaggcgttggctgtgatcgagtaccttctagctaatggcaccgaacgtgcagctgatggcattgttgacaatagctcacgaattgcagtatgggtccttcgctagtttttctagacattgatatttcattgtttatagtacttgtcgtctgatgctgatttcttttgggaagaaactcacaagatttgagtatttggagcctaatggaaaagatgttgggctcaatgtgcgtaagaaggctgaagctgttctagcaattttggatgacagggagaagcttcaagaggtcagagagaaggctgccgttactagagacaagtaagacattctgtagcccattagcgacattattgcatttcttgtacatttgatgcttacttcttttcatgaaccattggtctaggtattttggcttatcatcaactggaataacgcacaaatcgagcgcagcatcatttggcagtggcagctactcatctggtagccactatgggagcacaggaggttcaagggaggtgggatcattcaaggatatacacacaggcacagaatggaaaaagaacaagaaggaaacagtgtcaaactacagcagcaatagagaagggtctaaagaaattactaacagtgcaaccagttataagtcaaaaaagagtgaaaggcatggtagaaggtacctcccagttctactccgtctttttcaggttttaccatcaacaatagatagtagtggtgccttgaaattatcaagttattgagcaatgactttggaatccaatcttaagttactaaatctgatacttttactgtgtgcatgaaagaaatcaaaattccttaacattacactcgaagttatctgcaaatattagcaccacatctgaagccccaagctcaaagaaaggggaaaatgaggatgatgatgatttcaacccacgaggattttctacatctagtaagtatttatctgcagtatcttaaatattcatttgcatttatgattacaatggtttacctttttgttgcacacgtaaagttctaaggatttattcttgtttgaccatagtcatcatgttgccatctggaaattcacttggctgtatgtttggaactcagctggaacaggtaccacaagatctaatcacctggatctctttggtccaagcttgatggatgatcttgttgattctactacatccacttcaacagcaacgccaaatgttagcacacctgctgtgccagaggttgatttatttgcagatgcagctttccaatcagccaatgctccattggaggcagcaacggtttctcacactcaggtttatactttactaatagccttttttttaccatgattcatttttcatatccctaaatgtctgtgagaactacttactcaaatatgttaccaagaaagtggaaaaataccccccttaagattcataatttgcatgaactatattgttgaaacttgaaacttcattcattatatgtttccgtccatgtattttcaaataaaatacttggggaattcgaaatacatgagttcattattctacaactcattatttattttcaaatttcaatgtaggacaaaattgatttgtttgctggcagactgtcttctgctgattcatttacttcagacacagagttctcagtacgcggtagtcctaacaagtcatcggagaaaaaaatgtcttccgttgtgcatccttctacttctgcttttgatcccttcaaacaatcttttgccacctcatttccttcagattcagagttctcagttcatgatccgacaagcaaatcttctcaaggaaaaactcccacaccagaacattcaagtacagcagcttttgatccttttgctgcaattccactgaagagttttgatggatccgaatcttttggaacattttcttcgaacacagcctcaaacattactgaactgccacgggattcttctgggggtcccaaaagttctgaccatggtcctttggaggatgccaattttgatgccttcacttcacacttgggatcttccacaacaagtgcaactgagtccatgaataagcccatcaaaaagcttgggcaggactcgatgtcagcatcaaaatcagttgcaaagaaagaaacttttcaggtcaaatctggcatatgggctgactctttgagccgaggattgattgatttgaatataacttcgtgtaagtatttttgcactttttcctgtcatgcatgtagttcaagttcggtagatgcaaagtagcaaacataaattgtaatatgtatgtccgaatttgcaaggttcaattcattttagataatggatagaaattcggcctctataaaagtaaaagattcctagtgaactgtatattagattattagtatccttacaataaaacacaagcataagaataggaagggtcatcaagcacaactcaaaaggctaattatcctaggtgctaaaaaggaagacgcatcatagctcatactgtattgttgtaatatgcagcacaaaagaaggtcgatctctccgatgttgggattgtcggaccgctgagcggcggatctgaggataaaggcccgggggcgacgatgggcacagcaccaggccttgtcagttctagttttccatctaaaacagaaacatccagtggaagcggtcattttcagcaccaacagtttggaagctttaagtgatttttatccaggatatgtcttttgttctatggttcttgcagagtacttcttggagcattcgtacagctccatgcctataagagtaaacgtgtatatagctaccaaactctgtgcgatgatcaggagacgtgttgccaactaaccagcatcttctctgcccttgaggcattaatatttttttacttatggcgaaatggatatgttttgtgtacatgagtaaagaaccaatgccatggtagcaattgtaaaaagggttcatcaattatgtgtgatacacgctcatatgaattttgaaaaatgaataacgcaaagcattctggatgctggcagtggcaaatgttttttttagcgaaacagtacttggtgtgcccttttcattgatacagcgggaaaaaaaaactgtaccaaagccaaaactttacagaaagaaaaatactagggatgatctgtgtttggctactgccaagacccaagatttgcccgccttcctaattttcgccgctagggaccgtgctaagagttctttatgttgaaacactctgtgaaagagcatgtagcctagtggttgcagtgacttaagtagcatccgaaggttctgagttcaaatcgttcttaacttaaaaaaaaaaaaaaggcaccccaaggtcctgagttcaaatctccgtaactaagttcctatttttttaaaaaaaaactgaatatatctggttggatatagaagtcgggtaaaaaaacttttaaaaaaaatgttgaaacactctgattcctttctttccatatctcctaagcaacacggacggtggagactcttttcttagtcatctctaaggtactggccaacgttgtcatatctttctttccatatctcctaagcaacacggtggagactcttttcctagtcatctttgaggtactagccaacattgtccaccaagtatggatcaaatatttccatatctcctaagcaacacggaggagactcttttcctaggcatctctgaggtactagctaacgttgtccaccaagtatggatcaaagtaacggagttccaacttattggcttgataagtgttggtttctcgcccttcatggcgtggccctggctctctctctctctctctttcttttttttttgggggaaggggggatagcattggcccccccccttttttggggttttggaaaaaaaggggttttaatatgttttagctgtttaatgtaagatatatttgaacaatatgccactgtaattgatcagacaatacttggtcgattggtcctaacacaaattttatttcgattagtgtcaaatgaattgtcaaatcaatccaaccatccttaacataataggattgcatcaaatcatagaaaatcaattgtgctcaatgcatgtctcaacctagtcaaagtttgattccccaatcccaaccatcttaacatcaaagaattgcatcgtattagagtaaatcaaatcaaatcaatcatgccctattctcataacatagtgggggtcgaagtttcccccaacacccaaccatccttaacatgtactcgtagtaaatcaatcttgtggggtcggagttcaattccctgaacccccaacccatcgtcaaataccataggcaattgcaaatttactacaaatagttattacaaaactgccactagaaaattatannnnnnnnnnnnnnnnnnnnnnnnnnnnnnnnnnnnnnnnnnnnnnnnnnnnnnnnnnnnncaggcgtaactcactaaacatgggca

SEQ ID NO: 6509 - DNA, 1700 bp, Oryza sativa
  unsure (1)..(1700): unsure at all n locations
ccggcattgattgcatgccnnnnnnnnnnnnnnnnnnnnnnnnnnnnnnnnnnnnnnnnnnnnnnnnnnnnnnnnnnnnnnnnnnnaccttgtttgtaaacaagatggagcgtcctttagcaatctctattattgtcgatgtttgatgtcacgattctggtatttgtatagtatggggatcgttggtaccaggatatatacgagacttaggtaaaagagacagagacgataatttttatacatgttcgggcccctgaattgtcaggtaataaccctacatcctgttgaccgaagccggtcgttgctcttattcaccataatcacaccagtacaatatttggggtagcctatctatctgttgtcgacatagtggtttgaaatatcgtcacttagtcgacaacagggtagtcttcctcctcgaatccgtgcccgacgagattaaagacagcgctagatccctacagctggcctctgtaggtaccggatagggtcagtccaggcatatctctgatgtcgatatccggcggcgtgtcttggtgtatgttggcttgtatgttgtggcttttgttgttctgtgtatgttgattgtgtctcctctcctcctagggggccttgtatttatacccataggtgtccccttgtccaagtagaactagggaaaccaatatgaatagtagtccttgtcgtttccatgtagaactctatttatcattccttatgcggaactcttcctatatccgaaagttgtttccgtataagatatggtatgtggtgggtactaccgagatttagttaactactgttaggtatgtggtatccataaccctgaaaattataaaatgttaatgaatcctaaagcaagctaaccaaatggaacctttggcacacataactttcaaaagtttactcggagctgacctttaaactgagttctttcgtacttgtatacagatcgcacccttctaatctaatactaactaatttcatgtaatcatgttagggtttgggttagggttggggcgatgcccaggcgactgggtgacagcttccttcctccctccttggcgatggagtttgatggagactttctccgatgtgcttatggagtctgcaggttttacgcctgcttttggcaagatccttgccggatgggattatggtggatcatctagccctacaataggctttcgatgctgccgggtatctcaaatgaaatttccaagacctgaagttgttggtattcggcctagagcccatgctccctgtggcaaattccatagcgtaccagacatactttggatgggttcacatcgtctgccgttttggctgacggcaaacattgccgttgccttcatccctgccacacatccttctgtcaacagctgcatatagtgatcccaccatttgtgattaattagggattactaatcaacagaatcacttatttctcttcccaaaaaatcagcaaatagaatctcagcggcaaagcgcgcgggaacaaaagcagagcagagggaaagctcctgctttttggcgccaagaatatggatcgacaccaaatgtctattcacccaggaacagcagaaccagaacaacaaaatcttttatcagatggannnnnnnnnnnnnnnnnnnnnnnnnnnnnnnnnnnnnnnnnnnnnnnnnnnnnnnnntagcaagcgtgtcatcaaggggggcat

SEQ ID NO: 6510 - DNA, 15773 bp, Oryza sativa
  unsure (1)..(15773): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccaaatgtctattcacccaggaacagcagaaccagaacaacaaaatcttttatcagatggatgtgagttgtattatgaaggatttcagcagtagcttcatttcgctgctagtttttggatgaaaaatactctatctgggacatagtagtagtgcagcaatgctatttttgtcaaataaatacttaaatattttataagacatatactattgttcaggtatttgaatagcttcttagtataacagaagcttgctttgctgtagtattttgctctgctctgctctgcttctgtcagttgatccatttcttggcgccaaaaagcatgagctttccctctgctctatttttgttctcgcgcgctttgcccctgagattctatttgctgattttctttgaaagagaaataagtgattctgctgattagtagtccctaattaatcacaaatggtgggaccactgcatgcatccgttgataaaaagatgtgtggcagggatgaatgtaacggcaatgtttgccgtcagccaaaacggcagacgatgtgaacccacttcggatcggttagcgtctggttttctggagatctgatctacagaagtttccttggaatgtttacgggggagaaaaggactcggttgaaaaaaatcctttataaggatcgatttgctaaggttttgatagcgttgcagaagatccaatccaaggagagggagatgcccgagttagcctacattgtcagagaggttgcagacttgctttctggaaaaagggagattttgctttggaaaattcattgtagccaaaatcttgttagtcatacgctagccattaagggccgctgtgagtccctttctagattttgtttagaaaatgattattcttttatttctcatcttgtaagcgaggactattatcctgagtaatatattccttttcctcgcaaaaaagaaaaactaatttccaggtttagatactattcaaagaaatgttcttctccgaatcataaatatttgatttttagtactatatctgaacaaacttttgaaactttaacaatcagtaattttttaaatatatagtttaaaacaaaaaagctatatgagtaaatcgcattggcggtacacgaacttatcaggtatgtgtaatctagtgcactaacttataaaacaattatttgagtaaagtgcattagcggtccttagacttgtagggttgtgtcatataggtccctaaactctcaaaatacatatcaggtcctaaaacttgtcaaagtgtatcatttaggtcccaaatcgatacatcccctctagaatcctacgtggtgctgatgtggcataccacatggacgtgacgtgtcctttttattttttttcttcttttatttttctttttcgttttcttctcattcttctttttttttcctttcttttgctcgggtcacagagaaaggagacgaaagggaaaaagaaaaagaaaaaaaatttaaatgggtcctatttgtcagtcaaaatgatgccacggcatgtccatgtggtatgccacatcaacgccacatagaatgctgaaggggttgtggcgatttgggacctatatgacacactatgacaagttctaggacttggatatgcattttgagagtttagggacctagatgacacacccctacaagtttaaggaccgcccgtatactttactccgattattttgttgtacgatcttacctagggtgcacgaaccaagattagaaggacattattacatggctaatcttatagattttataggtgttgattaggatactatgcaaatatatactcactctgtctcataataaaaaggattttggtggatgtgacatatcttagtacaataaaactggacagatagtctgttcagatttattatatcacatctatccaaaatcccttatattatgggacaaagggagtatctaaaaagtttgccttttaggtcctgttcgtttcttctaccatcataggattaaattttggatacttgtggcgcgcttttcaaactgctaaatggtacatttcgtgcgaaaattttctatatgaaagttgctctaaaatatcagattaatccattttccaagtttgtaataattaaaactcaattaatcacacgttattaccacctcgttatatgtgaaacacttaatctttatctttatcttcatcttcatcttctggagatttaaacaccaccttagacatgcatatattcagtaaaaagacaaaatgaggcgtagtgattatatagaactagacaaagatatgaaaaaccgagctatgatacatgggttagaaacatatgaaattcatagtttcaacgatgaaggaaagtagagatgtttataattatagcttgtcttatgcatactcactgtatgtgtgtacgtcacatcctaattaacatcaacttgataaaattaacattaccaagccattttggtccttgttcacacgaattagacaatttcgtgtatcaaagcgagcgttctataagttaggttaatgtactaaattacattcacataacaaggttatgtatcaccactacaatttactcaaactatatcataataccatcaactcatttttataaacctgtcttactataaaatcagtgcccaaagtatcaaaatttgaccataatttatcctaaatgtaaaaaatatctacgatcgattggagaatacatataccatggcaaaaggttcgagattcagatagacaaagaggcaattgcaaatttaccactattttgaatcgttattgcaaaactgtcattagaaaattacaaaaataccactagaactattattcgagtggcatccttacaatattgaaaaaaccagtagcaaatttgcaaatgcccccttagacaaaagatactcaacatattccagggaatatacgctgaagctcgaaatcccgttaaggttttgaaccaaacactccatcctacagaaacgaaatttgcatgctcatgcggagcaaacaaataatgcatgattttttgcgtaagcctccaaaactcgtactgcagttctccaaataaatgggcaactcactgatcactactgacgatataaaagagcccgaaaatctgcgaatcggagaagagatcccgcacggacacggtgggccggagcaaaacacagaccgttggatacgaaatggacggcccgaacgagacccaggatataatacgcagcgcagaagaaaatcaaacggaccaacacgaaaaccctcctcctccgcccaaccccattccttctcacccactctcttctcccgccgccgccgccggaggaggcggctcctcgtcgtcggcctcgacgaccatggcacggatcgtgtcgcgcgccctcccgttcgcctcgcgctcgccgcagctcggcgcggcgctgatacgctcggcgccgatgcgctgcccgcccctccccgccgcggcgcccaccgcctcgctgctctcctggcgcgggttcacgccctcctcagagccctcgcgctcggcgccgccgccaccgccgctgccgatgccgcccttcgcggggttcctcgccggcatccgaagcttccgcaggggtaggcgcggccagtcggcggcgaggcgtgcgcagccccaggaccccatcccttcaccccctcccgcgccgaaggagagcgagatcgagctctacgcgcgaatcggcatcgacgatgacacgcccgaagaccccgaagtgctggtacgtacgctactcgtggaacttctgtgccaataatatgtggctgttttagatgaagtcaccggaatcacagattgaaatgttcacaagctatagcgcggcattctctggtttactggatgatttatgctcaatcgttgttgtactatttctaatcaatgtagaaagtcctgacttttactcttgtgatttctgctccagtccttgtatgctaatttatggttagcatatcgtaactgttgtcccgaattggttgtgtttgccattcgctaaaacgaattgcacccttcaggcagctgagcatacactttctttgatctagaggtaaacaagtgggcaatgtagtcagaaatcttcgtttcaaaggaagaaaggtagtcagaacctaagttagcaggtattttattatgacgtgatgcagttttgaaattggtttaggcttaggcatttgggtatcggattatgtcgttttgttgtttgattttattcatcaagttatagtggaattccttggttgattttggtttagtagtttatatccctccgagcaatctgttgcatattttgccaataaaatggtgtgctagaaatgttgcattttcaatttgtgacgttttttgtttacttatgcttctggtaatgtgaatgcagaacattgtagaaattctaaaattaaatgttccgatggcgatgaaaattgcactagatgggcttctggattccaactacaaaacacgagacacttcaataagtgatgtcgggaggtatgataaggttgaagtttctgtgttgctatgcaatgacaacttcatccagaaccttaacaaagaatggagaggtgaagacagctgtattgaaatgctctcaatgtcacaatacattcctgatcttgatgttcctattgtaaggaaaaaaaatcctttatttgaatgctgttcttttagacatgccatcttgttgtattttctgaatttattttctcgcagctaatgttaggtgatattgtaatctcagttgagacagctgcaaggcaggctgaggagcgaggtcatacacttcttgatgaagtgcggatactagcggtatgctcacttgcttattgactgtcattagccccctaccgtttagaggtttgaatacacatgttatctttttcttggtgaatatccaacttccttttaccaaatcacttaatcctatgttattctacacatactaaaacacagataatatggtacaaaattgactgtttacttactctgtattaggttcgtggaattctacgtcttctgggttttgatcaccaaacaagtcatgagtctgcagttgaaatggagaaggaggagcagctcattttgaagagtctaaggtggaaagggaaaaatcttgctaagagtgttcttgattcgggcaagcgtcatacagaaacatcggatggtgtgcttttttgagatttctgtagttataatcctttccattattttgatcttgaaaaggtgctttcacacacatgatgataatgtagctattgctgcctaagaatgtttacagggcaagtgacaagtggtctaaaaagagctggaagcctaagattttatagaccaaaattcaaatatatcttctgtgatatggatggtatatcatttgctctttgcatatatcactactctagacatgtgtttatatttaccagtgatattttttaatttaaaaaggtacactgctcaacagtaaaagtcaagttacagcaaggaatgcagaagctctgagggaagcaaggtcaaggggagtaaacatagttattgccacagggaaggtactacaagttcttcatttctgtaataacttaactgtcccttgccagcccaggccagatcttctggatcaccctgtttccaccattgctgcatccttttccaagccaagccagattcaagtctcaattataaaacttgcattacgctaatcttggtagaatatgttaataaaaatcctctatgaggacacttgatgtttattgttttcattttatgagctgaaaggaaaaaattactacaagtagacaatcaagaataccctctgttctgccagcctatttacgtttggccctgtcatatttcagtaactcaaaatgctgataattgtttctcatacatgttcattttggaaataggcacggccggctgtcattgatgctctcaatatggttgacttgtctggaagaactggaattgtctcagaatcatctcctggcatatttcttcaggttggtggaaagtattcatggacaacacaatatttcaagaaataactttaggatacagtggtgaaaatgcggcatctttacacttcctggtagcatataatctaataggttgcaaatatgctaatggagatccttgtatcatatttttgactgaagagtgcatgccacttgcattgtgacctttatggcaccgtacttaaatctgtgtaaaatgaacaaaattattgaatgttttttcttttactcttaatttacgcccttttttcttgaattgagttaaagcgtgaaatttggttaagtgacagggcaatcattcttacccccctgcattttaatatctgttgaatgcatgttgcttgcaatacatccttttggtgccctaaataaacttttgatgaaatgaaatatagttgaaggtttatttccttttgcattttaattctttgcctttttcttgtatttgttgagtgaagtgcaaatgttagtcatgagataagtcaattattcttacctccctggtttcaaaagctggctatactgtgttcatagaacagaaaggccgctgctgatgttgcctgtgcagccttgctaattcgaagcttacattctacattttatggaaaagaacaaaaaaaagcatgacagcatcctttgatcaggccctagtggtctgtgcttctgctcagtcctataatgtgctaccctaagtcaatgttaccttgtattcagtatattaatatgcgctatgcctttattttccgagctcagtcaatattaccttgtaacatcctttgatcaggccctggtggtctgtgcttctgctcagtcctataatgtgctaccctaagtcaatgttaccttgtattctgtaatattaatatgtgctatgcctttattttccgagctcactgtttcaagactaccgcgttgttcctatccagtagataagtgaaacagtttattgttcatgtgtgcatgattcccattctcatcagattgatgctttcatctgtagggcctcttggtttatggtttgcaaggaagagaaatttataaaaggaatttagatcaagaagtatgcagagaggtaagctacatttttcttccttataggcattgagaccataaatgtgcatacaagaataatttagatccaaaaggctacactttcagggtttgcctacttaatgatatatcacctgggatgtatctctccagctaatggactaatttagatgccctcttatgtccatttaatatatagatgttagctggacaatgtagagtctatctttctactccatccgttccaacatataagaatttctgcgtgttttccaaaatgaatctggtgggagggatgcccggatacattttgaaaaactcgcagaaatgcttatattttggaatggaggtagtaatagataattttattatcttagtatccatcattaccaatttaagttagcgcttgcactgtgtagtgacactattggcttattgcaggcattgttatattctttggagcagaaggtaccattagtagcatttagccaggaccgatgcttctctatgtatgatgatcctttggttgattctctccattatgtgtatcatgaacctaaggtgtttgctggtccttggtcaagtaaattttagctgtcatattcctattaatttgactgtagttgtgactcttgttgcaggctgaaatagtctcgtctattgatcagcttttaggaacagctgagatacaggttctgtgctctcttaacaatttttagaacactttcatgattagttcagcatgaatcattttaatgttcctttgcttaaatactaagagcatccgtctagatgacattctggttggtgattcattttctcaaaatttgttccaagtggttggttcataaaataagaaactactggtttagttactataaaaatacgggctttcttttggacagggtgggggagggggtgtcctagtcctaccatgtattttacttaaccataaaataaattaggttaatatatcttatacaattggaaccctttaaatgcagttattactcttctcataaaaccacatcgtctcgattgtttctagcctttggatgattgatctaaggtgcagactacacagagcaataaagcgagtcttctagctacaaactataaatccaccttgcatctcatgtctatcgtttcgtcatgcacgtttctggcagcaatgttgtatattacaatctcaaccatttggataatcaaagattaatgttcattgaagcaacttgaaggcaaaaagatctgcttcgcttaattactcaatagatgtgcaaggcttatagaaatgcgcaaacagccactatatgaaccacttccaattgaataacaaattgtgatttgtgctgctgtcaacggcttccgtgatcgaatgccactagtcaatttctcaatatgaaattcgtaatagaaaccaatttatgcaacaaacaagttgctcattttgactgtggctgacattttcatatatggggattactctattagcaatttgacgatgctaagatgtgtagctgtctagctgactgcattataattttcatgttcagaaagtgctcttccttgaaactcctgagggaatttcttctgcattgaggccattctgggaaaaggcaatagaaggaagggcccgtgtggttcaagcacagcctgatatgcttgaacttgtacctcctgcaacttcaaaaggcaatggggtgaagattcttttggaccacctttgcattagtccggatgaggtattagtactttagttctctattacatcttattgcatgacggaatacaattgatgtcatcacctatctagttctttcaattatgaaaaaccgtcatttaaatcttggtcatacatatgccacaaaataaaatatttgaagtctgcactgagttttccaaaccaattgcccagtgatctagcggtataagtagatttaaaatggatattagacctctgatcttccatcaaaccattgaaagcccacctgcaatccttctaacttcaactttatttttttcttttgcaaggtaatggctatcggggatggagaaaatgacatagaaatgctacagctagcatcattgggtgttgcgcttgcaaatgggtctgagaaaaccaaagcagtggcaaatataattggtgccactaatgatgaagatggagtcgcacaggctatttacgactatgctttctaacagctgctaactctaaggcgtattgggataggattatctactctttggttctccccagtgccctggattcaccatataacaagacttgatcaccatctatccacaagataatactgggatgtgatctgaagccctgttggagtcaaaacattttgaactattaggcttcggttcattttttggtttggcaaacattcatgaccagccatgctacaatttgtgtgtctggaatatttatagaattgaattccttttgttttcatctttgatgaccaaaggactcccttaacgttaagctgttcttcttcttcttttaaccaaggcaattggatgtactgcagacatatgctttaaatttcgacagaaggctgttcatcatccccaggcagtccaatgaaaaatttcattgtagtatttacaaacagaatcgatgtctccttgaacaagacgactctctgtatatggcagagaacgaaatcctcttacatccgtgacaggctaatatgcttgtcaacaaaatcctcaacgaaaaaagaacagagatgaaaccctgaccccccaaaaaaaaaacatttcgatactgttcctactgatgatatccgcttttgtttacaggaattgggggaggcctatagagcatgcttttggtgttattcctggccatcagatttgcgcaagaacttccagacttcttggctattgatgtgctgtttgcgccaggtatatgacaagcttcctggttcccatccagtgctacatagctcttggatgatttgatcttcttgtatggattctccttcttgcgtagatcctctaggcatctcacctcagacatacatgcaaaagattgagactttccgtcgtagtatttggataatcctttcctgcaaagaacaacaaagcacttgccctgtgagaaaattttccttttgctagtacatctattgatactaatatgcaactcttcttccccaggaacttacttgacagggagttgtgccttcatagatgacagatcgtagaggctatctgaattcatccttctcgctggctgctgcgcaaactggtcttcttgagcttcagcttcctcgctgtctgaaaattgagcctcatcatcggagtcgcctgagatggacgatgatgtctcgaacaagtcttcatcttcttcttcacggtatactggaaggaccgcagctccaccgaatttgcccatgctcgcagtttttctggcttctggaacaaagacaccgaaagaacaggtacgctttgtgtatagaactatggatatattcttcttcctctcttgcttcctctctttcacaatctttacaacgtccggtggggagggtgggtgtatatatagctccagctgaaatgggataacgctaagctgccttctttcaaacactgcacagtgccctttgactaatataatcttacgcaatttgcatccatgacatcacctatttgttgtgtttacatggactagttaggtcttttccagaacactgacatggacccatgagcatggctgcttgtgtgcctttgtcccagtttttgccgaaataaaagaaagtaatgaaaaaagagcgtgaaagttggttggccacttccacatgctttcccggattctgctgctggtacccctgatctgatcttatcttcttagtttgttgaatgggacccagatttgttcttatatccctttggcaagttggttttctgagactgacttgtaggccatggcatgttatggtgaggatgatgcctcatcatgttaattcttttttgtggggagctgagcgaggacacgaggcgcgctactgttggcttatgattctcgttgcaggctgagtcggtggccgaggtagaacgcaactagatctttcaggataaaccttttcattacttaacccggagtattttggggaaatcacgctaatagtagaactttggtgccttcaattttttactataacaacctgttgtttttctactttctgaacagttcgaaatggtgagatttctaagtagtattaattccgttacgtcgacgagggaattacggctcttttagtccttgataactgccagaaaatactcttgtgcctcctaattcgggacaaatttcagcatacgaacagtgtgagtggagcactagctgcacaaggggtcctgtaagttaactgttaatttacgtaatctcgaacagtcttagctttcaaaacagagacctttttcctcatttccttcaggatcactgctcactggttccccacatactcatgtttctcgtttcagcaatgggtaaattgagattccatggacccccaatcagagttcggtgagtaacacgtgtatggttttccgcatgacaactgtgattgcacttcgctgtgttacttagcctccattacacgcaattttgcgagagaaaacgagaggcaactaacatacgtccagcgctcgaaataaagttgtattgcatcgcatcattggtaacagtgctaatgcctgtccattagaactcactagatgctgctcaacttgagctgtgtttagttcagtgtaaagtttagattttggttgaaattggagatgatgtgactgaaaaattatgtgtatataacaggttgatgtgatggaaaatgactgaaatttagatctaaactttggatccaaactttagatctaaacacagccttagagaagccgatacacgttcctgcggtaggatactgtcgatcttagccacattgtcatgtatctggggtttctttaagacttgagaacttaatcaagtattttgatgtagatagtataatctacaaacgcatatataattcgacacgactaggacctaacccaacgcgacgtggtgagctgttcaaaaccggacacctgtcgcgcgatccgtgtacgcgccaaggtgcatgttcggtgggcgaaaccaacaacagcacctcgcacgtctgccattaacacgaactcctgataataatctaaaaaatgcttttataaaccgacgagacagaatgccctgggtacacatggcacggacagcatttccggggacatggccacaggtttgattagtggaccaacaaaaccggcgacatgctaatctcttactcgtcatctcgtgtccgcgtgttgctctgcacgaaggctgtctgtccacgttctagagatgcaaattgtgttgcagatcaaagcccagaaatgcgctcctgctgtctttgcacttttgatcgcttttttcattttgttctcgagccaattgcatgtcctaatccgtgccattaacctcagatttgtagtcaagggatggctgcttagaatctgtactatggatattgatgcccccttatccttaatcctccttatccaggcgtggactgcttcaagcttcgcgtggtgggcaagatgaaaatatcatcccaagtagtgttccatgacgtctcactcccgtagcgaatttttgacttgtttacatagggtgagtttgaggaggaggagattgagaagattaggaagatatgcaaaatgagatgaaccattagcgcatgattaattgagtattaactattttaaattttaaaaaataaattaatatgattttttaaagtaactttcctatagaaaatttttataaaaaatataccgtttagtagtttgggaagcgtgcgcgtgaaaatcgaaacaaactcactcactttcttccgctgccgaacgcagccatattgtgctcgtggttggggaacggagcttctcttccggaaacattcaaacacgagcttgctacaagtattattgagctcgacgtacacgtacgagccttcctcccggctgcatctatctcctgtcaggtctgaatttttcctcatctagctaacctttttgttgcgacttaagactattcccaggtagaaataggatttttcctctagaaccttttcgtgcgttcaaaacgcgtcgaccctggatagagcgcaagccaaccaaccgcgctctgaccggcttggctcgcgcgcgcggaagattatcattggatttggaacaacacatgtttattccgctcactaaacatgaccggtggcctgggcgagagccatccatcatcgatcacccaaaagacgcgtttggctcgtagtcgtcttataatcccaagcgataagggttcgcggatcgtgccgggatccggcgaaagcgaccgagcgcagtagcatcgcgcggcgcgctgaaatcatgtggcacgaggccggagggagcctgcgatttttgcgtggaccacggctgtactacctgtccaggccgcgcgccagccgccgggaacgtggtctgcgcgcgctcggacgaaacgcgcgcatgtggatagctcgcggggatgggatcggctcggcgccgcgtcgctgttcgcccgatttttattttcgatctcttcggcggatctctcgcctgttccgtgcgaatccggacgggcgggctgaaccgcctgtgcacaagccaggcttgcaaattgcaaaccccgagacgcgtccgcgtctccgcctctcacgcgcgcacgtccggacgcgccgcgcggaacctgacgattttttttttgtttccttttccgtatccgaggggcgagggcggccaagccaagccggcggccgcgcgcgcgcgcaggcgacggcgtctccactcgtcgtgggcggtcgactcgcctactataatcggtgagcgatccatccagcacaggaaaagccggaaacccgggtcgtctctcctacagcgcgcgtggagagatgtaccgcggctcgtgtagggctcgtgcttggtcggagtctgcatgcgggatgttcctcttgggttgggtgccgtggccgtcatgggagcggactccggtgctccactgtagtggatgggcgaaccggaataaccaaaaagacgagaaggacgtgaaggctttgatgggcgcgagcccagtaagagcaacgtcaatagccaactattgactcaaaacatctaaagccaatctaataactcattcatacaataattaattataaaaatatgctacaccattaatatctggtctcacctctcatacacacgtaacatcttggagtccgtgttgcagctggctacaaatctgtagcccgctttcttctctcttctcttttcttctcgatatatggttatagccggcttatagcctgctattgtacatgctctaacagtggatgccttagggcacccacaatggttatctataagctctctacaacagatccatgtcagcatattttcctacttagaagagattaaatgaagagatagagcaaagctatctactaacatggaaatagtttatagagaaaaacaaggcaatggattagagagctatagatacccatgtagacataccattgaagtggtttattattaatttagtctattgctgagatgtacatattttatagatagcacattactttaccattgcgggtgctcttatgtattccgttgagacattgcaacggattcattcatgccgcgtgcgaatcctgcacactgtataactgcatgcgaatcatgtgtgctaggcatgtaacatactccgtatttctttgtttcagatagttgcgtacagggttcgctaaaccgttcaagatgagcttatcatatcacacggtttaacggatattacggtaaacacggttaccacaaaaccgtacggttattacgagatatacagtggtttaaaaaactttaaacgttattacacgtgataatcgcacaattttataaaccctaccatccctagggaaaaagtacatttgataaaacaacctagagtaagtgatataccagatgtggctatcaccttcaattttatccatatcattcaaacaaaaaataagaggcaacatatacaatatgtcacctctaatacacaaataccaatatctctaatactctcataatttttttaaatttgtgtggaggttgactcttgatttaggctcaaagtaggtttatagtagactataagtcaactgtaaacttacgtggaggagaaagaatttttaaaaaataaagaggattgtctccaatgcaatagctagttattcacatatttcaaatatattaaaggcatagggagagataaagagagagaagaaaaatagagataaaattatagctttttctactataatatgagctcatagttggctttagtattgaacttgctctcatcatctctctccccacttctctcctccaactcannnnnnnnnnnnnnnnnnnnnnnnnnnnnnnnnnnnnnnnnnnnnnnnnnnnnnnnnnnnnnnnaaggcgattccacctggcgcg

SEQ ID NO: 6511 - DNA, 5770 bp, Oryza sativa
  unsure (1)..(5770): unsure at all n locations
cacggattgatgaactgactacttcatgcgaatncgagctcggtacccaatcgcacaattttataaaccctaccatccctagggaaaaagtacatttgataaaacaacctagagtaagtgatataccagatgtggctatcaccttcaattttatccatatcattcaaacaaaaaataagaggcaacatatacaatatgtcacctctaatacacaaataccaatatctctaatactctcataatttttttaaatttgtgtggaggttgactcttgatttaggctcaaagtaggtttatagtagactataagtcaactgtaaacttacgtggaggagaaagaatttttaaaaaataaagaggattgtctccaatgcaatagctagttattcacatatttcaaatatattaaaggcatagggagagataaagagagagaagaaaaatagagataaaattatagctttttctactataatatgagctcatagttggctttagtattgaacttgctctcatcatctctctccccacttctctcctccaactcatcgctcaattatatgtgatatttttaggggcaatacatgaatcattataacacttgctcttagagcaggtacaatagcaggctataagccagctacaaacatattttaaggagataaatcagaagagagaagagcagcgggctacagatttataaccagcggtagcacgtactctaagatgcaatgtgtgtatgacaggtgggaccagatattaatagtgtagtatgtaactattgtatgaatgggctattagattgaccatatatgagttgaagctactatttggctatactattaaacttgctcatatgagattctatctttttaaggaaaaaagagctaaaggatgtgttcgttactccagttttttatcttttactttctcattttatttaaatgtgcttccgaacaaataaacaatgtgtttttcaaaaaaaaaagaaagttatagagttgcttaaaaaccatattaatctttttttctaagtttttatgaataatacttaattaatcgtgcagagcaatattattttccgtgtgaaaggaaagattcgatgctgtgtaatgccgaacgcacccaagcctctcgtcgaagcttatctaccgtagttaaattttaaaatttaaatgttaatctgagaatagaatttggtgttattttcaccgtggtccatttcttagcatttattttaagccgctaataatatactctctttgtttcacattgtaataagttaatctaggtttgtcatacgtcaaaaaaaaaattaaactcaaccaatttaacagaaaattacaaaaacatttctgacataaaataaatatactataaaatatattgattgatggattcaataaaaatactttagtgttatggatgctaatatattttttctataaacacccaaagtaacttataatatgaaacgaacagaacagagtagatgtgtgaaagtttttgctataaattattttggttatctttttgcatggcttatcagtcgtacctcaaaagatcaaactatatgcctttcaagatgaaccttaaggcactgttgcacacccgttaacgatggatttactgtaaaaaaaacagagaaaaaccacaacatataacccgcacaattaaaaaaaatcaagatccgttacaaatagatcgaataacatgtggatactttttttatatcatgacaaaatattggcaatgttgaagtctagatggaattggcatcaccaatattttagcaaactatttgtttgatggcatatttttttaagcaaaccaaacatttgcaaagtactactacgtccctcatataagttgttttagttttgttcttagttaaaattctctaactttgattggttttagattattttttaaaataatatttttaaaagaaaacttcaaatgttatagatattggtatattttatttttataaatttggtcaaagtccaacttataacataacttaagcaccttacatcggagataataggtgctactcctattttaaacgtatcctcagctcggcgctggccgaccagcggtccagcagtactatactattgcaaattgtaatgccgaacttatcaggcgagctactagttcaaagcttcccgtctagaacatacgtttacgtagggcagcaacttgcgaagtccatcctcgcgcgttttggctctcctcaagggcgtttcagtggggagtacggctgacccgattgttgagacgagtggcggtttcaactctcaactgacggaaggggagacgcacgcatcgtcatctgaccggccgctcacccgatgaggcgagcgattcgatcggatgggcggatcgattgggttgggttgcattggattggattaggcgcgggaatcaggtggcgacggacgggtggaagttaggacggcagcgcagctgcaagttggccggtttctttttgtatttctctggcgtggtcggctggttcagctagccggtcagatgcatggagcggatagagtcgatttctcttgtacgagtagatcacggaaggaatgatgatatttttcgtacataggcctagagaatttttagggcgtttcgtagtggatgggtcaatgtatggagcactgtgttttaataagacgggaaagctggaatccaagtagaaactcctggagacaccgccgcgccggggggacaagcatcgtgatcggtaggaaggcgatgagcgggagaacaacgatacttgcttaggtcgagtacgttagatcttccgcgttcttttcggcaattcggcccactgaacacggctggtcttgcggcccacagtagcggttggcaatgtcagtttattgacttcctgagctcaagctacgcctctctgaccatggaatcgtttttttttttctttctcgaaacaaaaatacaaacataaagctcgtgtacatacttcccattcgaaacttgagacaggtgaaaattaagcaagggcacgtaaaataaaaaaaatattaacgcatgattaattaagttttaattattataaatttaaaaatagatttatttgatattttagagcaactttttatataaggttttcacacaaaacatatcgtttttcagattaggaaaacatactaacgaaaataaagtacaatctgcatcttaaaaaaaagacctcacttttataagggcccctttgatttggaggaagatcatataaattttggataatttcaatcctatagtaaaatttcatatgaaaacctttgaaacaaaagattgaattatatgttatcttttgaaattcctatggaatgaacaatcctataaagattttggaggaaatttagtaagagctacaacctcttggaaatatccctttgagtctatcttgctcgtccgattcctatgtatttcctggagtccaatcaaatgatcatttttgtatttttcctatattttgcaattctctgttttgcacttatatttctattagaatcctatatttttcctattgctctatttttgtgtacctatgatataattataaaggggtcccgaaggaacacacgcacgctacctctacgtgcatttatgagatattgtactagcacatcttttgattaacaaaatcattataaacatctagctatcgaaggatacatcacctgtgatagaaataaatgaacgtatcgtgtaggatatgtttggttcgatacgatttaaaaaatgtagttttgaattttataaaattttgatagttaccaatccaaacatacgttaaggctcgattctgtttatctgattagatgatagacgatatatcattaggttttgtgatatttacaaacgaatgaactaattattataactattataaagttgaagtgtttttaaatactatcaaacttgtacataaaaaagttctgcaaaaatcgtacgttttactagtaattttgtagcttaacaagcttattcatcatgataatttatcctgtgaaaggaaaataccctacgttacctatcccaacttcccaagtcgtgtaattctgtaaattctctcacctaacaccacacaaaagtgacgaggctttaaacttaaaacactttcgcatgcttgaacgtgccagcttcaaagcaaacagaccctgtgttttgaagggagaaattgcaacatatggtgaaatgaacgacggacgacggactgtgcaatggcccattatctcactgggcccggtcgtgtgctgtttaaccgcagatagaggatgatgaatcttgttaggaagaagattattttacctccctcaagtaagagctgagatataatcgaaaccctcatccacaaaaccgggtcaacttatcgtctactgtaagacacggtttggacattggtttcgtcatacataacggaaaacacaagaataataaaaaataatggacctcgcgtgttagtgttagtaggttagaaaaattaaaacaagttatgtgacacccacatgtcaggagtactttctcctagcttgactcatccactcagtctctatgcatcctatcttggtggagaggagaagtgtaggaagagctcgccggtggtgcatgtagagaaggcggcgatactcaatggagaaagaggagatagagctcgtggccgaggtagtgcttggcattggaaataactagaggctcaacacctttccgaggacttcctcctgttgttccaagactgcctttatcttgggtatgctgtagcccctatgccatcatcgggcctagccgcgcacttgttagatcgatagtacggaagctactcacatcgtgcccgtcagttgccgctgctcgatggactagcacgattgggggcggcgaagggtggcaaggcctagatcgtgagaccatcgttgctgtgcttcccgatagctaccgcctgcgtctaccatcccaaaagatctcccgacgacgacgagtttattttccacctcttctttcctctatctccatctgccaccatggtcgatcttgtgcccgtggcccactcatcgagtactcgattttgccactgttagcgccttgctctttggcggcggcggcctgctcgctttcctccgtcgtagattgacgagtaactatgaactaggacaatgtgccatgtaggagtggataacgagccagctcgcctcggctcattaaccttaacaggctaaaagcctagctcagcttggctcgagagttggctcgttaaactcattaatatatatttaccaacttcacaatttcaattttacaagtttaccatgtataaatataataataaacactactatctccatcacagtattagtgcatccagaatataatgtgatatatcttagaactacgagtcttggatgcacttaagttaggacggagagactatctaataatgaattcactaaatacaaatagtctggatataattaaatgactaaacactacttaagaagcactaagtatacatgaagatatgacgatctcttatattaaaaatgcgtttgaacaaaacaagatagctataagcgcatgattaattaagttttaattattacaaacttgaaaaaaagatatatttgatattttcaaacaactttcatatagaaagttttcannnnnnnnnnnnnnnnnnnnnnnnnnnnnnnnnnnnnnnnnnnnnnnnnnnnnnnnnnnnnnnnnngggcggtcatcaagggggggg

SEQ ID NO: 6512 - DNA, 6363 bp, Oryza sativa
  unsure (1)..(6363): unsure at all n locations
acggcattgattgacacgtcnnnnnnnnnnnnnnnnnnnnnnnnnnnnnnnnnnnnnnnnnnnnnnnnnnnnnnnnnnnnnnnnnnnacatatatctacctataatagatcttgttatgactatacaatggattttggctatatatttatatatttagtataataaaattaaatagacttatattcagatttattgtattaagatatattatactctattcgtccaaaaaaattaacctaggactgggacgtgacataattttagtatagttttttatttttttaatggaaggagtagtgttcataagaccatcagtgacgagcacccaccaccagtccgatctgatcatttgtgaaccgtctgatatgtggagaaacagtacaacctgaggtgggctttaaataacgcctccgcttcccaaaacgccaaaaagcgcgccaaaccaagggacgctgcctttgccgctgcgggacgggcccacgccgtgtgtgtttttgcgggcggactgagcttaccgatgcgacctgtccctgtcactcccgcctcggtaaccggcgcgctaccctcgctttcgcttgctgcaagagcgcatggccgtggactccatggaccccctcctcctactactactgggagaatgggcccaagctcctgaaccagaaagggttttctcaagcatttaagcgactgttttctcaagcaaagcatctacccaaatgaaaaccaggagcccaggatagaatatgtcgctaatgagcctgtctaaacatggtaaagtacactccacacgagtgaagaagcatcaaaacgcgtaaacgacccggttctaaagtcattttttaccgcggctcctcagctcgaccgacatgtggtggtccatgtaaaagaatctccccagccgcaaacattctcgcattctccacgactccactaggcacacttttttttctctctctcttggtccgattaccactgatacggacgtgggccgcttttgtttgaacactctcaacccaattttataacgcccacctcgcgtccgcctcggcacggtcacgcacgcactccactgcactgcactgcccgctttgttgctctgtgcctgtgggctgtggcgtctgtgaccgtcaggcgtcagctcgtgtcctcgcctgctcgtcctccttcctctccgctggtgctctctctctcttccctccacgactccacggacggtcagggcaagggcacggtctcgcaccgagccacgggcgcacgcatcgcgaaagcgcggccaccggcttgtgttgggtaggaggactggcaggggcaccaggcggcggagcggagctcgggggctcggacgccaatggcgcatgtggcttttgttgcgctcctcttcttgctgctcgtcggtgagtcgttcaaccacaccgcgttccttcttccgttgctctcgctgtttgcgtagtagtgatacttttgtggggagagtgttcagtgagtgagtgctactgctagatgccttgcttgccggtgagtgtagcaacctgcagatgtgggacaagaatacgattcttcttgtttcatggtccagttgttacgatgcacattgaacttgttcgttcttttggggtgaaatcactcattttatcgatgtgtatttcaagattgtttctttttttttgggagatgaagaaatggaagagaaatgatcactaaaactatgaaaaatgcatgattgcaaatgtggcttttgcagggcattgcctcggaggcaaggttggcatctgctacggccgcaacgccgatgacctgccggcgccggacaaggtggtgcagctcatccagcagcagtcgctcaagtacgtgcgcatctacgacaccaacatcgacgtcatcaaggccttcgccaacaccggcgtcgagctcatggtcggcgtccccaactccgacctcctccccttcgcgcagtaccagtccaacgtcgatacctggctcaagaacagcatcctcccctactacccggccaccatgatcacctacatcaccgtcggcgccgaggtcaccgagagccccgtcaacgtgtccgccctcgtcgtgcctgccatgcgcaatgtgcatactgccctcaagaaggccggcctgcacaagaagatcaccatctcgagcacgcactcgctcgggatactgtcccggtcgtttccgccgtccgcgggggcgttcaacagcagctacgcctacttcctgaagccgatgctggagttcctcgtggagaaccaggcaccgttcatggtggatttgtacccctactatgcgtaccagaactcaccaagcaatgtctcgctgaactacgcgctgttctcgccgcagtctcaggatgtgattgaccccaacaccggactggtttacacaaacatgttcgatgcgcagatcgattccattttctttgcactgatggctctgaactttaagactctgaagatcatggtcaccgagacagggtggccaaacaaaggggcagctaaggagaccggagcaacacctgacaatgctcagacctacaacactaatctcattcgtcatgttgttaatgacagcggcacacctgcaaaacctggggaagaaattgatgtgtacattttttcattgttcaatgagaacaggaaaccaggaattgagtctgagaggaactgggggctgttcttccctgaccaaagctctatatacagtctagattggactggcagaggcaatgtggacatcatgactggaggaaacattacaaatgcaaatggtacttggtgtgttgcttctgctaatgcgtctgagacagatctacagaatggtttaaattgggcatgtggaccaggcaatgttgattgctctgctattcaaccgagtcagccctgctaccagcctgatacattggcatcacatgcttcatatgccttcaacagctattatcagcaaaatggagctaacgatgtagcttgtgactttggcggtactggagtgcggacaactaaagatccaagtaagttgccaccattcgtatgaaatctatatcggttatagtaccattttacaattcctatgtactacctactagtggatgttttggtgaggtctgcatcatagtgttgtagctcaatgaaagcatataactggaactagcatgtgctgattatgacctgtttatgatggtaagtggtaacataggtccttgaccgaaattgtagtgatagctgatagataagctggtaatagatgctgcaatactggctaaatttctgacttgaactaatattcaaatgtttatggtttttggtgacatggataatacatatgtaagtatgtaactgtaataacatgcttgttgtcaatttgagttgtccgttatatttttctggttcgctgttctcttgtgcattgctttgtcttgcattatctcttgggagtttgctaagtgttgataagtattgttgatttggcatgtatggtattcatgctctgctctatttcactagttaatagtattctcaatgttccaactctgttgatcttgtggtgagaacactaataatgttcgtaggaaattcctagcccttgtgcatggatcagcacatgcttttgtaaatcatggatatcaaaatttgatgatggatattgtgtattaatatgggttaccgatgggtaggttgctggtccttagaccttagtccttcaaaatgctatgtggaagtggaacaaccttcaagaccaaactaaaattataaagatattgatggttacatccatgccaattattgttacaatggagattttgcatacgctcgattgtttagtactactagaatataagatgaaggtatattgaaatgtgatgatgaattgttttgcttgcgtgcaggttatgacacttgtgtttatatggctgccgggtatggaaaagctttctcatatctttgttcaatttttttgaagcattttttcaccaactcctttgagaaatagttctgctgactattgttttttcctcccttgaaggagtaagatgagcacaacaaattcatccaaccttccagttcaaagtgggttcagcccatcgcgattcgacaaaaacttctacctgttgttctccatgctacccattatgattgctgcatgcattgtgtgatatgttcggagagagatcttgcagaagccttttgccatggaggatggaacggtaatcgcctgatactggaaaccagtactggtttgtttgtcatagttagcggagtgttgtagtatgactatgtagtaggaaactaggaattctcttgccttgcgcggacagcatatatgagttagcattatgaactaggaacattgcagatgatgtctcttggtagttataatcctattatgctcgctggatttttcagtgccactaattctttgctgctacctttttttggggacatgtttgctgctattcttcacatgatctgatcatcacatataataggggggctaatgggcgattgaccgatcggtttgccccccccccctccccctatactcctccctcttctcccccttcctcctccccttcttctctttctactacagtacaccacacaattttttttaaaaaacaaaagttagaaaaatttatgtatagaaatactatatataaaaaaattgaatttaaattcaaatttaaatcgggtatgtaaacttttgacttataaactttgggtctataaattttagttgtataaactttagatgtatagaaatgctatatatagaaaatatttgaattcaaattcaaatttgaatcagatataatttaaatttaaatttgaatcgggtatgtaaacttttgacttataaactttggatctaaactttagatgtatagaaatactatatatagaaaatatttgaattcaaatttgaattagatataatttaaattcaaatttgaagcgggtatataaacttttgacttataaactttaggtgtataaactttagatgtatagaaatactatatataaaaaaaaatatttgaattcaaattcaaatttgaatcggatatataaacctttgacttataaacttttggtctctaaactttaaatgtgtaaacttgaggtgtataaactttaggtgtataaatttactaaaatagaaaagtaatgcggtgacaaaaaaagaaaaccaggtggagggtggggggaggggatcgatcgctgtcctaacccgaacagcatttccgcatataatatcgtcttgcacctgtggctctgaactcaattgctcttgggctgcaccgaaaactattcagcccaagatttgttttcttctcattttgttatgtttagcccaggggaaaaggtacacccaaggtccctcaaccttgtcatcgagttacaaaatcgtcccctaaccacaaaaccagatatctagcgtcccttgactagttaaaaccggtcacaatagatccttcggtgattttgaccccggttttgtcctacgtggcaactgagacagcgtgggacccacatggtgcctaaatgtcaggctgagtcatttctctccccctcctctctagtctctagtctcttcctcggttcctcctctctctctctatgtgggtctgtaggccggtcggaggtgcgaggcgggagaggagggcggtgccgcgacggcggccggcggcggccgcggtggggaagcacggcggcagcccggtggagaggaggaggaggctggtctgccggcgccggagctgtgcggtttggtttggttggttggtgaggggattcagggattggtttggtgtttagtactgtacgtgcacgatggcgacgtggaggagcttgccgcggaggccgacggcgatggagatggcggccatgacggccgggccggtcaggaacctcaccgtcatggcgaacgtcgccaccttgttccggcacgcgatgatccgcggttgcagcgccatgaacagccctgagagtgaagaaacgtgtttgtgttggtaagttgcaagaactgtgttgtgaggtaaggtgaggaggagaatgaaccgaggctgaacatggccatgccatggccggcgtcggagaggatggagatggatttcaggagattgatttcccattgtgattatcgatggcctgcattgctccatcgattctacagtgaggacggagccgagcatcggggaggcggccgtggggagggtcgcgcaggggaccaaagtcctggccgagggcggtcacgatagaatattccggnnnnnnnnnnnnnnnnnnnnnnnnnnnnnnnnnnnnnnnnnnnnnnnnnnnnnnnnnnnnnnnnnnnggtgtncacttnngccagca

SEQ ID NO: 6513 - DNA, 1646 bp, Oryza sativa
  unsure (1)..(1646): unsure at all n locations
cgtgcttccctgtaaagagccgcccggttttcgcttggttaccgcttgccactccccgaagcccatttttggcggtcacggaactccgttgggctgccgccgccgccgaccgcggtgggggcgccgccttcctcttctcccgccttgccttgcggagtcgccgactgccttaaagaaaaagagagaggaggaaccgaggaagagaagagagggagagagatgattcagcctgacaatgtggggcctatatggtcccatgctgactcagccgccacgtaggacaaaaccagggtcaaaaccaccgaacgacatgttgtgaccggttttgactggttaagcgatgctatggttttgcggttagaggacgattttgtaactcgatgacaagttgagggacctttggtgtactttttcctagcccaggatgtgtgtcggacaggctacgtttaagcccacagtcctatatatggactggcccaagccttgaaatgttagacccacgtggtccctttttacagggccgagacatataaagcccaaaggagcttctagtcggacattggcccttcgagatagagttggagttaatgcacgtaatacgagagagacagtaacacataataataaattaagttttaattatgtacaaacttagaatataaattttatattttaaagaaattctcatatataattttttcgtacgatacacaatgtttagcagtttaaaaaagtgcgaacaaaaactatggcaaaatctacattttaatgaaaactaaggtactctctccatccacaaaagttacacatattacatattactttttgacataaagaccaagaaaaaattaaatcaccttggatgttacaaaatcaagaagtgaatataagcatgcaaccaataaacatttagatgactccttgggttctaataaaatatttaatttctctttttatttaagttttgaatgtataaagactacaaataggaacaacttatttggaaaaactcaaatgtgtaatatgtgtaatttttgtggatggaggaagtaaaatttactggttgcaagtttcaacatggtgtagtataatcaaggtaaccagtttaacatactggttgcaacttgaaagcccgaaacacaggagagtacttatctatttcactgttactgtttgccaagtgtatattattatgactttttttttactcaaagtgtgctgatcattttttggaggggaagggatgacactgcgttgaagacttctagtagtaccaagttgttccttgtttagtgccacaaaacgaaggttgttccttgtttaaactgtgccacggcgtgcaagtggcttggtgatactttttacagtgattttcggattgattagtacaaatggtagtcgagttgcaaagctttgtgcacatgcatggtttgcagcagaagatcacaggaaggcaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6514 - DNA, 1163 bp, Oryza sativa
  unsure (1)..(1163): unsure at all n locations
gggctttgatgcatgacnnnnnnnnnnnnnnnnnnnnnnnnnnnnnnnnnnnnnnnnnnnnnnnnnnnnnnnnnnnnnnnnnnnnnnnnttcaaccctagcgccgccgagacgactccagcgccctctcgcccttccagagccggcagatccgcagggggcgcgggagagaaagcgcgcggatcgggaggtggtgatggcgagttgcggctgcctcgcgggacgcgagaaatgggaagagcgcctgcgccgcggtgtctaaaacctcggtagaggcggatgcggaaacaggtggcaattttgctgaatcggagagagggccaggggagacggtctggtctcgctggttcgtggttttttgttggtgagagaatgagagatggaatttattggtggaggaaacgtggtgtgtgtgctctttcgcgtcaggcccttcaacagctgcataattgtgctctttgatggttggatggtttggtaggtgcaacaacaattcctcaacgcgcagcgttttgttcatgctattgaattaagaggttcattttctagagtacatgtaaaagattttcgtgtcccgcttgcgttaggagaagaaaagggagcacaacagaacccaaacataatggtacggagggaatgaagagttttttagaggtccatgctcagtatacttggaatgtttaactgatgcgtctaatgttctccttctccatactccaagaggtactccctccgttctataatataaggaattttgagtttttacttgcactgtttgatcactcgtcttattcaaaaaattttagaattattatttattttttctgtgacttactttattatctaaagtactttaagcacaacttttcgttttttatatttgcacaaattttttaaataagacgagtggtcaaataatacaaataaaaactcaaaatcctttatattatgggacggagggagtagttgtttagtggggattgagatccgatgcagacacaactgcaccataggactgcatgtattgtaaccgttcattttaatgatcaaaagctcatatttaccgctccactactcaaacagtagtacataaaacaatattttatactaggtaccgagctcgaattcggcctatgtgagtctgaatctcacntcatgccaggc

SEQ ID NO: 6515 - DNA, 1209 bp, Oryza sativa
  unsure (1)..(1209): unsure at all n locations
nagatgtgcaaggcttatagaaatgcgcaaacagccactatatgaaccacttccaattgaataacaaattgtgatttgtgctgctgtcaacggcttccgtgatcgaatgccactagtcaatttctcaatatgaaattcgtaatagaaaccaatttatgcaacaaacaagttgctcattttgactgtggctgacattttcatatatggggattactctattagcaatttgacgatgctaagatgtgtagctgtctagctgactgcattataattttcatgttcagaaagtgctcttccttgaaactcctgagggaatttcttctgcattgaggccattctgggaaaaggcaatagaaggaagggcccgtgtggttcaagcacagcctgatatgcttgaacttgtacctcctgcaacttcaaaaggcaatggggtgaagattcttttggaccacctttgcattagtccggatgaggtattagtactttagttctctattacatcttattgcatgacggaatacaattgatgtcatcaccctatctagttctttcaattatgaaaaaccgtcatttaaatcttggtcatacatatgccacaaaataaaatatttgaagtctgcactgagttttccaaaccaattgcccagtgatctagcggtataagtagatttaaaatggatattagacctctgatcttccatcaaaccattgaaagcccacctgcaatccttctaacttcaactttatttttttcttttgcaaggtaatggctatcggggatggagaaaatgacatagaaatgctacagctagcatcattgggtgttgcgcttgcaaatgggtctgagaaaaccaaagcagtggcaaatataattggtgccactaatgatgaagatggagtcgcacaggctatttacgactatgctttctaacagctgctaactctaaggcgtattgggataggattatctactctttggttctccccaggggttgaccccccctggtatttttccaaccgcccaattttaaatttaaaaaaaaaccccccaaaaaaaggggggggaaattgtcaccatctaccacaagataatactgggatgtgatctgaagccctgttggagtcaaaacattttgaactattangcttcggtatatttnttggtttatgcaacattcatgaccagccattgctcaatttgtgtgtatg

SEQ ID NO: 6516 - DNA, 3627 bp, Oryza sativa
  unsure (1)..(3627): unsure at all n locations
gcgcgcattgagtgactnattgatnnnnnnnnnnnnnnnnnnnnnnnnnnnnnnnnnnnnnnnnnnnnnnnnnnnnnnnnnnnnnnnnctcttgcgattgctttgaacaaaagatgcaaatatggggcttacacaagctgcactaataaattttcctatagtcgagatgtatttgcctgagcgagtgatgcggcaatttgggcttcgccaatccattccaccaccttttcgacctaccctacaggcgctgcatcgtattagtcgacgtggcagagaacgtgagaactgggaagagacacatcatgagtacattcaggaatgggaagcccgccggcagcgcatatttccagagtcagagcagtatgacccatcgtcttatgaggagtacctgcattggtactcaggagttacacggcggtatcttgtaccatcaatcagtgatgatgtggaagcaggaccttcattacagcctgatgattccattgatctgcagtatcaagccaaggctcctatgatccgcaaagcagtaagcctatattatctattcagttcctatgcagtttctgtagttgattggacctaaatttgtgtcagatataagttgtctttgcgagacttcaaatagtttttacaatcactccatgcataatttaactaatatatttaactcgaagggtctgctgattgttgtaggttgataaactgcacggtatggtaaagaaggccaagatggccatgacatccacagctgatacaaccaaacaagccttggtctttgagtttctgcatggctttcaggatgttctccatgaccttggcgagatcaaggaaaatggtggttccgctactagtccacatgttgaatcagctgccgctcaagactacttttgctagaagctgaacagaacattgttcatgccgatcaagaagctcagcatcaggaagaggaagagcttcacatggtggatgatgcaacaatgaccctcgagcctatggatgaggaggataatgggttcaacaatgtcatctgcccatgtccttcactggagttggaggaacacagtcactcagctacaccagccatcgatgagtgtgatacagccactcctgctccaggctctgcaatcccacagcaaagcactagtgttgatcaagatggacatctggaaaatcctaacgaaatgggccagattgaactaatggtggaacctatgtatgtggatcacaatgattccaacaatgtgctctcatccagcacgtcagttcaggcgctgttggagaattgtgaagtagcagagcagtcaatgaaaatgtcgatccagccacccaagttactggctcatctaccccagaacagggcccggatgtcatagtagatgctgaacaagaaaacccagccacaacagagggcaactaacttcaatgccgtcccctcgtctgcaaaggtgacaggcgattctgatttctccccttatggaccaattcgtgccacctatgtatagtgcttagatgccgttgtccgaaggttcagcatattgctgacatattgccctggttgtttgaccatgatgggctccactggaaattttagccgtaattactgatgtagcttacatatctcttgctttccaaagtcattacacttatcattatcaacatttttggtttttttttgtttttgaacatgcattcgattttcaattggaacttaacgctgccaatgcatatactatgttcttatacaaagaccaagaaaaagaaaaggttggaggtaggtaatggcgtaactagttgggccacgcacggcgaaactagtatatgatgccaatgccatgatggtcaatattgctttcatattaaagttttttttacattttgagttgattttttaaaagtcaagatgaaaggggagaccacagttgaaagtttcatatgatttgagttggaagttttatgatttaagttgaaattttcatattaaataagtgctatgaaagggaaaagaagtgtggctgtgtgctaggcgaggcgctagcaatctcgtgggggaagcgaagagaggcccaaaccgctggttgcctgcttggcccatgggtttgagaagaccatgggctcgagcggcccaagaccatggacttgaggaaggagtcgtagtcgtcgtatcttgatgacacgtgcgaccggcccgcgcgctcgtcgttattccgcggcgccatcttcctctctcctccgccctacgcgtcgccccgcctcgcctggccttccccgcgcatcctgcacggagccctaggaggctaggagaggaagaagaacacgcgcgcggggggatagtggatagccgaagcaactcgatcgatctgtggccgcgatcgtagctctcttcttggtccgatctcgtctctcccggcatggatttcaggaaggtgctcgaccagaccgtccgggagatgtaagaatcagaatttttatttctccttctccgccccttttctcctcctggtgtactcctatcttgtaaagatatttttcttcttgtactttcagaaggagggaggtaaatcttaaggtgctcaaggtgccggaaatcgagcagaaggtcaaaatttctttcgattttgccgtcaagagtcaaaatttggaattttgggtggtcagatggtttgctatttacctggattttgtgattggcgattgaagttttttccccgatctcgtatgcaggttcttgatgccaccagcgacgagccgtgggggccgcatggttccgatttggcagatatcgccagggccaccaagagctagtgagtagctcaaagctaaaaaaaaaaatcagaacttatttcccatttgtttatgagaatctagcgtgtttcagtttacgacttgggggcgttgcacattttgattgttcgcataatcccattgctttcttgtttcttttccagcggtgatagcgaaattataatgaatgtgttatggcaacgcctggggaacacacttgcgaattggcgtcacgtgtataaggtaataagataggattgattgtgcagtgatgtgctgtttggattgattccttaataacaggatgtttcaatcattacaggcgttggctgtgatcgagtaccttctagctaatggcaccgaacgtgcagctgatggcattgttgacaatagctcacgaattgcagtatgggtccttcgctagtttttctagacattgatatttcattgtttatagtacttgtcgtctgatgctgatttcttttgggaagaaactcacaagatttgagtatttggagcctaatggaaaagatgttgggctcaatgtgcgtaagaaggctgaagctgttctagcaattttggatgacagggagaagcttcaagaggtcagagagaaggctgccgttactagagacaagtaagacattctgtagcccattagcgacattattgcatttcttgtacatttgatgcttacttcttttcatgaaccattggtctaggtattttggcttatcatcaactggaataacgcacaaannnnnnnnnnnnnnnnnnnnnnnnnnnnnnnnnnnnnnnnnnnnnnnnnnnnnnnnnnnnnnnnnnnggtcgatccaagggggaagg

SEQ ID NO: 6517 - DNA, 1339 bp, Oryza sativa
  unsure (1)..(1339): unsure at all n locations
agattaggcctttttacgttcacaacctaaaacttgtccataatgatggtcctttgctgtcgatttgcaatgtactcagctttctaattgcactctcaaaatggacttgccaccctttttccctcccttatttcgtctaacattctctcaggtgtagctatcctgacaacttttggttagtactagcagttgccatgtcaatgatttatgtacaatgatatcatagtggtatggttattgaaaaacgtgtcaataaattggttggacaaaacgacggaagatttaaacttaccgtgagtactataccctaaactctaaaacctaaacccccttcgtactataatatagatttcgatattttgcttgcactgtttgacaactcgtcttattaaaaaaatttgtgcaaatataaaaaacgaaaagttgtgcttaaaatactttggataataaagtaagtaaaaaaaataattccataattttttgaataagatgaatggtcaaacagtgtaagcaaaatgtcaaaatcccttatactagaggacggagggagtatttctttaaaatagtatagtagtccagctgtacacacatacatactagactttgtcttgatatgtcgtttctcggtgtttatctagtctaacatcattgagaaaaaaaatagaataatgatgaaattttctccagtattaataattcttaacctctccacttatcaaccacaaaagggatcatgtttctttattttatcaaccgtgaaatcttcattctttgccacttcggtatgcaaaaacatgagttggttgttgagctccggttgagaagaatcagcatgacatcatgattcgtccctttgcaaatatcccatcctctccctccgtccctctttctctctctcattttaagggtatgtttggataatgaaaaatgagaggtaggattaggattggaaaataaatgaagcgttcattggtggagaaaccatctttggtcggttgaccaaaatccacaatagtcccggttgcaataaaaacagggactaaaaatcaaccgggactaaaaacacaacaaccgggactaaaaatcatctttactcccggttcatcacgtgtcagttggtgacaccaaccgggactaaagatcatctttatagtcccggttgataatactaaccgggactaaaaattatattgatctttagtcccggttaatattaccaaccgagactaaaatttaatacgtagtatnnnnnnnnnnnnnnnnnnnnnnnnnnnnnnnnnnnnnnnnnnnnnnnnnnnnnnnnnnngtaagacttggagttgcatntccatgggcgccg

SEQ ID NO: 6518 - DNA, 903 bp, Oryza sativa
  unsure (1)..(903): unsure at all n locations
aatacatatgttactcnccttgacttggcttccttaaaagcttntgcattcctgctgtacttgactttttactgttgagcagtgtacctttttaaattaaaaaatatcattggtaaatataaacacatgtctagagtagtgatatatgcaaagagcaaatgatataccatccatatcacagaagatatatttgaattttggtctataaaatcttaggcttcaagctctttttagaccacttgtcacttgccctgtaaacattcttaggcagcaatagctacattatcatcatgtgtgtgaaagcaccttttcaagatcaaaataatggaaaggattataactacagaaatctcaaaaaagcacaccatccgatgtttctgtatgacgcttgcccgaatcaagaacactcttagcaagatttttccctttccaccttagactcttcaaaatgagctgctcctccttctccatttcaactgcagactcatgacttgtttggtgatcaaaacccagaagacgtagaattccacgaacctaatacagagtaagtaaacagtcaattttgtaccatattatctgtgttttagtatgtgtagaataacataggattaagtgatttggtaaaaggaagttggatattcaccaagaaaaagataacatgtgtattcaaacctctaaacggtagggggctaatgacagtcaataagcaagtgagcataccgctagtatccgcacttcatcaagaagtgtatgacctcgctcctcagcctgccttgcagctgtctcaactgagattacaatatcacctaacattagctgcgagaaaataaattcagaaaatacaacaagatggcatgtctgggtaccgagctcgaattcggccaatagtcatctatcctgcac

SEQ ID NO: 6519 - DNA, 1164 bp, Oryza sativa
  unsure (1)..(1164): unsure at all n locations
cggcgcagtaaactccacnnnnnnnnnnnnnnnnnnnnnnnnnnnnnnnnnnnnnnnnnnnnnnnnnnnnnnnnnnnnnnnnntatctggatggaggtttgatctggtagaaatagaatagaacatagcttcactttggaagtaacttctgttaattggctggctggctgccttccctggctcctataaatcagctacatgtgcatcctttgaacgtggaatacgcaacaactcatttgtttgccttcaattatattctgaaatgttgttttcaaggtgatgtcatgggggttaagctaataattttctcgtttactgtccctggcagacttttcctaatccactgcaagatcatccagcctattcgaccgtcaagtaaggcttctctttcggtttgactttgctatcccctttggtcaacctcgtcatatttattgtgaaatgttttaagctaaatgttctctttgtacatttaccaggcagtattttgtcaatgcagatgatactgtacctgaaaaggtgaaaaaaaaaagtctccactgatgttttgatgtgtagacgtaattctgaatgatactcaccctgatgttttgccatcacaggtggttgttcagaaggacagtcccagaggagttcacttccgtcgtgctgggcctcgtcagagggtaggatgccttggatatatgcctattatcatttaggggcatgcattacccacatttaggctgacacaaattctcaaatcttatcaggtgtacttcgagtcagaagatgtcaaagcatgcattgtaacctgcggaggcctttgccctgtgctaaatacggtcattagagagttggtgtgcggcttgtcccacatgtacaatgtcaatgatatcttcggcatacaggtttgaaatatttccagctgacctaaataccaaaatgtattatgtggaatatcacttaaggnttaagcggcaaattttcttggaaaaattgggggcccgggtttggggattttttttttccccctttttgggggctgactataagaggaagatttaattgattatactcaaatagttgcaagtgcgatctgtgaattgtattatatttttgtgcaaaacgacttatgtgaaatttgtgccagctagtagttttgagatgagagtaaaagacatt

SEQ ID NO: 6520 - DNA, 762 bp, Oryza sativa
  unsure (1)..(762): unsure at all n locations
ctgcgccagagatcnnnnnnnnnnnnnnnnnnnnnnnnnnnnnnnnnnnnnnnnnnnnnnnnnnnnnnnnnnnnnnnnnncagtcctataatgtgctaccctaagtcaatgttaccttgtattcagtatattaatatgcgctatgcctttattttccgagctcagtcaatattaccttgtaacatcctttgatcaggccctggtggtctgtgcttctgctcagtcctataatgtgctaccctaagtcaatgttaccttgtattctgtaatattaatatgtgctatgcctttattttccgagctcactgtttcaagactaccgcgttgttcctatccagtagataagtgaaacagtttattgttcatgtgtgcatgattcccattctcatcagattgatgctttcatctgtagggcctcttggtttatggtttgcaaggaagagaaatttataaaaggaatttagatcaagaagtatgcagagaggtaagctacatttttcttccttataggcattgagaccataaatgtgcatacaagaataatttagatccaaaaggctacactttcaaggtttggctacttaatgatatatcacctgggatgtatctctccagctaatggactaatttaaatgcccttttatgtccatttaatatatagatgttagctggacaatgtagaatctatctttctactccattcgttccaacatataaaaaattttgcgtgtttttcaaaatgaatctggtgggagggatgct

SEQ ID NO: 6521 - DNA, 1052 bp, Oryza sativa
  unsure (1)..(1052): unsure at all n locations
ncaagccggtcagagcgcggttgttggcttgcgctctatccaggttcgacgcgttttgaacgcacgaaaaggttctagaggaaaaatcttatttctacctgggaatagtcttaagtcgcaacaaaaaggttagctagatgaggaaaaattcagacctgacaggagatagatgcagccggaaggaaggctcgtacgtgtacgtcgagctcaataatacttgtagcaagctcgtgtttgaatgtttccggaagagaagctccgttccccaaccacgagcacaatatggctgcgttcggcagcggaagaaagtgagtgagtttgtttcgattttcacgcgcacgcttcccaaactactaaacggtatattttttataaaaattttctataggaaagttactttaaaaaatcatattaatttattttttaaaatttaaaatagttaatactcaattaatcatgcgctaatggttcatctcattttgcatatcttcctaatcttctcaatctcctcctcctcaaactcaccctatgtaaacaagtcaaaaattcgctacgggagtgagacgtcatggaacactacttgggatgatattttcatcttgcccaccacgcgaagcttgaagcagtccacgcctggataaggaggattaaggataagggggcatcaatatccatagcacagattctaagcagccatcccttgactacaaatttgagggnaatggctcggatcacgcctnnnntnnnnngttgtgcacacnccgttntattccctcgaaaaggcaatgacagtccgagcgccgttttcggccttgacctccaaccagtttgaatttctccaacgtggacagataaccccttctgtgtgggggtccagggcgaagaaaagagggtccgcggacactagatgacttgtcagagattagcatgtcgccggttattgtggtacactaaataaacctgtggccatgtctccggaaatgcctgccgtgccatgtgtacacagagcattctgcatcgtgtgtttataaaagcattttttacattatagc

SEQ ID NO: 6522 - DNA, 765 bp, Oryza sativa
  unsure (1)..(765): unsure at all n locations
cgcgcnttaggtatccagtgcanaaggcgcnnnnnnnnnnnnnnnnnnnnnnnnnnnnnnnnnnnnnnnnnnnnnnnnnnnnnatcgctacgggtaaaagacatatttaatattttattaggctacatattgataagaaatttcaatgacaattcggatggataaaaaccactattgcatactgaaatacttgctctttttcaactcccgcgtggtaaagtgcgcgatctcctttttctaaaattatacctgggctcgcgtacaaagtgattgtgtcacgcgtagatgacatataagcagtcgagggagaagacgtaagcgctggtaccaacccatcactgattgagagaagggagaaccagagaagggacaagggaagagcaggtgcgttaagtgaatggcaaggcggataattcccttctaactgtcagggtccttaccgaagcgagttaaaccgttagatgattcaatcggacgattcaacatggtccgtgtaggcgacgaatgaaaaggagtgtgatgatcggaaaaatccgtttttttaagtaggaagggataaaagttcgtgtattggtactcgggcagaacatccttgaatgaaagaagcatcggcatgcatcaacaaaagcttgccgtccttcctgctcgcatctncttagcctagcccatctctcattcaagctaagtttgacatgcccgaggagatacacatgcatatgtntggttgcttacaccagagataccggttggaaagagattttgttg

SEQ ID NO: 6523 - DNA, 763 bp, Oryza sativa
  unsure (1)..(763): unsure at all n locations
cgcgccattggataccctnnnnnnnnnnnnnnnnnnnnnnnnnnnnnnnnnnnnnnnnnnnnnnnnnnnnnnnnnnnnnnnnnntattcttacctccctggtttcaaaagctggctatactgtgttcatagaacagaaaggccgctgctgatgttgcctgtgcagccttgctaattcgaagcttacattctacattttatggaaaagaacaaaaaaaagcatgacagcatcctttgatcaggccctagtggtctgtgcttctgctcagtcctataatgtgctaccctaagtcaatgttaccttgtattcagtatattaatatgcgctatgcctttattttccgagctcagtcaatattaccttgtaacatcctttgatcaggccctggtggtctgtgcttctgctcagtcctataatgtgctaccctaagtcaatgttaccttgtattctgtaatattaatatgtgctatgcctttattttccgagctcactgtttcaagactaccgcgttgttcctatccagtagataagtgaaacagtttattgttcatgtgtgcatgattcccattctcatcagattgatgctttcatctgtagggcctcttggtttatggtttgcaaggaagagaaatttataaaaggaatttagatcaagaagtatgcagagaggtaagctacatttttcttccttataggcattgagaccataaatgtgcatacaagaataatttagatcccaaaggctacactttcagggtttgcg

SEQ ID NO: 6524 - DNA, 856 bp, Oryza sativa
  unsure (1)..(856): unsure at all n locations
ngagatcaggtaccgctaaaagtatgggaatcaggtttcttcttctattgtgggacaacaaacaatctatccccgtttcaacatctgactaagtaaacaaggattagccacaatcaccatcaattcctacacggaacgccccccgcgtcgggcgaatcggatggggggttttgcagcgggaaggatcgggatgggagggtgcggtaccttgagagagcgcaagtggctcccggcgatgcggtacatctctgccgtgcgcgtcgcggaggcttggaggaggcgaccggcggagatgaggggagccgccgccggggaggtgggagacgcgggtgcgaccgtccggtgcggcgcggaggttgagctcggccgggtggagacgtggagtggtcggatccgaactgtgcgtaggttttgtgggaatgggaaggctctggttttgtgggcttggtcatgacgggcttccatagaatcataggccgaaggaataagttcatccgaggtcccttaattttacaacaaatccgattttcgtccttaaaccccaaaaccagatacaaccggtccccaatctgtcaaaaccggtgcccttggcggttttgaaggcggttttagctgatatggcgccatttgactaggtctccgtcccacgtgacattgatgtggcgatgaccgtggcaattatatctcagaaaaataataaaaatcatgggcccacatatcaaccacacaaaaaaaatctaaaaatgatggggcccatatgttagctacaaaaataatatgnnnnnnnnnnnnnnnnnnnnnnnnnnnnnnnnnnnnnnnnnnnnnnnnnnnnnnnnnnnnnnnnnnnncgcactcg

SEQ ID NO: 6525 - DNA, 1133 bp, Oryza sativa
  unsure (1)..(1133): unsure at all n locations
ccgcgcgagtaaagcactactatatgncgaattcgagctcggtacccaatagagcagagggaaagctcatgctttttggcgccaagaaatggatcaactgacagaagcagagcagagcagagcaaaatactacagcaaagcaagcttctgttatactaagaagctattcaaatacctgaacaatagtatatgtcttataaaatatttaagtatttatttgacaaaaatagcattgctgcactactactatgtcccagatagagtatttttcatccaaaaactagcagcgaaatgaagctactgctgaaatccttcataatacaactcacatccatctgataaaagattttgttgttctggttctgctgttcctgggtgaatagacatttggtgtcgatccatattcttggcgccaaaaagcaggagctttccctctgctctgcttttgttcccgcgcgctttgccgctgagattctatttgctgattttttgggaagagaaataagtgattctgttgattagtaatccctaattaatcacaaatggtgggatcactatatgcagctgttgacagaaggatgtgtggcagggatgaaggcaacggcaatgtttgccgtcagccaaaacggcagacgatgtgaacccatccaaagtatgtctggtacgctatggaatttgccacagggagcatgggctctaggccgaataccaacaacttcaggtcttggaaatttcatttgagatacccggcagcatcgaaagcctattgtagggctagatgatccaccataatcccatccggcaaggatcttgccaaaagcaggcgtaaaacctgcagactccataagcacatcggagaaagtctccatcaaactccatcgccaaggagggaggaaggaagctgtcacccagtcgcctgggcccaaattcggccccccaaaccaccccttataaccccccccccaaaaaaaaaaaaaacccccccccccccctttacatgatcatgaaatagtagatagatagaagggtgcgatctgtatacaagtacgaaagaactcagttaaaggtcanctccgagtaaaattttgaaagttatgtgtgccaaaggttccatttggttagcttgctatatg

SEQ ID NO: 6526 - DNA, 5595 bp, Oryza sativa
  unsure (1)..(5595): unsure at all n locations
tgagcttgtttaagaattcattaacatttaataattttcagggttatgaatcccacatacctaccagtagttatctaaatctcggtagtacccaccacataccatatcttataggancacaactttcggatatagaaagagttccgcataaggaatgataaatagagttctacatggaacgaccaaggactactattcatattggtttccctagttctacttggacaagggacatcctatgggtataaatacaaggccccctagaaggagaggagcctcaatcaacatactcagaccaccaaaaggcccaacatacaagccaacatacaccaagacacgccgccggatatcgacatcagagatatgcctggactgaccctatccggtacctacagaggccagctgtagggatctagcgctgtctttaatctcgtcgggcacggattcgaggaggaagactaccctgttgtcgactaagtgacgatatttcaaaccactatgtcgacaacagatagataggctaccccaaatattgtactggtgtgattatggtgaataagagcaacgaccggcttcggtcaacaggatgtagggttattacctgacaattcaggggcccgaacatgtataaaaattatcgtctctgtctcttttacctaagtctcgtatatatcctggtaccaacgatccccatactatacaaataccagaatcgtgacatcaaacatcgacaataatagagattgctaaaggacgctccatcttgtttacaaacaaggtcaaaatgatttgaaatcaccacattaacacaaaacagatatctcccaaaaaaaacagagagagaagaaacctacatcagtaaccatgaaggatctacattattataacggtgtagaatgcagattgactgcatatatattatatttattgtagctgtcacagttgtgtgtgtatgtgcgtgtgtgtatatatatatatacacacacacacaagcaaaatgcccgtgcatcgctacgggtaaaagacatataaaatattttattaggctacatattgataagaaatttcaatgacaattcggatggataaaaaccactattgcatactgaaatacttgctctttttcaactcccgcgtggtaaagtgcgcgatctcctttttctaaaattatacctgggctcgcgtacaaagtgattgtgtcacgcgtagatgacatataggcagtcgagggagaagacgtaggcgctggtaccaacccatcactgattgagagaagggagaaccagagaagggacaagggaagagcaggtgcgttaagtgaatggcaaggcggataattcccttctaactgtcagggtccttaccgaagcgagttaaaccgttagatgattcaatcggacgattcaacatggtccgtgtaggcgacgaatgaaaaggagtgtgatgatcggaaaaatccgtttttttaagtaggaagggataaaagttcgtgtattggtactcgggcagaacatccttgaatgaaagaagcatcggcatgcatcaacaaaagctgcccgtcctccctgctcgcatctccttagcctagcccatctctcatccaagctaagtttgacatgcccgaggagatacacatgcatatgtttggttgcttacacgagagatacggtttggaagagattttgtttggatgattttatggatgatcacttctctttatttagttaggtgaggttatctataaaatatcatattaacatctgattcaattaattaggtgtactcttcaacatgcaaaatatgatttttttactaatgtgtaaatcattgttcccaaaagatgtgaaaaaaaaaccacatatacagtatgtgtgtgtcaaacctagctaatgcatcacagctagtatatgtgtgtgtcaagcagtagcagtaatctacagttaggctaatctgatcttaatgatcaagacacgcatgagtgagtaacaaaaaatgcattgtcttagaaaagtgggaactgggaagcttgcgtgtgagcgcctgagcggtaggagaagaaaaaaagaaaaaaaaaacagaaaaggagcgttgtttcctcgccgcccccgataattatccgcatgtgcagttagtgaaaaaaaaaaacaaaaaaggagcatcgttccttcatcctctttcctcgtcctcatcgccactcgtcattcctctcagctcgccgccccgattcatttgcttgccgccggatctgacgcctttggactcgtggccaacgaatcccgcggcgggaggaaggagagtgtgctgaatcccgttggattcggccgcctagaggccggcggacactggatccaaccgccttgaagccaaaggccgcccgatccacagcgcagcagtggcggcggcgacggcctcagcctagagctagcagtggtggtggtgacggcctcatcctccgacgagcagcggcggcctcccccttctccttgatggccgcatggtaggtgtggatcgaaggtgaccacggctgagagggagattgatgatggtgttggcggtgagtcagtttggttctcctgttattttgttgaatgtctaatatggcagaagaattttgatccgtgatttggttctgctgttgttgatgacgttgacggataattgaatcaatgtaaatttcctcttcttgatttctaaggtgcttctcatctttgacctgtggatgtggaattttttttcctaacttataaatgtggatgggggatttgggcaactgtggatgtgtgattcttcgtaatctgtaatcgtggatggggatcgaggggggggggatgtttacaagattgggttatcttgagggaattttggttgtaatttgtgtgtttatgttttcgattcggttagcttctcatacgggcattgagacagggaagcggggaaattcacatcgatgtgacggacaaaaacggattggctcggataatgtgacgattggaaaaaatatgaatcttttaattagttaagatatagatatagatatatatatatattttttcaatctttaacaataagcaaaggaattgcaaacatagtacacgttgagccgccgcagccgcacaattgtgccggaaaattcagttagttatatagtttgtctgccacttctaaccaaattctctacctaccaacatgctccattatccatagaaacctaactaaagatcacacaaccagcaaagcagcgcagtatccagcatccagccacaagaaaacatgacgagaacaatgctgacaagagcggtacctaccggagagcagtcgtcctcggaagcacaggcgcaagactttgacaagtgccaagactgtgatgtgccaaatagcagggaacattgcccccctagaaaaaaaaggtactacggagtagcagcagacaaatagtgacatggaacatggacatctttttattccgatcggagaaacaaccattaagtgaaatctcacgttttcagggttaaaaaacaaggacaatccgcacatccacatctctacactctccaaactcactatgcacacattttcttcccggtggcattgccgcgataagagaaagtagaaacatcactgtttctaccatgtctaacaggctaactgcctattattatctactactatgtacccttgattcacagcattgaaaactgcataaaagcctgctggtttacctagcaggcccgaacctcagcaaaccggcttggggttggctcacaattgttggtaagtttcagagatccaaagagacatgatagtcttctcatgatgggcttccggctgactatcacttccaacgacacaacgtccttcctggtatcggcataagtatcatatccctcgaggtccgcttctgttatgagtactgcgtcagtacacactgtagggctcgttggcctgggtaacattacttgacaaaggggtaaaccactatcttcgtaatcaagctccatggagtagtaatcatcaatttctgagttggtgatgcagtcatccccggcttctagaaaatggcccaggtttttactctgtattggaagacgcccggtggtgagggtactaaaaacgttgacagcctgcacaatcatgtcgttgcatgaagcagcttagcatttgtaggactgtagagtaatagctctcacttggacaaaatgcaataacaaaagacgtccccacacctgccactgcgatggtgccaaaagtactctaggcctaatggatcggacatgatctaatgctgcttctggactcatgctccgatatttaatctgcaagacaagtaatctgtcatcagcaaaatggagcgaaagatatacaatattgagttgctttaattattgtttatcctaccagataacacaaaacaatagtcgtgctacgccctcttccagctttacagtgaacataagtaatgccaccttctgatgcattccctgaaaaaaagagccaaagttaatatccagttgaggtcagcaaaaattgtctgcataaatggctacaatgcagaaagtgtgtaaaagcaggtttcctttcctgccagcagatatattaataatttcacttaataatcatggtgtatggtagtattatattgcactgacagctaacagatccttctcatcccatggttggaacttggagatgggatgtgaattagaacatgtcgctgcaacttaaatttgaacacctactacaccaacaactaattggccatgatcgcaaaccaaattccatatccattagttgaacgcagctatcacctgctccacaaaatcagagttgactgcaactagcttgacttcccttaatctgactaccggtagtagttttgttacctaaacctatgtcattgtttacatgcggaagaacaatatttcatactagtgttcgagaaaaaataaatattccatactacagagtcatacaggcattaaaaaaatcgaagtgtaaaagtgacacacttaggaccatgttcaacaaagggcatgaagccattaacattggccacctttaggactatatgttgatatgttccacaaagggcatgaacttacggtggataaaatctatggcttgacaaatatcctggagggctggtgcaaacaggtagtctcttgtgggaataataaggtggtcaatcccatgggcctgcaaaagtaggacttgttactcgtcaggaggatcttgcattgttgattgcaaacacaaaataaagtgattgaaaatcccctgaatgaatcaaatgaataaaattatgctttaaactcaacgagaagatgtctgacaacaaaagactacatcatacactctcacaacgagtaaataatgaagaccaagtctttccttctgattgagtagcgaatcaaggttcacaacacaaatgaaatcatgtactaagctaggaaatcaagtgataagagattttacctggtataaagatgttgggaccagggtctcataagcctcattcaatgttacaactnnnnnnnnnnnnnnnnnnnnnnnnnnnnnnnnnnnnnnnnnnnnnnnnnnnnnnnnnnnnnnnnnnnn

SEQ ID NO: 6527 - DNA, 3320 bp, Oryza sativa
  unsure (1)..(3320): unsure at all n locations
ctggcaaatgaatccctnnnnnnnnnnnnnnnnnnnnnnnnnnnnnnnnnnnnnnnnnnnnnnnnnnnnnnnnnnnnnnnnnagtactaaattatgtaaaacaacagtgtaacaaagaacggcaactaaagccatgtccacaaatccctccacatgccaaactaaacatcatatgagacttactgcagtctacactagtaatttaccaaagaacaggccgaaataacgtacgcacttgaagataattactcaaatttcttagacaaaatggagccttaatggaacaaccacaggaacacaatcactgctcacggggaagcgaagggtattacttcagggggaaaaaaaggcaatgaaactctccccgtaatatccaagcataacaaaaccaacccccaagtgaacaaatcccacagagataagtcaacagccaccctaacagtcacgagtaaaccaaaagcgaagcctataatcgcgcgaggcttgtagagagtttaatcacgcgagtcgaattcagacgcaaggaaagagggggcaaacccacctggtcgactcggtcccaccaccggaactccgcctcgaaccggttgcgcagcacgttgtagagcagcgtcgggtagaacagcaccctggcgccggcgccgacgagcgcacgcttcgcgctcagccgcgctaccaccacgccgccgcggacgctggccttctccaccaccacctgctgctcctcctccccttccgaccgcaccccgtcacactctcccagctcgctaatcctcatgcccctcctcctccttcccccaccagcttcaaccctagcgccgccgagacgactccagcgccctctcgcccttccagagccggcagatccgcagggggcgcgggagagaaagcgcgcggatcgggaggtggtgatggcgagttgcggctgcctcgcgggacgcgagaaatgggaagagcgcctgcgccgcggtgtctaaaacctcggtagaggcggatgcggaaacaggtggcaattttgctgaatcggagagagggccaggggagacggtctggtctcgctggttcgtggttttttgttggtgagagaatgagagatggaatttattggtggaggaaacgtggtgtgtgtgctctttcgcgtcaggcccttcaacagctgcataattgtgctctttgatggttggatggtttggtaggtgcaacaacaattcctcaacgcgcagcgttttgttcatgctattgaattaagaggttcattttctagagtacatgtaaaagattttcgtgtcccgcttgcgttaggagaagaaaagggagcacaacagaacccaaacataatggtacggagggaatgaagagttttttagaggtccatgctcagtatacttgaaatgtttaactgatgcgtctaatgttctccttctccatactccaagaggtactccctccgttctataatataagggattttgagtttttacttgcactgtttgatcactcgtcttattcaaaaaattttagaattattatttattttttctgtgacttactttattatctaaagtactttaagcacaacttttcgttttttatatttgcacaaattttttaaataagacgagtggtcaaataatacaaataaaaactcaaaatcctttatattatgggacggagggagtagttgtttagtggggattgagatccgatgcagacacaactgcaccataggactgcatgtattgtaaccgttcattttaatgatcaaaagctcatatttaccgctccactactcaaacagtagtacataaaacaatattttatactataacagtttttgctacattgccaagctaatatgtagtaccgtttaatttcaatccaatacagcagctgcaaattatttaagttacagtcaatactatgactgcagctgattcagatccgtttagtgggatacacagtcaatactcaatgacatgttttaattgtaacggaataacatcgagtcacaaaaaatacttattaatttgttaaaaataaaagaatatacaaaggtgccgaacatggtagtagacagctcttccaggggttgttaaggatatcttattaagttgagtcaatccgttctatgccattaacaattgtgtgggttctacaatatgccactaacaaatttagttctacaatatactaccgaacaatccattttctccttatatgccatcgttgttagtcagccattagttttattaaaaactttgtgcaaatacataagatataaattatgctttaagcacttttagtgataaaacaatcacagtaaaaataaatgataatcataaaaaaattaagtaagtcaaatgatcaaatatgtgtcaaaagttaaagacgactttcattaaaaaccagatgtaatatttaggctttgtttggctaatgagttagggaaataatttcctacccacaaaagacatctttaaattccaaccattcattatcccttttctatttaatcctaaccactggtggagaaagcctttttactcccagttggtaacccccatatagtcccggtttttcaaccgggagtatgaatccaggactaaagatcactatctttagtcccggttcaaatacccgggactaaagatcgatctttagtcccggttggtgttaccaaccgggaaaaaagagaggaatctttaatcccggttgataacaccaatcgggactaaagagagagtagcgctttttttttcttttgccagatttaatctctatattttctcccaaatctagtgccatgtatatccctaaatcaatccccaaatccccaattcaaagtaacatcccaaatcttaagttacttataaacataaatcaaatacatcacaaatcctaaaaaaatatactcaaatcaaatacatcacaaatcctaaaaaatacacacaaatcaaatacatcatagattatacatctcatatccatgcaacgaatcacaaaattacacatcccaatcaatcacaaattgtaaaaaaaaagaaaaaaaaagaaaagagaccggccggcagttgagagggcaaggccgccgccgggcgcacccccgccggccgccgctgcgcgcggcactgccaccgcccgccgcggccccgccggccaccgggtcggatgggaagtgaggaggggaggaggaaggggagaagggggaggaggagttagatctgtgaagaggaaggggaacagatctgtgaagtgtaggagaggataagggatagagatgggtnccgagcaagaaggcggccatggcatcgatccgcgcg

SEQ ID NO: 6528 - DNA, 28806 bp, Oryza sativa
  unsure (1)..(28806): unsure at all n locations
acggccattatactnnnnnnnnnnnnnnnnnnnnnnnnnnnnnnnnnnnnnnnnnnnnnnnnnnnnnnnnnnnnnnnnnnnnnnaaacgacatatcaagacaaagtctagtatgtatgtgtgtacagctggactactatactattttaaagaaatactccctccgtcctctagtataagggattttgacattttgcttacactgtttgaccattcatcttattcaaaaaattatggaattattttttttacttactttattatccaaagtattttaagcacaacttttcgttttttatatttgcacaaatttttttaataagacgagttgtcaaacagtgcaagcaaaatatcgaaatctatattatagtacgaagggggtttaggttttagagtttagggtatagtactcacggtaagtttaaatcttccgtcgttttgtccaaccaatttattgacacgtttttcaataaccataccactatgatatcattgtacataaatcattgacatggcaactgctagtactaaccaaaagttgtcaggatagctacacctgagagaatgttagacgaaataagggagggaaaaagggtggcaagtccattttgagagtgcaattagaaagctgagtacattgcaaatcgacagcaaaggaccatcattatggacaagttctaggttgtgaacgtaaaaaggcctaatcaccaactccgcccatcaatgctttccaggggtgtaaatgatatactaaaccgcataaaaccacaaatcttttggattttttttctcatttcctcgaggccttattcgattaatttttatgagggagggattagagagaatttattccacacctattgtggtgtggaattattcctcccgtctttaatcctatctaaaccgaacaaggccctattgtggtgtggaattattcttccacagtcccctccaatatttttcaatccccttcaaaccgaacaagctctcacggctgccactcagccactcacatcttctaagggtgcgtttggtttacggtcaaggttagataggatatggcggtccataatttgctggatttgacgatccagttttttgtttggtggagtgagtatattgatccagttttttatttggttctagggatgaaggtggatttggtgatccaattttttgtttggttagagggagtaggatggatgaatggctgcaatcaccccttcattagagagggtgagtataccccttcaaaatcaccaaacccacaaaattatcaatctatatattaaaaaaatatagagaaataaaaaaatcataaacaaataaaagggggaaaataaaaaaaatagtcctcttctcgttggtcgtcggcttgctcttctcgccagctgccgccccgtcttctcgctcgccagccgctgtctcgtctcttcgctcctctcgccggccgccaccccgtcccctcattaggcggtgacaacgacgacgatgccggccgtctcaccggatccgccgcctccagatcccggcgaggaggagcctgggaaactacaatggttgccgctttcagatccggtcatcgtcatctacttccataccaccgcctcttcccactcgccaccgccccatcttcttgctgtcgtcgccttcggcctccagtctcgcggcaccctcttcccgccgccaccgcgcttgtgtcccgtgccagccgttgcgctcccgtcccgcaccggcctccgagctcgcctctcttgctggctgcgtgcttgctgcctcgctcgcaggggcgtgcctaggttatactacccggtgtcacaggacaccgggtagattattcaaatcctatataaattacactatattaattaatatattagtcaataattagataattagtatgtattggacccccggtaacttttattctaggttcgccactgctcgctcaagtcattgcggtcacgtggtgacggatgacacgagtcgagcgaccagcttgctcgctcgtccgccctcgcccgggcgctcgggcggctacttctaaggggaatattctcctccgggccgccctattctattttcgcccaccaaccaaacacaaaaaaaaaagggggccgccatatcctatccacccaaaacccaccatccaaacacaccctaagaaaatccactcgctctaatcccggccgtatattcccaatccaggcgaatcggccactgtaaccggaaaaaaacagttctatccgtcagatgccgatcggaaggccagcatcagcgctatacggtataggctcccgataaagaagacggccgcggctacgaggccgcatgattggatcggaccgcggcgagctggcgtcgccagtggcgtcaggcgcacgacctgccacctcgcacgcgccccgtgggacccccgcggtctcggcgtcgtctcggcgtcagggctcgcgctggccgacaagcgggctggtgttcacgtgggcccggctgaaaggggggctcctgcagctgggggcccacctgggcggtgtccgttggaagcatcccgttggtggatgccccgtgggcccgcggcggctgaggtcctcgggaagggtgacggtatccgtgggcgccaggcgctgggagcctgggattgggcggggtgtggggccacggcacttgcacggggtttgactgacggtgtggccgcgtgggaggcgatggatggattgttccgccaccacgcgagccgccgtgacgcggctgcagtgctctgctctcgcgtggttggcactcaccacctcacctcatattttgctgcttgcatgattggtttggaacagcgacactggcacactgctcccctgaatccctgaaccctgataggttttgctgagaaaaatatcactgatgctgaattgaggcttccatccgatggtccaataaaccgaagaataaaccaaattttaaattttcaaacttaattttaagtttgattttgagatattttcaacgtatatttttttcagcattggcttttaaattaaaaaaaaacacatatataaaagttttacctataaatttatttttattttctaataagccgttttggtttattagaaaaaaaagccaatcgattggggcctgacatgggcaaggcagtggtggtggtgctccggtgccaacccaaacgggaaagatccggatcaattttttttgctcgcgggagagttgcggtaatatgctctcggtaatgacagcgatcgcaatcgatccatccatactcgacgagttcacatactccatggctccatacttcagggttcacaccgagtgacatcacgcccgctcgtgcttcatgaccttcttagcattatcgtcttgcgcttgacgattcacgaccttgccttgcacgcaggcttgtcacttgtggcttgtgcgtagtggctctccttttcgtatagacttccaggcttccagcttcatgagacgaatgcagaagactatacgattgttttcttgtaaagtcgtgtttcagagaaataacactcagcacatgttggagcatgtagaggacagatactaaccatttgtaaattaaagtttcgtttggaaggctgtgtttagttcaccctaaaattgtaagtttggttgaaattagatgatgtgacggaaaagttggaagtttgtgtgtaggaatgttttgatgtgatggaaaagttagaagtttgaagaataactttgaaactaaacacggcggaagtgtgtttcgactgaaaatttcggtgacacattaaaagaaacaagcattttgtgtatgattaattaaatattaattattataaattttaaaaatacatttaattaatttagaaagaaacttctatatttatgatttttgccgcaccatttaacggattgtaaagcggtatagaatgtagcccaagttgaaataccaaaattttcccacccaagcatgtaacttgtatttcgttgggtgtttgtatgaatgttaatagccgccaaatcaatagtccattaatgttatattctattatctaaaaacattgtccattgatagcgcgagaacttacccaagacctaagttcccaatatgttagtagggtggagaaacaaaatagccataaatttgtttcttttgcccttttatataaagacacgtactatttaggttgtgtttagttccacgctaaaattagaagtttgaagaaattagaacgacgtgatgaaaaatttgaagtttgtgtgtgtagaaaagttcgatgtgacgaaaaagttgaaagtttgaagaaaaaagttggaacctaaacagggccttaatgtattcttttcaaatagtacacgtttgtatcctcatcagtttgtcaagagctgattatatatcaaaacgacttattagctataaaaaataatttatgaataaatattgacaaaaaaaactacattgaaaatactctaaaattaacttaaaattatgttttaaatttgaattttgacatcagctgattcattgtaggataaatcatgaggctcttgctaggggataaattaagcacatattctacacatgtcatattcagattgcggattccacttcaacatcttacgtgtactccaccttgataaaaagaacgtgcttcacgagcctacaactcacaaaaaggataaaaagaggcaaatactttattttacaggagtgtgacaagactaaaattacctaaaacgaagctgccataaactcagtgcgtgtccattccacgtacttttgaagaaaaagatacatctcttttttttaaccgggaaaaacacattcgctgcgaagtgtgtgtagtttaacttcttggaattaacacgggagttcggatttacgactatttatttagtggtagcatggtaggtggaatacccatacacaatgaaacactcacgatgacttcatcaattataaaactagaggatgccccgtgcgttgctgtgggacttggttaacatcaatttgttagataggaggtacaatctcaagaagaaacagaagaaacaaatagctttcttggagaaattctttttaacagctctatccaaaatttgtagataatttaggtagcacatgtcaactgaaggggcgttcagccataaagctcttttatacggattgacgggctggatacatgtagatgtgtgtggagatggaccaatttgttcatgtgggctacatttggcgctgaggaggtgaagagactcactcggtgactaatgggttgggctctatgctgcattccatccaacgtctgagaagcgatctaatgcattcatccaacggttcacaatttgataataatgtggaagcatgaggtttgagcttttggccttaactttataaaaagaagggatatgtcagtctagtcatccgaaggtattaataggatgtgatgtgcatatgtgcattgatagggtgagcgcgcgcatagtgaacgtctagatttccgtgtgtttctcaaggaaaaaaaaggggaaaaagcattagtttcacataacaccatagcatcatgtaacagaggaatgggctgaagtggatgtgcagttttgtactagtcaacaaaagccggaataagttcactttaggtcactcaatttattgcctagtttgaaattcattcctgatccacaatacaaaatatgacgcacctctcaactctcaaaaccagttcaagtaagatcccaatatgttttgaacaacagtttcaactaatgtggcatctacgtggtgttgacaaagtcaaataaaaccatgggacccacacgttagtgagtattcggttaaaaataaataaattgaagtgagacccatgtacagggtggagtgagatctgcaaggtgtctggagggaggtggtggagtgcaacgtcgtgtcttgttgcttctcatttgccgtggtggggcttatcgttgtccgcggcgttgccgacgccaatgctacaacaccgggaggaaggagatggacgagctccacgcccagggtacgggcctgcgggccctcgcccagtacacgtgcacacatcgggtcggtgaaggtgcgctggtctgtgagtgatggctgaggtgtctttgcggtgaagaacattgaggcggggcaacaaaaatagcacatcctctacagtccacaacagttgactcaaatctcttagcaccaattttctctccttcctcccttggctaacatgcacaagttcattgggaagagaaaagacaaaacaaagagagtagataccagcacggggctacccacatacgacaagaaggaagcaaccgtagggcggcgacatgttggcggcgttggggaccccgacaccggcggttgcaggcattgaaggaagcaggagcaggacccgaccgacggtaacggccatagcagaggctgaaggaggaccccaacgggtagagtcggcgattgcgccacgggaggcacgaggaggggcctactcccttggtcggcgacaaggcaggcggagcactgatgtagattgagagactcgcatcgaccacagcgataaccaatgcaactagttggagtcagcgttgacgagctgggcgacgactagtactcgagggtgacgacccaaatctagatcccgtcgagggagaagcgactaagagcaagtataatagtaggctacaagccggctaaatgctgaggtggaggagagaagagaggagagagaggagaagcggactgtaaacttacagccgacttggacacaagaaccaagaaactctatgagagaaataagtgggccctatattaattgtaaagagctaactattatatgggtaagctaagagaagactacacagaaccttctagctaacaggtcggctgtattactagccttgctctaagggaatgcactcaaggcatgtcggtcacggtaagtagggggactcagggtgcgtgtggagggcgacgaatgtgctatttttgctgactcaaatctctcagttcacatgtggccgctaacatgtgggggccacgtgggtcccactcgccacgtaagccaaaaccgatcactatactgctaagagaccaaagttgacattgcattatgagttgggggatgagttatatctgatatttcagttcaggcatgaattttagacttggtgacaaattaaaagacctaaaggaacttatccaacaaagccatcccttaactcttaaaggcctggtacgagtctatccagtgggcccatttcccaacctttcggcctaggaataagttcatccaacttccctctatttacaccgaatccgatttttgtcgttgaaccccaaaaccagatacaaccaatttatgaactgtcaaaacctgtgcaaacgaggtccctcggcggttttaaaagcggttttggctgacgtgacgtctacgtggcgatgacgtggcaattatatatcagaaaaataataaaaaacataggcccacatgtcagccacacaaaaaaaatcttaaaaaaggtggggcccacatgccagctaaaaataaataaatatggtgggccccacatgtcatctccctctccccactcggctctctctcttcttcctcgtcacgccgcagcatgccgccgccgccgacggcagccgaagcatgccgacggagcggcagctgcagcaggccgcgggcgaaggggcccacgaggagcggaggggcgagcggagtggcgacagcggcagggcgtgggcggagcgcctcctgcctcctcccgttcctccaggggctccccaacctcccgccgctccgcgtctccagcagcgcgcccgtcacgccgccgctctcgtcgccgacggcgtcgcaggcacccaagatcaggaagccggactagaacgtcgaccccttccggcaccccttcttcgcggtctccgcgccggcgagcccgacccgcggccgccgccttgagcacccgaacacgataccggagtgcgacaagtccgacgtctcgacggtggactccggccggtggttcagcttccagatggccaccacaacgctgacgtcccgcacctacaacctcgtcaacccggcctggtggattgggaaatttcagggtgaagtcttcgattcgagtccttcctgtgcatgcaagaaagggcgctgtgccgtgaggagatcctcagctttgagcatccatggggttcctcaaccttgtgggcaactcctttgggtgctcggcttccggcgagcggctcgtctcggcggccagggacggcgacctgcaggaggcgcgcgcgctgctcgagtacaacccgcggctcgcctggtactccactttcggcggccgcaactcgccgctgcactacaccgccgcgcagggtcaccatgaggtgatgccatttgtttgccaaactagctgaagtatcagtgtttctgtatagatgggtaaaagaactgcaatactgcattcacattttctgttgcttgcatgttcaaattgtttctctgttgctcgaatccgacgtcaagatcaacctcaggaattacaggggccaggtaaaccaagatttctggtacatttaattgtttaagtttcgacaaggggtgggtgatgccatgggagggcgagaggaggcggcgtggactggggcgaaggacggcggccgcacaggaggacatgtggggagagggagatgacttgtggggccggatgtaggtggcgacatcggtgtcggagtggccatcaaaaacggcgaagaggccgacctcgttgtcatcctaatctaggtggcgaaactcgggggcgacctcctcctcctctgggcaccgccgccgccgccgcccgcgccctgccgccgccgccgccgccgccactccgcccgcccctccgctcctcgtgggctccttcgcccgcggcctgccgcagccgccgctccgtcggtatgcttcggccgctgtcgtcgtcgtcggcatgctgcggcgtgatgagcaagaagagggagagccgagtggggagagggagatgacatgtggggcccacgggcctcaccatattatttttgtagctaacatatgggccccatcatttttagattttttttgtgtggttgatatgtgggcccatgatttttattatttttctgagatataattgccacggtcatcgccacatcaatgtcacgtgggacggagacctagtcaaatggcgccatatcagctaaaaccgccttcaaaaccgccaagggcaccggttttgacagattggggaccggttgtatctggttttggggtttaaggacgaaaatcggatttgttgtaaaattaagggacctcggatgaacttattccttcggcctatgattctatggaagcccgtcatgaccaagcccacaaaaccagagccttcccattcccacaaaacctacgcacagttcggatccgaccactccacgtctccacccggccgagctcaacctccgcgccgcaccggacggtcgcacccgcgtctcccacctccccggcggcggctcccctcatctccgccggtcgcctcctccaagcctccgcgacgcgcacggcagagatgtaccgcatcgccgggagccacttgcgctctctcaaggtaccgcaccctcccatcccgatccttcccgctgcaaaaccccccatccgattcgcccgacgcggggggcgttccgtgtaggaattgatggtgattgtggctaatccttgtttacttagtcagatgttgaaacgggagatagattgtttgttgtcccacgatgagaagaagaaacctgcatcccgatacatttagcggtcactgattctctctagcacttaccgttttcctgttaaatttattcagataacgcagctgaagtcctgtaaatcctttaaccaacatttttcgtgacggtgcgggatgctatgttgaatgcacggacgccacattttcttttgcctattgcattatattattttgactttttaagctgttttctttgcttgtctgatctgtctagaagtgttgggttgatgagttatcgctaactcaatacacatagtgcttatatcatcttttcagattgataatgttaatacgatattttgagtttttttgggtaaggttcacctgaatgtttaaaacaactattttaatgtaactattatactgcaatttgattccaaagggaaagggtgatgtatgacagtataagttaagctgcaaagtttacttctcggagatttcttttcgcaatatgatcttgctagtttggtttttcagtgaccactgcctccagtattttctgtaatttgtatagaatttttttcatgtgcaagtttttcagtttgagtaccttcttacttctaagtaatttcacctcatgttgtttctgccacattatttgttttcctttatttccataaaaccatatcatgtatcataaagacgcatctcttttgcttatgtggttgcagagatacagttatagtaggtttgctagtacaagtgttgtgaagcagtcttcaggtggtttgtttagctggcttcttggggagaagtcaagccaattgcctcctcttgatgtccctctcccgggtattacccttcctccaccactgccagactttgttgaaccgtctaagacaaaagtcaccactctcccgaatggcatcaagattgcttcagaaacgtcagtggtatgatggtatcactatatgccttcaggtgttttaatagattctcttttttctgcatcagcatgaaaagtaaattttttaggacttatctgcagagtccagcagcatctgtgggactgtatattgactgtggttcaatatatgaaacacctgcttcatctggagcatcacatctgttggagagaatggcgttcaagagcactacaaacaggagtcatttgcggctagtacgtgaagtagaagccattggagggaatgtctctgcatcagcctctcgtgaacaaatgtgctatacctatgatgcattcaaggcctatgtacctgagatggttgaagtgcttattgatagtgtgaggaacccagccttttttaactgggagattaaagagcaggtattctgtcattccgaaattagcatttttgatattctgtatatgttggcattataataatgatgtcttgttccccctacagctggagaagatcaaggctgaaatagctgaagtttctgataatcctcaaggtttacttctagaggcactccattctgctggctattctggggcactggcgaagcccctaatggcacctcagtccgctattcataggttggacagtagtatccttgaggaattcattgctgtaagattcatcaacttgccatttatattgtttttttgttagaaagtgcgtgctttgacatatgcttgcattgatgaattcaggaaaattacacagcacctaggatggtccttgcggcatctggagttgaacatgatgaactagtttcaattgctgagccacttctgtcggatcttcccagtgtgaagcgtccagaagagccaaaatcagtttatgtgggaggagactatcgttgtcaagcggactctgacgtgagcttttgctgctttacgctgtttgttgatgaggatgtgtatatgtacttataatcctggcttccttttcatgaacagaagacacatattgctcttgcttttgaagtaccaggtggatggtttgaagagaaaactgccatcattgttactgttcttcaggtattgttggcaaacatcaaatttaaccattattcagagacaaaactcaactatggtataccttttatgtagtttactgtctagtagactgccttatatgttcaccatttctttatacgcaatatggatggtcttgttattttgcagatgctcatgggaggaggtggttctttctctgctggtggtcctgggaagggcatgcattctcgattgtgtatgttgaattccacattcttgtcaatgtttcaaaaaattaagttgacttcttgtgccaatttcttaacattagcgtgatgctttatttacagatctccggatattaaacaactaccatcagatcgagtcattctctgcattcaacagtatctacaaccattctggtctttttggaattcatgcaacaactgtgagccccttatcagacatggatgatcctgcttttttttttgccaaattcaagaagtaaatgtagtttagtgtctgtctttttataccaaatggaatagcctactctagtagttattataatgtccattatgtgtatatctggtcagtggtgaacccagaacaaaaattgccgggggtccaatacattattacttaattattgactgatttaatagtttaggacataatttggttaggattgaataatctatctggggtcctgtgaccctgggaagctcaacataggcactccattgtatttggtagttgatttgtgtgcacaaccaacctggtctcttttatcctttctgcttctgggatttacacaccatcttacgcatggaataacttgattgcatgaggcctgtgatgaaaccgggcaaagcagccagtgacctttgtaaccaaaatagagaggtcaaaagttccttaagtaggtgaagagggagaattttagtgcctttattacggatataatagaagctagaagcaaccaatacttttgtgggatgtgtggaaagcatccatctggaactgtgagaagtattgtttgcatacttctctgtttagcagggtatatggcaaatgggcacatcgcctgctctactcatttgttttgagatgtttgttatgcattctaccttcactccatatctcctatcactatattgtacaacaatttgtaccatttttttcctctttctagttttccttggaaatgaaactgtgcaaagggagtgagaagattgactaaagccttgtagagacatcaatttgcatccatttctttcttttcattttgttgtgttcattgtgctattaaatgatagaatcacttgtcagtaacactttttgctactcctttcatgatatataattgacacagctttatgtcttgcaatcagagcccaaattttgcttccaaggctgtggatttggcagcaggagagcttcttgaggttgcaactcctggaaaaggtttgcttcttatttgacatattggatatttataaggaccatgcccatatatattttcctcatggctgtattttttgtgtagttacacaagaacagcttgatcgagctaaacaggcaaccaagtctgcagttttgatgaacttggaatccagagtatgcatttctaaccactacttgaatcctttgtgcttatcttttgtttcctgttgtatccttgacactttgttttcttcactgcaggtcgtagcatctgaagacatagggaggcagattttgacgtatggggaaaggtatggttgcaccagcattggtaacatagcaacaaaagtcacctcacatggttcttaaacctttatgtgcactagccatgcattcactatcatttatgagctatgattgtgcaatcatgctgtgtcctgacaattttaagaacgggaactttagcatgtcattaaaatcatagtgaaacctacaaatatatgttgtctattgagatgtcaccttcagtatttacacaagcatagagctttgatccttcaactgtgaatgaactacaacagtttgctttttgtgtagtgttcgttttttgttgtgaacatacatgctaagttcattctagttttaacatgcattactattgacatttctctatatactactatgaagagggagtatgtccgtttacttggaactcggaaaatccagtttgaataaactaatctgtatagccgcctgtgcaccgccttgctgatgtaatgacatcctgccaatgtatagcactccgagcaattgaacaagatgattcctctccttagcccctctcaatgtcgatcttctataattactacaatagtaatgtatgttttatatcccattgaatggcatggggctgggcaatacaaatagaccgccggatgtctatataaccgtagttgcatcaactattgcggaatgaggattgccaacaattttctgttagctagtcagtggtcatcactattatggcaatagaccgtcgttcagctttttacccttagttgtgaatctctaactattcagctttgttgggatcgcaggaaacccattgagcatttcttgaaagatcttgaagcaatcaccttgaatgacatttcttctactgccaagaagatcatttcatcaccccttacactggcatcatggggtgacggtatgttctaacttaatcttcatcaaagtatttccttgtgaggattatgtaatactccctccagttttttttatatgacgttggctagttcaaatttgaactagtcagcgttatacatataaagatggaggcagtactaccttttataaactaataattttggacttgtgattcactagaatgctttcttgcagttattcatgtcccgagctatgaatctgttagccagaagtttttctcaaagtaagcaagcctatcgcatggcttgcccccgacttctaaagttgcagacgtgtaactctactggtccttggccctaaccgctggaattcacaataataaattgtctagacttatttttcttagatattttaattttaagcaaataatagttactcaaacggcgatgatgctgactgtcctttttattcttttcctttattatattgatccataattttgcgtcaggctggaactatttttagttccgcggtggtgttgttgttttttgttttgttttttttttgtcgtgctgagcttagcacagctgagctgttgcgtatgtgtcgtgacttcaagtctatgcatgctgaaatcgtcttgatgatttttccattcatggtgagccgttcttcaatattttaactgagttccccaatgccattacgtattattgtcgcattttctccaaggctgaagcctgaaatacagttcttttcctttttacttgaaatctcttccctcgtttcgcatctgaccttctagtcttctagagcatacatgagccattcttccgtatcctcgtgtaattttctctgtgatctagagtagtttgtattaagatgtgactttatactttggtgtgtttgctggtatatgttggctgcgcgggtttcaatagctgacagtgtgtacgcttctacggttccattcgatggctgcattggtacggggtactctatctgtctcataaaaaaataaatttaatatagaatgtaacatatttagtactacgaatatatgtatagaggctgtattatgaatttaaacatattcttgtttagatttataataggaaaaaatacgaattaccctaaactatgacggtcgactgaattacccccctcaacaacaaaaccagacatttaacatctttaattttctaaaccggataaataaccccccttggtgctgtacaaggtggttttagtcctatatgatatccacgtggcaatgtattaatccagtcagcaacatctcaataaaatgaatattctaaaattaggtggtcccacacgtcatgctcttcccgtcttccactttcccctctcttcgtctcgtgcagcgcagacagaaagcgacggcggcagtggcgctctccagggcgggcgggggaagcggcggcgtccagggcggcgaccgcgccctccagggcggatgggggaagcgacagcttccagggcgggcgggggaagcggtggcggtgacggcgccctccaagtcggacgggggcagcggcggtggcggcggcggcgccctgcatggcgggcgggggaagcggcagcggcgacggagccctctaggacaggtgggcaaagcggcaggggcaacggcggcggtcgctgacgccgtcgcggtcttcttccccctcgtcggaaagctcacgtacgtcccctctaccggcgacgtcgtcgttgactgctcgccatctgccgttggggacggggcgacagcgacgcgcgggcgctgtcagccgccgagaggcacgatgtcccggcgttcttgcggctcgtgcccagcctggaggcccccgagctccccgcgccattgctcgccgtgcaggtgacgcggttcgtcggcggcggggacgggggcggcgttgccgtgcaacacgccgtgccggacggccagagcttctggcggttcatggacgcgtggtctgcgccggccctcggccggccatctgccccggcgccggtgtttgaccggtcggcgatcgtgcaccccatggccgctgccatggctcagcgcatcctccggaaagtgacaccagagctaccactggtaatctcatttttgtatgtgcgcatgtgcattttttatgaaaattcattaagtcatctgatttttagcgtgttctacagattttcatcgaaatttgtagctcctcactgcgaatttgttgaggcgaacatggcaacaccacgacacgactacgctagagctcgagcgccaccgcatcgccgacatcaagaacctcatcgtggagctcgacgaggccaccacatcccccgggcgggtgcggggagcagcggcggcggccgcagcgacagatcggcggcgtccccccgattccccctcccatccgcgcccaccgtcggccagagccaccaagccgtgcccgcagctgctcgcccattgacgcctaacaccaacgtcagagaagtgacagagaacaaggggttaatatgacatgtgggccctatattattttattttattttattttgctgattggatttccacgtcgacgccacgtgtatgccacgtagaaccaaaaccgttccggattgagtcagggtaattcgtccggtttcaatagtttgaggtttaatatgtctggttttgtggttcgggggggtggaggggggggcaattcatactgtcgtaaaagttcaggggtgtaattcgtatttttttctttataatactaagatgtgttatataacataatagatttgttttttatggaatgagagagtatgcgttatgccgcacaaattgtatatttccgctgcagtgattcccttcttttcttagcagtattgaatttgtcaatatgtccattcgttgaatcagaagtagtacttaatcaatgaatcaccgaaatgagcctttattctggttcccccaagtttttttgaaacgtccaatatatggtcctctccttgccttgagtttgcgacgtgacgacggcgcattgggcagaaagccgtcggctgcttaggacaagtactatgggtattcaagcacaagcctcaatatgccatataggactaaatagtaaggtggaggagagaagaaggatgagagagaaatagtcacctctcatgcaaggggcagcccctatacaaactttaataaacatgtgagagtgttagaaatattggggattgtgtggtagaggcaacctaggccctgtttggttccatgggctaaacattagccctcaccttttagccctgaattagccctcaaggatataaacaggtgggctattttttggctaaagtgaattagccccgctcaaaacattagcccctccaaggggtgctaatagggtaattttatgtggggaccataaaaagcagctctctctctccttctctctcctctctttcttctctctctcaactttttagtcttgaattagcccatggatccaaacatgccaccctaggctaatgcttagcctagcaattcatgactaaacattagctctcaaaattagacatgggctaatcttccaaacaggcccctattatacatatcacctcttaaattaattatatatgtcatgcatgaaattagatacggtagttacctctactataaaaattgcccttacgggagcagacccttttagcctttcttgttatctgtgggcgacgctacctggatttgaataagacggacggactgttagtataatactctgttaggatctaggatctattatattcgctctctttaccgatgtctagaaggatatgcttccgcgttctattcttgcgactcatcttctactacacctgaagtcttgattccagatggtggggttggcaccctattcctctgcttctcgacggtcctttgcttttcctgaacggagcgcgtgaaatggacttggctggtctgaactctgaactctacacgagcctgtgttgccccgtttaccccatccatgatgcgccaaaccgtcgaggcccaaggatgcacctcaaaacctactgcgattcataggtccaaacgtgtgaaatcacacatactatgggctaatagtaaaacacaagttttgagcttttctgaaagacagtgaggtgctgcggtaaccagccagtcggtgggcgctcatgtggcgagatgcgctgaggcgagagggacgcagccaccaatgaccaatccacgcgccccgctcgtgagctccactccagcgccgccaagtgctcgcgatgggcgcggcatctcacacctgtcgacaccaggttgggagttcgagttgggaaaacgcccggtggcccgaggagcagcgattccgcgaggacgcgcacacgctttgcatccgagagcagtgttgccatgacacgcgcgcgcgaatcaccaatgcgaatgaagaaccgtggcgtgggcgaccgtcacgttgttccctttggacagatgagcgctgatttgctgaccgtctcatctcattgccttctatgtagacaaatatatttggatgagctgatccaccatgacccttttaaccacacgacaatgcatacgcgattgtttgctttcgaacagcgtagacaatttttttttactggaggaacaacaatgtgtacaaatttgggctccttttattttaagtgttgaatctagagaacgtgatagagatcaaatgactcattttggtcatattatatggtcaaaactcaaaatcccacaattaaccatgacgaacacctgtcaatttcgatgtgagaatatcctcctgagctcaaattagccacccactattcacaggttgctactctgtgtcctaaacctgacacgaataagcgcctcataagagcatctccagcagagaccctaaatacaattcttaaacagtttttaggtgctaaggacaaaaaataaactccagcaaagcccttactatatgccctaaaataggaaggacctcaaatacccctccgcagcccttaggcctgggggctgtagaccgaggccctatcgccgtttttctacgcgggaggaaatttcctggcgtgtggtgtctgtcatccctcccgcggaatcgctgccacggcgccgatcttcgccagctcgctggttccgccgctcgtggccgacggtgcgaccatccagtacctccaccggccactgcttgtcgtccgcgtgcccgcttgcttgttttttcatggtccttgatcagttcgcacactgatgcactatatggtaaacaagaatgttctgaaattcatgaccatcagaaacatgttctaaacaatcctgctctcgattggtttatggctaactgtggttctaaatgatcatggcataaaaaatattgttctgttcctttaaagtttgtggtgcttggtaggttgagacaattaggctgcttgcaattatgcagtagttccttcaaagattattctgcagtgttgttcttttgtgtcagttgtgagttgaagtttaacttcaaggttttttttttctaggaggatttaagctctttctgaagtttctcagatagattagattggaaaaggtatagagttaattttatctattgattatacttcttatttaattgaactacgtagtgtcttgaatacttgccggtaggatttcactcccatgtttgagaattttgaatttgaattatgatatttaaaattatggatttgaatacaattgaattctatgcattagaaatatttgtatttgaattattactatgttaaactaggtgtaagcatagagtataatcagaaatacaagagaaaaagaaatgggggctaagaaatagggtctgctagtagagttggagataatttttgaattcttagtaaatggggacagccctcatttaacctttgatgactctaaaatagtgactactgatggagatgctctaagtcataacccagccatctcatcgttaatctctcggcggccggctggcagcagaaaccaccataccagaaaccgctcttctttccccttctccacgcttcgcttcgcttctctcctctcttcgccgagaaatatttaaaccgctccccaccggccacctcgtcggtttcgtccggtaagagaaaaccgtttcttttttttggcgaatcgcattcgcgcactaccaaacaccaacgcgagctcggaaagctactgatggcgtctcacatcattctgccgaaggaggaggaggcggcgctgggcgtggcggtggaggaggaccacgactcgccggcggcgccagggtaccagcatcagcaggggccgccggtggcgaaggcgctgccattctcggccacgtgcgtgcggatctcccgcgactcgtacccaaacctccgcgccctccggaacgcctccgccatgagcctccccgacgacgacgccgcctacgccaagctcgaggagggcgactacggctacctcctcgatgacgtcccgcacttcacggactacctctccgatctccccgtgagcgccgacacccctcctcttcccactcatccttgtctcgcgctggttgttccgctgccagattcgacgcctgcggtgaaaaaaattgcagtatgcagtgctgcttgagattttgatggttcttttggagacgcggatctcgtgaaagctttagatttagttctgccatttgtgtgaggtggagctttatttggatggttcctttatttttggtgtttttggcgtgtcatgccggggatgggttctggaatgagatccatttcggttgttctcagttcattagctggatatttatcaaacagaaaaagtcgcattagtgtaggacaagtacagctttggcgattcgtacctgcaattgaggttgtggcgtggatctcttaattacttgtgcttgtaggtatctggatggaggtttgatctggtagaaatagaatagaacatagcttcactttggaagtaacttctgttaattggctggctggctgccttccctggctcctataaatcagctacatgtgcatcctttgaacgtggaatacgcaacaactcatttgtttgccttcaattatattctgaaatgttgttttcaaggtgatgtcatgggggttaagctaataattttctcgtttactgtccctggcagacttttcctaatccactgcaagatcatccagcctattcgaccgtcaagtaaggcttctctttcggtttgactttgctatcccctttggtcaacctcgtcatatttattgtgaaatgttttaagctaaatgttctctttgtacatttaccaggcagtattttgtcaatgcagatgatactgtacctgaaaaggtgaaaaaaaaaagtctccactgatgttttgatgtgtagacgtaattctgaatgatactcaccctgatgttttgccatcacaggtggttgttcagaaggacagtcccagaggagttcacttccgtcgtgctgggcctcgtcagagggtaggatgccttggatatatgcctattatcatttaggggcatgcattacccacatttaggctgacacaaattctcaaatcttatcaggtgtacttcgagtcagaagatgtcaaagcatgcattgtaacctgcggaggcctttgccctgggctaaatacggtcattagagagttggtgtgcggcttgtcccacatgtacaatgtcaatgatatcttcggcatacaggtttgaaatatttccagctgacctaaataccaaaatgtattatgtggaatatcacttagtaggaattttgaatggcgtgttctgctgacctataatgaggaaatgatttcaattgtattatactcaaatagttgcaagtgcgatctgtgaattgtattatatttttgtgcaaacgactaatgtgaaatttgtgccagctagtagttttgccatgagagtaaaagactgtagcatgcacattggtgatgccaattttttaactgcacctttcctcttatttctaacatgctataagtaattctgtagaatggatacaagggattctattcgagtaattatcttcctatgacacctaaaagtgtcaatgatatccacaaaagaggtggcacagttctgggaacatcacggggtggtcatgacaccaaaaaaattgttgacaacattcaagatcgtggtattaatcaggtaggtgttgtaactatttttcttagtataataatccttattttgaattttgggtaaaatatgcctgtgtactttgtctaggtatacatcattggaggggatggaactcagaagggagcatatgaaatatataaggtaatcactatcatgagtaacttccatatcttgtagagacctccagacattgtcaaacttcttcatctgttcatgtgcactctggcagcaggaatttgttgagtggtgtgcatttggcttaaaaattgttgtatgtgcagtgtgcatatcattagaaactgagggaaaatattgttggagttttgtttttcagaactgatttttaatttgatttttccctttttcaattggcaggaaattcgtagacgtggtctaaaagttgctgttgctggtgttcccaagacaattgataatgatatagcggtaatttatgattacaagcgtttatttttgcctgcaaagaagcattacaactcttttgatactgcacaatttttctattaaagaagtactgattttttctgtacattaaaactcaggttatagacaagtcctttggttttgatagtgctgtagaagaggcccagcgtgccattgatgcagctcatgttgaggcttcaagtgctgagaatggaataggcttagttaaactgatgggtcgctatagtggttagttttctatatcagccccatatacgtctttgctgcagctgcattcttacatttctctgctcccttgtttctttaatgctttaattggataaatatgcacgtaaaactaagagaactatattttgcttatatactctaattcaagagaactgttcatgaaatgtttattttctgcctacagaatggaattcacatattcctcatgtgaatccatgatgaatttctaacttttttgttttagttatttcattatactgtccttattccttttctatggtaccttgcagggtttattgcaatgtatgctactcttgcaagcagagacgtggtaagttaatgctttatatctatgtcgttctttagtttcttcgagtcaaatattctgtgtattcatgttctgggtgcagtaatgcattggaccacctagcattcttcttctccacgaatggtacctcctattcattgggtttctctgtcttctataggactgctgcttaattcctgagtcaccattttatttggaaggggagggtggactgtttgagtacatagagaagaggttgaaagagaacaaccacatggttattgttgtagctgagggagcaggacaggatcttattgccaaaagtatagctgcagcagatcaaatagatgcatctggaaataagctacttcttgatgttggtctttggctgactcacaagattaaggtatgcactgtctatttacttgagtttgcatgggactgatccagttcgattttgcattttgttgatagtgttgcttcacatgcgctttatgcattcatcttttaaatttccactaaaactgcaagaatgcttgctgaacaccaatgcatgtggtatttgcttttgggtttggaaatataccataggaaaggtagaaattcatacctaagagcagcattacattaaacaattttaactataaaagccatactttttatatgttcgcctgttaaaagcgatgctttttatatgctcacctgttaatcaatagaagtaagtgtaggttgaggtttacgttttgtcagttcgatgttcaatcacagttaacatatttagccagctgtatctttatgtgagtgtggtcctgttcacggattgcattcatctcttgtatgtatgttctgtaattcataatagattaggtgcatgcgtatgtaaagcttacatggctctgtgctcagtgggtcagctgcctcggtgttgagccatacattgattttgtacagtgttagtatctcagtgacccattatgtttgtagttgctatttttagtatcttatggatttccaggatatcataaccaattaattaattacaagtttccttgaagatttctctgagattttttttttgcatgaattccttccaggattactgcaagaacaaaaagatggagatgactattaagtatataggtaaagatcttgtttttatgttcaattctcgatgcacatgcggagtgctagtttgaagtactactttttatatgtatctgagtatctccctatggaatgttgcaataacagcctgttatttctaatggcagatccaacctacatgatccgtgcaattccaagcaatgcatcagacaatgtctactgcacactgctggcgcacagtgccattcatggggcaatggctggatatagcttcacagttggaatggtcaatggcaggcatgcatacattccatttcacgtgagtacaaatttttgtattaccttaattttctccggttcccagattcaaacatattaccctcaacaattatcatgaattaaatattaccctttaacagttcgcatgacatcaatttttgtgttctgacaaacagagggtaacatcaacaagaaacaaggttaagataaccgacaggatgtgggcaaggctgttgtcctcgaccaaccagcccagcttcctgagccagaaggacatcgatgccgcaagagaggctgataagctagccagcaaatcgcctgtgccagttaacaccaaggagcacggagagaatgtaaagaagccggcaaatggtgagaaatagcatgcctttgatgattctttacctgtacagtagctacgctattcggctgaggccatgaaccgatcctactcaatttttgttttcgcggttcatctccgatgcgttgcaatggatacacgcgaaaaggatcttgatcgtctacgtaataaaaaacaccacctcatatttttgtatcagagaacatgtgtgtagcactacgcactttgcaagagttctgcctattatttcggtaagagaacttcttgatttttgtgttctgcaaccattactttttctctgaagctaagtttgttttccttaaaaaaggaaagtaaacaaagataagaatagaagagaagcttgccatgtttttttcaaatggccgtttaattgaagatggtcgtgggctcgtggccaactcggcaactacttcccagctgttgcatttgttcatcggaaaattgttgatgatccaaccatgagcctggcacgtcaaactttggccgttgacggaaatctgctcccgcctcccatagaaaccacggatgcctcctcgcgcgcggcgcgaaatcacgagttcacgactacacgagggccttgtggtcaccgtcgccggccaccgcgcgcgcgatctctcttttttccagccgccgtccatgcttctcctcgcgccgttgcttcttcagccgaagaagcgtcacgattcttacttctgcgcagttgatatgcagtagtttggccctcacatgctctatctttctcatttcctcgatcgctcacgctgttactcttttccatgcatgcgtgcgaccaggagaaggctccagcgacgccgtcgtccaagagccgttcgccaccacgcctacttcgccggctgccctcgccgccggcgccgtgtcgaatccggcgctaacaccagcagcagtgtccatgtccttctacgacgtgaacgctggcgagcagccgagccgagaggacgaagccccggaggaggtggtagaggccgctgtggcgaacggagcaccgacggccgtggagaagcataataagctgtactctcccgcagaaacgccggcggggagtgggacgcggccgcacccaaccgcggacgccgtcgccgagacggcgggggcggcgcccgatgacgtcgacgggtgcacgacgccgccgccgcggccggtgcacgactcggaggggtccgacacgcagagcgcggacgatcacggcagcccacagagggagaagccaaggacgacatcgacggccgggggcgtgaagcgggacgtggctccctcctggtcgtcgaggctgctcgcgttccggtcgttctcgcgggacaagaaggcgaaggcaaccgtggacgcgcggccgccggcgcacggcaaggcgcgggatgagggcgatgagcacaaggagaagggcaaggagaggcggaaacggttttggaagtgaaggtggcattgatgcatgcacagttgattttctttgattgatttgtttgcactccatgaaataagtgagggctgtgatagtgtaattgtgatattacagagtactaatatataatcattctttgatgcaatccgtgttttgtaatcctaagcctttttccactggtttggttgcagctatgttactctttgaacacatgtctggcggaataccagaacgaatcatgaacacggcattctagacgaatatatcgcagtgaaactcggagaattgctcttgccttctcgctagaggtgagtaccgagtagaacggtcgattcgtggaagcgctatcccgcgtaacagcgccaatgaccagcgtgtgtcgtccttcgctttcacttttcctttcccctccccagcatacatgtgtagtgctcgatcaggtcgccagcgaccagcctgatcaaggctgcaggatatgaaggtcactcgtcgctggacaagatgacagtatagaatttctacttttcatgatggtgcagggggtagtagaattaatctccgaacctcgccagccaagagcgcggctaactgaaagtctgaaaatcaatcaagcctcagagtcacactggcaccccaccccacgccgtgatgactaccttcccgtccccaccacctcctcctactccggcgaagcggctgcgcgacagcgcgaggagaacccgtccgccggcacggcacgcgcgctcgctcaccgggagcgtggcggatcgaagcggaagcgtgctgccatgatgtggtgggtgtcagcggcacaaaaacggtatgggcatttgcaaatttgccacctgttttttcaatattgcaaggataccactcgaatgataattctagtggtatttttataattttctagtggcagttttgtaataacgatttgtagtaaatttgcaattgcctatggtatttgacgatgggttgggggttcagggaattgaactccgaccccacaagattgatttactacgagtacatgttaaggatggttgggtgttgggggaaacttcgacccccactatgttatgagaatagggcatgattgatttgatttgatttactctaatttgatgcaattctttcatgttaagatggttgggattggggaatcaaacttcgactaggttgtgacatgcattgtgcacaattgattttctctgctttgatgcaatcctattatgttaaggatggttggtttgatttgacaattcatttgagactaatcgcaataaaatttgtgttaggaccaatcgaccaagtatagcctgatcaattacagtggcatattgttcaaatatatcttacattaaacagctaaaacatataaaacccttctccagcaggcgaaggctagcccccctcccccccaaaaaaaaaaagaagagagagagagagagagccagggccacgccatgaagggcgagaaaccaacacttatcaagccaataagttggaactccgttactttgatccatacttggtggacaacgttagctagtacctcagagatgcctaggaaaagagtctcctccgtgttgcttaggagatatggaaatatttgatccatacttggtggacaatgttggctagtacctcaaagatgactaggaaaagagtctccaccgtgttgcttaggagatatggaaagaaagatatgacaacgttggccagtaccttagagatgactaagaaaagagtctccaccgtccgtgttgcttaggagatatggaaagaaaggaatcagagtgtttcaacattttttttaaaagtttttttacccgacttctatatccaaccagatatattcagtttttttttaaaaaaataggaacttagttacggagatttgaactcaggaccttggggtgccttttttttttttttaagttaagaacgatttgaactcagaaccttcggatgctacttaagtcactgcaaccactaggctacatgctctttcacagagtgtttcacaannnnnnnnnnnnnnnnnnnnnnnnnnnnnnnnnnnnnnnnnnnnnnnnnnnnnnnnnnnnnnnnnaagnncgttcaatccattnnccacat

SEQ ID NO: 6529 - DNA, 873 bp, Oryza sativa
  unsure (1)..(873): unsure at all n locations
aggcacaagatcgcccatgggtgccagatgaagatagagaaaagaaaggtgaaaaataacttgttcgtcgtcggaagatccttttggnatggtagacgcaggcggtagctatcgggaagcacagcancgatggtctcacgatttaggccttgccacccttcgccgcccccattcgtgttagtccatcaacaacggcacttgacgggcacgatgtgagtagcttccgtactatcgatctaacaagtgcgcggctaggcccgatgatggcataggggctacagcatacccaagataaaggcagtcttggaacaacagaaggaagtcctcgaaaaggtgttgagcctctagttatttccaatgccaagcactacctcggccacgagctctatctcctctttctccattgagtatcgccgccttctctacatgcaccaccggcgagctcttcctacacttctcctctccaccaagataggatgcatagagactgagtggatgagtcaagctaggagaaagtactcctgacatgtgggtgtcacataacttgttttaatttttctaacctactaacactaacacgcgaggtccattattttttattattcttgtgttttccgttatgtatgacgaaaccaatgtccaaaccgtgtcttacagtagacgataagttgacccggttttgtggatgagggtttcgattatatctcagctcttacttgagggaggtaaaataatcttcttcctaacaagattcatcatcctctatctgcggttaaacagcacacgaccgggnnnnnnnnnnnnnnnnnnnnnnnnnnnnnnnnnnnnnnnnnnnnnnnnnnnnnnnnnnnnnnnnnnnnnnnnnnnntcaan

SEQ ID NO: 6530 - DNA, 667 bp, Oryza sativa
  unsure (1)..(667): unsure at all n locations
gaagtactctactcnnnnnnnnnnnnnnnnnnnnnnnnnnnnnnnnnnnnnnnnnnnnnnnnnnnnnnnnnnnnnaatgaaaaatttcattgtagtatttacaaacagaatcgatgtctccttgaacaagacgactctctgtatatggcagagaacgaaatcctcttacatccgtgacaggctaatatgcttgtcaacaaaatcctcaacgaaaaaagaacagagatgaaaccctgaccccccaaaaaaaaaacatttcgatactggtcctactgatgatatccgcttttgtttacaggaattgggggaggcctatagagcatgcttttggggttattcctggccatcagatttgcgcaagaacttccagacttcttggctattgatgggctggttgcgccaggtatatgacaagcttcctggttcccatccagggctacatagcttttggatgatttgatcttcttgtatggattctccctcttgcgtagattctctaggcatgtcacctcagacatacatgccaaagattgagactttccgtcggagtatttggaatatccttttctgcaaagaacaacaaaacacttgccctgtgagaaaaatttccctttgctagtccatctattgatactaaaatgcaactcttctttcccaggaacttact

SEQ ID NO: 6531 - DNA, 1139 bp, Oryza sativa
  unsure (1)..(1139): unsure at all n locations
gatgatgacgnctgcctnnnnnnnnnnnnnnnnnnnnnnnnnnnnnnnnnnnnnnnnnnnnnnnnnnnnnnnnnnnnnntactacgacggaaagtctcaatcttttgcatgtatgtctgaggtgagatgcctagaggatctacgcaagaaggagaatccatacaagaagatcaaatcatccaagagctatgtagcactggatgggaaccaggaagcttgtcatatacctggcgcaaacagcacatcaatagccaagaagtctggaagttcttgcgcaaatctgatggccaggaataacaccaaaagcatgctctataggcctcccccaattcctgtaaacaaaagcggatatcatcagtaggaacagtatcgaaatgttttttttttggggggtcagggtttcatctctggtcttttttcgttgaggattttgttgacaagcatattagcctgtcacggatgtaagaggatttcgttctctgccatatacagagagtcgtcttgttcaaggagacatcgattctgtttgtaaatactacaatgaaatttttcattggactgcctggggatgatgaacagccttctgtcgaaatttaaagcatatgtctgcagtacatccaattgccttggttaaaagaagaagaagaacagcttaacgtttagggagtcctttggtcatcaaagatgaaaacaaaaggaattcaattctataaatattccagacacacaaattgtagcatggctggtcatgaatgtttgccaaaccaaaaaatgaaccgaagcctaatagttcaaaatgttttgactccaacagggcttcagatcacattccagtattatcttgtggatagatggtgatcaagtcttgttatatggtgaatccatggcactggggagaaccaaagagtggataatcctattccaatacgccttagangttaagcaaccttgtttttattggaaaaaaaaaaaaaaggggcgtagtcgtcaatagcctgtgcgactgcatcttcatcattagtggcaccaattatatctgccactgcttatgttntcttagacccatgtgcaagcgcaacaccccaatgatgcttagttgtaggcattctatgtcattntcttcattcccgatagccatt

SEQ ID NO: 6532 - DNA, 1199 bp, Oryza sativa
  unsure (1)..(1199): unsure at all n locations
cgatgatattnnnnnnnnnnnnnnnnnnnnnnnnnnnnnnnnnnnnnnnnnnnnnnnnnnnnnnnnnnnnnnnnnnnnnnnnttctattcggtaattatcttcctatgacacctaaaagtgtcaatgatatccacaaaagaggtggcacagttctgggaacatcacggggtggtcatgacaccaaaaaaattgttgacaacattcaagatcgtggtattaatcaggtaggtgttgtaactatttttcttagtataataatccttattttgaattttgggtaaaatatgcctgtgtactttgtctaggtatacatcattggaggggatggaactcagaagggagcatatgaaatatataaggtaatcactatcatgagtaacttccatatcttgtagagacctccagacattgtcaaacttcttcatctgttcatgtgcactctggcagcaggaatttgttgagtggtgtgcatttggcttaaaaattgttgtatgtgcagtgtgcatatcattagaaactgagggaaaatattgttggagttttgtttttcagaactgatttttaatttgatttttccctttttcaattggcaggaaattcgtagacgtggtctaaaagttgctgttgctggtgttcccaagacaattgataatgatatagcggtaatttatgattacaagcgtttatttttgcctgcaaagaagcattacaactcttttgatactgcacaatttttctattaaagaagtactgattttttctgtacattaaaactcaagttatagacaagtcctttggttttgatagtgctgtaaaagaggcccagcgagccattgatgcagctcatgttgaggcttcaagtgctgagaatggaatacgcttatataaactgatgggtcgctatagcggttaggtctctatatcagccccatatacgtctttgctgcagatgcattcttacatttatctgctcccttgtttgtttttttaaattgacgtttttaaaatctggcggaaatttaaaaaaaaaatttttaaattttttggggggccccccccgtaaactagagaacatattttgttatatactctaattcaagagaactgttcatgaaatgctnnttnnnngcctacaaaagggaatnnacataagtctgagtgagaatccatgatgaatttctaacttttttgagttaat

SEQ ID NO: 6533 - DNA, 784 bp, Oryza sativa
  unsure (1)..(784): unsure at all n locations
cgatagtatnnnnnnnnnnnnnnnnnnnnnnnnnnnnnnnnnnnnnnnnnnnnnnnnnnnnnnnnnnnnnnnnnnnnnnntttgcatgaagcagcttagcatttgtaggactgtagagtaatagctctcacttggacaaaatgcaataacaaaagacgtccccacacctgccactgcgatggtgccaaaagtactctaggcctaatggatcggacatgatctaatgctgcttctggactcatgctccgatatttaatctgcaagacaagtaatctgtcatcagcaaaatggagcgaaagatatacaatattgagttgctttaattattgtttatcctaccagataacacaaaacaatagtcgtgctacgccctcttccagctttacagtgaacataagtaatgccaccttctgatgcattccctgaaaaaaagagccaaagttaatatccagttgaggtcagcaaaaattgtctgcataaatggctacaatgcagaaagtgtgtaaaagcaggtttcctttcctgccagcagatatattaataatttcacttaataatcatggtgtatggtagtattatattgcactgacagctaacagatccttctcatcccatggttggaacttggagatgggatgtgaattagaacatgtcgctgcaacttaaatttgaacacctactacaccaacaactaattggccatgatcgcaaaccaaattccatatncattagtttgacgcagctatcacctgcctcacaaaatcagagntgactgcaactagct

SEQ ID NO: 6534 - DNA, 1712 bp, Oryza sativa
  unsure (1)..(1712): unsure at all n locations
acggcattgaactgcacgtcnnnnnnnnnnnnnnnnnnnnnnnnnnnnnnnnnnnnnnnnnnnnnnnnnnnnnnnnnnnnnnnnnnnaaaaaataaatattccatactacagagtcatacaggcattaaaaaaatcgaagtgtaaaagtgacacacttaggaccatgttcaacaaagggcatgaagccattaacattggccacctttaggactatatgttgatatgttccacaaagggcatgaacttacggtggataaaatctatggcttgacaaatatcctggagggctggtgcaaacaggtagtctcttgtgggaataataaggtggtcaatcccatgggcctgcaaaagtaggacttgttactcgtcaggaggatcttgcattgttgattgcaaacacaaaataaagtgattgaaaatcccctgaatgaatcaaatgaataaaattatgctttaaactcaacgagaagatgtctgacaacaaaagactacatcatacactctcacaacgagtaaataatgaagaccaagtctttccttctgattgagtagcgaatcaaggttcacaacacaaatgaaatcatgtactaagctaggaaatcaagtgataagagattttacctggtataaagatgttgggaccagggtctcataagcctcattcaatgttacaactccctgaactccaagttgcttcaaacgtggaacatcacttgggaaaggaacagcacctagcaaaatatactgcgggtggagattggacaaattagtcggtgagatctttatagcacagactcaattaagagtactaaattatgtaaaacaacagtgtaacaaagaacggcaactaaagccatgtccacaaatccctccacatgccaaactaaacatcatatgagacttactgcagtctacactagtaatttaccaaagaacaggccgaaataacgtacgcacttgaagataattactcaaatttcttagacaaaatggagccttaatggaacaaccacaggaacacaatcactgctcacggggaagcgaagggtattacttcagggggaaaaaaaggcaatgaaactctccccgtaatatccaagcataacaaaaccaacccccaagtgaacaaatcccacagagataagtcaacagccaccctaacagtcacgagtaaaccaaaagcgaagcctataatcgcgcgaggcttgtagagagtttaatcacgcgagtcgaattcagacgcaaggaaagagggggcaaacccacctggtcgactcggtcccaccaccggaactccgcctcgaaccggttgcgcagcacgttgtagagcagcgtcgggtagaacagcaccctggcgccggcgccgacgagcgcacgcttagcgctcagccgcgctaccaccacgccgacgaggacgctggcctcctccaccaccacctgctgctcctccttcccttccgaccgcaccccgttacacttctcccccccaagacattccgccttaaaaattcccccttttcaaaaatttggagcccccccccccccccccccctttttttacaaccctctacttacgccaccagcttcaaccctagcgccgacgagacgactccagcgccctctcgcccttccatagccggnngatccnaattnnnnnnncnnaaganaaaacgcacagatcgggaggtnnnaatagctaantgcggattaa

SEQ ID NO: 6535 - DNA, 672 bp, Oryza sativa
  unsure (1)..(672): unsure at all n locations
cgcgtagtaacgacagcctnnnnnnnnnnnnnnnnnnnnnnnnnnnnnnnnnnnnnnnnnnnnnnnnnnnnnnnnnnnnnntgctccctcagctacaacaataaccatgtgggtgatctctttcaacctcttctctatgtactcaaacaggccaccctccccttccaaataaaatggggactcaggaattaagcagcagtcctatagaagacagagaaacccaatgaataggaggtaccattcggggagaaaaagaatgctaggtggtccaatgcattactgcacccagaacatgaatacacagaatatttgactcgaagaaactaaagaacgacatagatataaagcattaacttaccacgtctctgcttgcaagagtagcatacattgcaataaaccctgcaagggaccatagaaaaggaataaggacagtataatgaaataactaaaacaaaaaagttagaaattcatcatggattcacatgaggaatatgtgaattccattctgtaggcagaaaataaacatttcatgaacagtgctcttgaattagagtatataagcaaaatataggcctcttagttttacgtgcatatttatccaattaaagcattaaagaaacaagggagcagagaaatgttagaatgcagctgcagcaaagacgtatatggggg

SEQ ID NO: 6536 - DNA, 878 bp, Oryza sativa
  unsure (1)..(878): unsure at all n locations
gcggtgagtgcagactcgtatgggcgaanncgagctcggtaccctggccgtcatgggagcggactccggtgctccactgtagtggatgggcgaaccggaataaccaaaatgacgagaaggacgtgaaggctttgatgggcgcgagcccagtaagagcaacgtcaatagccaactattgactcaaaacatctaaagccaatctaataactcattcatacaataattaattataaaaatatgctacaccattaatatctggtctcacctctcatacacacgtaacatcttggagtccgtgttgcagctggctacaaatctgtagcccgctttcttctctcttctcttttcttctcgatatatggttatagccggcttatagcctgctattgtacatgctctaacagtggatgccttagggcacccacaatggttatctataagctctctacaacagatccatgtcagcatattttcctacttagaagagattaaatgaagagatagagcaaagctatctactaacatggaaatagtttatagagaaaaacaaggcaatggattagagagctatagatacccatgtagacataccattgaagtggtttattattaatttagtctattgctgagatgtacatattttatagatagcacattactttttttacaccaatatgtncggggggtggcccccttccctttttttaaaatttggggggttttaaaaaattttttttccgtgagcattgaacggattcattcatgccgcgtgcgaattctgcacactgtataactgcntgcgaatcatgtgtgctaagcatgtagcatactgcgagatgttttgcttcagatagttgcgggcagggttcgctaaaatg

SEQ ID NO: 6537 - DNA, 809 bp, Oryza sativa
  unsure (1)..(809): unsure at all n locations
cgagcccttgaatgcatctcaagtctnnnnnnnnnnnnnnnnnnnnnnnnnnnnnnnnnnnnnnnnnnnnnnnnnnnnnnnnnnnnnntggggcaatggctggatatagcttcacagttggaatggtcaatggcaggcatgcatacattccatttcacgtgagtacaaatttttgtattaccttaattttctccggttcccagattcaaacatattaccctcaacaattatcatgaattaaatattaccctttaacagttcgcatgacatcaatttttgtgttctgacaaacagagggtaacatcaacaagaaacaaggttaagataaccgacaggatgtgggcaaggctgttgtcctcgaccaaccagcccagcttcctgagccagaaggacatcgatgccgcaagagaggctgataagctagccagcaaatcgcctgtgccagttaacaccaaggagcacggagagaatgtaaagaagccggcaaatggtgagaaatagcatgcctttgatgattctttacctgtacagtagctacgctattcggctgaggacatgaaccgatcctactcaatttttgttttcgcggttcatcttcgatgcgttgcaatggatacacgcgaaaaggatcttgatcgtctacgtaataaaaaacaccacctcatatttttgtatcagagaacatgtgtgtagcactacgcacttttgcaggagtctggctattatttcggaaagagaacttcttgaattttggggtctggaacccttactttttcttttgagcttagttcgttttccttaaaaaagga

SEQ ID NO: 6538 - DNA, 1360 bp, Oryza sativa
  unsure (1)..(1360): unsure at all n locations
ctgccccccatggatcgacttnnnnnnnnnnnnnnnnnnnnnnnnnnnnnnnnnnnnnnnnnnnnnnnnnnnnnnnnnnnnnnnnnntgcgataggcttgcttactttgagaaaaacttctggctaacagattcatagctcgggacatgaataactgcaagaaagcattctagtgaatcacaagtccaaaattattagtttataaaaggtagtactgcctccatctttatatgtataacgctgactagttcaaatttgaactagccaacgtcatataaaaaaaactggagggagtattacataatcctcacaaggaaatactttgatgaagattaagttagaacataccgtcaccccatgatgccagtgtaaggggtgatgaaatgatcttcttggcagtagaagaaatgtcattcaaggtgattgcttcaagatctttcaagaaatgctcaatgggtttcctgcgatcccaacaaagctgaatagttagagattcacaactaagggtaaaaagctgaacgacggtctattgccataatagtgatgaccactgactagctaacagaaaattggtggcaatcctcattccgcaatagttgatgcaactacggttatatagacatccggcggtctatttgtattgcccagccccatgccattcaatgggatataaaacatacattactattgtagtaattatagaagatcgacattgagaggggctaaggagaggaatcatcttgttcaattgctcggagtgctatacattggcaggatgtcattacatcagcacggcggagcacaggcggatatgcagattaatttattcaaactggattttccgagttccaagtaaacggacatactccctcttcatagtagtatatagagaaatgtcaatagtgatgcatgttaaaactagaatgaacttaccatgtatgttcacaacaaaaaacgaacactacacataaagcaaactgttgttgttcactcacacctgaaggatcaaagctctatgcttgtgtaaatactgaaggtgacatctcaatccacaacatatatttgtaggtttcactatgatcttaatgacatgctaaagttcccgttcttaacatggtcaggacacatcatgattgcacaatcatagctcataaacgatagtgaactgcaatggcccttaaaaaggttttgggggggncaaaacatcacggcttaagaaccatgtgaggtgactttagacgctacgttaccaatgctggtgcaaccataccttacccatacgcaaaatctggctccctatgaattcagatgctacgacctgcagtgaagaaaacatagtgtcatgatgcaacaggacaca

SEQ ID NO: 6539 - DNA, 821 bp, Oryza sativa
  unsure (1)..(821): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatgttgaaacgggagatagattgtttgttgtcccacgatgagaagaagaaacctgcatcccgatacatttagcggtcactgattctctctagcacttaccgttttcctgttaaatttattcagataacgcagctgaagtcctgtaaatcctttaaccaacatttttcgtgacggtgcgggatgctatgttgaatgcacggacgccacattttcttttgcctattgcattatattattttgactttttaagctgttttctttgcttgtctgatctgtctagaagtgttgggttgatgagttatcgctaactcaatacacatagtgcttatatcatcttttcagattgataatgttaatacgatattttgagtttttttgggtaaggttcacctgaatgtttaaaacaactattttaatgtaactattatactgcaatttgattccaaagggaaagggtgatgtatgacagtataagttaagctgcaaagtttacttctcggagatttcttttcgcaatatgatcttgctagtttggtttttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6540 - DNA, 867 bp, Oryza sativa
  unsure (1)..(867): unsure at all n locations
ctgccccttgtgatcgccagtctnnnnnnnnnnnnnnnnnnnnnnnnnnnnnnnnnnnnnnnnnnnnnnnnnnnnnnnnnnnnnntggcctgggctggcaagggacagttaagttattacagaaatgaagaacttgtagtaccttccctgtggcaataactatgtttactccccttgaccttgcttccctcagagcttctgcattccttgctgtaacttgacttttactgttgagcagtgtacctttttaaattaaaaaatatcactggtaaatataaacacatgtctagagtagtgatatatgcaaagagcaaatgatataccatccatatcacagaagatatatttgaattttggtctataaaatcttaggcttccagctctttttagaccacttgtcacttgccctgtaaacattcttaggcagcaatagctacattatcatcatgtgtgtgaaagcaccttttcaagatcaaaataatggaaaggattataactacagaaatctcaaaaaagcacaccatccgatgtttctgtatgacgcttgcccgaatcaagaacactcttagcaagatttttccctttccaccttagactcttcaaaatgagctgcttctccttctccatttcaactgcagactcatgacttttttggtgatcaaaacccagaagacgtagaattacacgaaccccatacagagtaaggtaacagtcaatttgtaccatgtgaattgccgaacctaatacagagtaagtgaacagacaattttgtaccatattatctgtgtttcagtatgtgtngaataacatangattaanggattttgggnnnnnaccnnnnnnttcaccaagaaaaagatgcagtag

SEQ ID NO: 6541 - DNA, 734 bp, Oryza sativa
  unsure (1)..(734): unsure at all n locations
cctgccccctttgttgnnnnnnnnnnnnnnnnnnnnnnnnnnnnnnnnnnnnnnnnnnnnnnnnnnnnnnnnnnnnnnnnnnnnnnnnnnnnnnctaatcagcagaatcacttatttctctttcaaagaaaatcagcaaatagaatctcaggggcaaagcgcgctagaccgngcatacctcactcgggcgggtcatgctttgtcccgcctcgagatggatcttctgtccggatgcgtgtatatcatctgctgctgctatccttttggcagcttctgctctgctctgctgccttgctacaacctgtaaccatgtggatgttctctttcaacctctactctatgtactccaacagtccaccctccgctttcatattatgtggtgactcgggtatttatcagcccccctatagcagacagatgaacctcctgcttaggtggtaccattcgcggcgaagaccatgcgtcgaggtcctttgcattactgcgcccagagcatgaatgcgcagactctttggctgcgagaaactaacgatcgacctacatattaagctttatctttccacgtctctgcttgcgcgagtcgcattcattgctatgaaccctgcacggttccctagggaaggattaatgaccggctcatgcactaactaataccctattgttgcaattcattatggattcccctgaggaatgtgtgatttcctttctggtggcagaaaataaacatctcctgg

SEQ ID NO: 6542 - DNA, 778 bp, Oryza sativa
  unsure (1)..(778): unsure at all n locations
gtgtccagtgacgtccgcttgttannnnnnnnnnnnnnnnnnnnnnnnnnnnnnnnnnnnnnnnnnnnnnnnnnnnnnnnnttgcaggcaaaaataaacgcttgtaatcataaattaccgctatatcattatcaattgtcttgggaacaccagcaacagcaacttttagaccacgtctacgaattttctgccaattgaaaaagggaaaaatcaaattaaaaatcagttctgaaaaacaaaactccaacaatattttccctcagtttctaatgatatgcacactgcacatacaacaatttttaagccaaatgcacaccactcaacaaattcctgctgccagagtgcacatgaacagatgaagaagtttgacaatgtctggaggtctctacaagatatggaagttactcatgatagtgattaccttatagagnncangggggnagttgtgagttccannaagagaggtgatggttacctggatctngttccccncccttttttacccaaaattcaaaatanggattattttacctanaaaaatattttccacacctaccttattaattccccgatacttgaaatgtgttggtttccataagagcccgcggaaaaaaggagccccccggcgtcatgaccaccccgtgatgttcccagaactgtgccacctcttttgtggatatcatngacacttttaggtgtcataggaagataattactccaatagaatcccttgtatccattctacagaattacttatagcatgttagaaataagagga

SEQ ID NO: 6543 - DNA, 773 bp, Oryza sativa
  unsure (1)..(773): unsure at all n locations
gggagcagtgtgccagtgtcgctgtccaaaccatncatgcaagcagcaaantatgaggtgaggtggtgagtgccaaccacgcgagagcagagcactgcagccgcgtcacgncggctcgcgtggtggcggaacaatccatccatcgcctcccaaggggaataccccaaaaaacccccgcggtgttcccagttccaaaccnccgtgcaagtgccgtggccccacacnccgcccaatcccaggctcccagcgcctggcgcccacggataccgtcacccttcccgaggacctcagccgccgcgggcccanggggcatctnnnnnnnnnanncttcccacggacnccgcccaggtgggcccccagctgcaggagcccccctttcagccgggcccacgtgaacaccagcccgcttgtcggccagcgcgagccctgacgccgagacgacgccgagaccgcgggggtcccacggggcgcgtgcgaggtggcaggtcgtgcgcctgacgccactggcgacgccagctcgccgcggtccgatccaatcatgcggcctcgtagccgcggccgtcttctttatcgggagcctataccgtatagcgctgatgctggccttccgatcggcatctgacggatagaactgtttttttccggttacagtgaacgattcgcctggattgggaatatacggccgggattannnnnnnnnnnnnnnnnnnnnnnnnnnnnnnnnnnnnnnnnnnnnnnnnnnnnnnnnnngaggggatcttaaantggcgcgg

SEQ ID NO: 6544 - DNA, 766 bp, Oryza sativa
  unsure (1)..(766): unsure at all n locations
cgcggccagtgaaccccgcctgnnnnnnnnnnnnnnnnnnnnnnnnnnnnnnnnnnnnnnnnnnnnnnnnnnnnnnnnnnnnncacattcgctgcgaagtgtgtgtagtttaacttcttggaattaacacgggagttcggatttacgactatttatttagtggtagcatggtaggtggaatacccatacacaatgaaacactcacgatgacttcatcaattataaaactagaggatgccccgtgcgttgctgtgggacttggttaacatcaatttgttagataggaggtacaatctcaagaagaaacagaagaaacaaatagctttcttggagaaattctttttaacagctctatccaaaatttgtagataatttaggtagcacatgtcaactgaaggggcgttcagccataaagctcttttatacggattgacgggctggatacatgtagatgtgtgtggagatggaccaatttgttcatgtgggctacatttggcgctgaggaggtgaagagactcactcggtgactaatgggttgggctctatgctgcattccatccaacgtctgagaagcgatctaaaatgggggatgtattcataaaaaaaagccaacggttcacaatttgataataatgtggaagcatgaggtttgagcttttggccttaactttataaaaagaagggatatgtcagtctagtcatccgaaggtattaataggatgtgatgtgcatatgtgcattgatagggtgagcgcgcgcatagtga

SEQ ID NO: 6545 - DNA, 784 bp, Oryza sativa
  unsure (1)..(784): unsure at all n locations
cggcgccagatgagtatcgcctcgtattaagccnnnnnnnnnnnnnnnnnnnnnnnnnnnnnnnnnnnnnnnnnnnnnnnnnnnnnnaaaaccagtagcaaatttgcaaatgccctctgagacaaaagatactcaacatattccagggaatatacgctgaagctcgaaatcccgttaaggttttgaaccaaacactccatcctacagaaacgaaatttgcatgctcatgcggagcaaacaaataatgcatgattttttgcgtaagcctccaaaactcgtactgcagttctccaaataaatgggcaactcactgatcactactgacgatataaaagagcccgaaaatctgcgaatcggagaagagatcccgcacggacacggtgggccggagcaaaacacagaccgttggatacgaaatggacggcccgaacgagacccaggatgtaatacgcagcgcaaaaccctnnnnnaggngccaacgagcaaaaccccccaaatgggggagaaccgatttcagttcaaccaatgtttttgcccgcgcccggcgcggaggagagggttcctcggaagtgggctcgacgaacccattggtcaaaacccggggggggaaaagaagaagggacgtgtcgcgcgccctcccgttcgcctcgcgctcgccgcagctcggcgcggcgctgatacgctcggcgccgatgcgctgcccgcccctccccgacggggagcccaccgcctcgctgctctcctggcgcgggttcacgccctcctcagagccctcgcgctcggg

SEQ ID NO: 6546 - DNA, 780 bp, Oryza sativa
  unsure (1)..(780): unsure at all n locations
ccgcccattgagacccactctttgagacnnnnnnnnnnnnnnnnnnnnnnnnnnnnnnnnnnnnnnnnnnnnnnnnnnnnnnataacttaagcaccttacatcggagataatttgtgctactcctattttaaacgtatcctcagctcggcgctggccgaccagcggtccagcagtactatactattgcaaattgtaatgccgaacttatcaggcgagctactagttcaaagcttcccgtctagaacatacgtttacgtagggcagcaacttgcgaagtccatcctcgcgcgttttggctctcctcaagggcgtttcagtggggagtacggctgacccgattgttgagacgagtggcggtttcaactctcaactgacggaaggggagacgcacgcatcgtcatctgaccggccgctcacccgatgagnnnnaaagaccagggggagggggggggagagggaggagtggggggagaagatcagtgtccncccctnnnncnnnnctgnnnccgcccccnnnnaagggaggaggggaggaggaggttgccgtgcccagcccttctttttaggatggatttggtagaatggcagccacgtatatggggagagaaggagagaaagaacccccgcctgtcagatgcatggagcggatagagtcgatttctcttgtacgagtagatcacggaaggaatgatgatatttttcgtacataggcctagagaatttttagggcgtttcgtactggatgggtcaatgtatggagcactgtgttttaataagac

SEQ ID NO: 6547 - DNA, 553 bp, Oryza sativa
  unsure (1)..(553): unsure at all n locations
gcgatcncnnattgaanttttgattccagcttggtaccccgccttccgctgatgccgaccccaacctcgatgcggccgccactgccggcgacgtcacgccggcactgccgacgacgtatgccgatgccactaccacgtcgccgtccccgccttgacatgccgtcaggctgagccacaccgtcgagacggcacgccaccgtcacgccgtcacggcgtcgacacgccgtcgtcgcgccacgccggcacctgtgctcaaagtctgtttataaaaattttttttggtggcggggggccccccccccccggctatgaggtgtttgtttcgatagtgaaccaacgtgaactttacgagaacaacnnnnnnnnnnnnnnnncnnnnnnnnnnttccnntgcgccgcctgannnnnnnnnnttnttttnnngggtactatcccattttnnnaatctgagggtatnagaacccnacgtcaccaacgtgaccttaacttaattntactaaccttaccnaattnccctccctaactaaccntnccttaactnnttttactccct

SEQ ID NO: 6548 - DNA, 934 bp, Oryza sativa
  unsure (1)..(934): unsure at all n locations
agggtacattgctcggcttgcccataaccgaggggccgctatttgaataggttttactctgatcaagggtgtacatctttacccacaaaacacatcttcctcaggtgtaaccacgtgccacataccaccacgggtatacggacggaagacgttacatagttcccaacccatcctagccataaacaagagtgccgacccaaccccacctacggcggaaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaaccacctaatgttgcctaattaatcagcgaagcatctacctaaattcatactagtggaaccataaatagagtacccactagttggggtttttgttatcctagggtgaacaaggtaataataacaatagcaataataatgtcataacaaaggtaaataggcatggctaaataaaacagtgataacgcgggaaattaaataaagcggntatgcattaatttaattaaaatattttataaactgggattcatatgctcaaggatgatgtgacttgccttgctcagagagacggnct

SEQ ID NO: 6549 - DNA, 1205 bp, Oryza sativa
  unsure (1)..(1205): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctttatttcgccggtcggcctatgtaactatgaagtagttgtgatttagattattttcgtcttaagtgtattttgctatgtatttccatgcttaagatgaaagtgtgaatctagtgcacatcttgggaagtagattcacatgagtatgtgttaagaatatttgagatgttgtagatctttagccatttttgtcaagtctcctgaatgtgtaacacatctggtcgccgccttcgagtggtttgacgggcacatctcaggctgaagttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcccagtgtattaaatgaacccccccccccgcggggagaaggagtttttttttttggaaaacttttcccctttcctgatttactgatattttttgccctaggacccctcgctcttggggtaagaaatatct

SEQ ID NO: 6550 - DNA, 1098 bp, Oryza sativa
  unsure (1)..(1098): unsure at all n locations
ccttaatttttttcctccatgaagcatttctcccaatataccccacacacttggccaattaatgttttgaggaatgttaagtaatctccttaagtataaggtttttgcctaataaaaaaatgtgaatccaagtttcccatgtttgatcctacccagtcccacaattccaaacccttagagtgggatccaaaaaagcaaatttggtagggatttcatattattacacttggcgagattaagtaaatcaattgaggaacttgcttttcttttgcaaattcatttgaaacttgttgaaataagagtttgaataaaaatggggtgattgggctcctaattgttgtttttcctttcaccgggcaaggcaagaacaaacagagtctcgtgaaaataaggggtaagggtaagccacccgtgccaaagattatttaaatgtaagagagagtacatatcccttgcacctgtatctttgagatatgcagcatagtagcaactcctgatcaacaagcaagtctttgtttcctttcttccttcactcgggacgagcaaaggttcaagcttgggggggggggggtttgacggtcgttatcgatcagtttcgaccgtcaatattaccaaaatagaagagaactagtgatgcttgcgttgcacaaatatgatagaataataatattctactagtattaggtctactaacattttgcagagaataacaataaagtggagaagaatcggcatcaactcaaacgataaatcaatgagacgatgtcgagaatcagacttatgcatgaatgggcctagaactcagagttgacacgtcaaactgggctaaaattcacaagtctatataaaggagcaacagaggaggccgccagccgaaaggtgggctggttgggccagcccctggttcggccgaacctcccttacctccgttggatccaggttttggttgtacggtggagatgaagccccaatgacggttggagggtattacctaccattccaaccgtcacaaccatcatagttcggctataaaaggagctcctnnnnnnnnnnnnnnnnnnnnnnnnnnnnnnnngagatacgattctaagggggggc

SEQ ID NO: 6551 - DNA, 1863 bp, Oryza sativa
  unsure (1)..(1863): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcacagtgcacctatgtgtggatgaaaatggaaaactgggagaaataaaaattggatggtgactcatttttgtatgaccctcctccttttactttattttggaaaacatggctttttcctatatttatctttttttttcatgctcgagaatactttatctcattcccttttgagcgttgttttcatttttctcctttttagctcatttctcattggcatcaaccattggaggagataccataaatgtatggagtctttatagaaattcttcttgtggataatgtcttgccagaaacaacgtaccgagcgaaaaaatttatccatctcctgggccttgagatacagaaaatttacgctgacgaaataattggatcctttactggggtgattatgcggatttggaccaatgtccagtatgcgaggcttctcggtataagtgtggagacattggaagtaatggtacaatgaataagaaaagagtcctggtgatggttgtatggtattttctaatcattcttcatttggaacgtatgttagcaaacaagaagattgctaagttgatgcgatggctgttggtatttcttaacgacattactagaaatataattcccagcaatggcgcataaatacttctggtatattatggttacagagttcatccctaagcgcacggatataccattgtagcatttcaacccgagagtattctaagggtatcgtatttattttatcccatgggaaaatcatgtagagagagcttgactaataatttatatattacttgtgataatcatattctaaacaggggttaagataatccaagggtagagtgacacacaagcatgaactactcatcctcataataaatcatctaagctaagtggaacgaaaagagaaagaaaatatgttcctatacttctattatacatagtatacatacattctagttaactgatatactagctaataccctctatccgatgccctcctggtacttcgagaagccaccgctgactgctgagttccttacgacagcccgtcatgaccatacaaccggagctaaatatggaggaataccctccccaggaaattaacttaggattatatactggcgtgggggaatacccgtactgagctgtcaccatcaacggcccacctctcatctgcaatatataaccccaaataatggtatcccgtaatctagacaccatgtctacaataccagaagcgcgtctaatatcctcatccccccatagagtaattgcataagcaaacattatacccgcaccaaagcatctcccagataagctagcggtatattcagtatcacatggacataatgtatagtnggctgtcgggtgcgaagcgagtgtctatcaatgtgtcacacggggggggtgggngnngggggaacaaagagacanatgacggaaagagacagatgcagtaaacaaagaggaattatgagcggggtcgaggtagaagaacgcgaggtagacgcgatagtggggtgcgcgggg

SEQ ID NO: 6552 - DNA, 11865 bp, Oryza sativa
  unsure (1)..(11865): unsure at all n locations
cagaatattttaagaattttggagagacggcacgaaacatncggttttgtttgagtacggatggcataaatccttttggagagatgagcagcggccatagcccttggcccgttccgatgtgtatctacaccctccccccctgtctatgcgtgaagaggaagtacataatgatgccgattattattcaaggccccaagcaacctggtaacgacatcgacgtgtacctaagatcactggtcgaagatcttaaacagttgtggaagaaggaaggtgtccccgtgtgggacgaggacaaacaggaggagtttaacctacgagcgctgctgttcgtaaccatcaacgattggcctgcacttagcaacctattcggacagtccaacaaggggtacaaggcttgcactcactatatggatgaaacagaaagtacgtatcttaagcactataggaaggttgtatacatgggtcatcgtcgattccttgcagcaaaccacccggtacggaagaaaggcaagcacttcgaacataaggctgaccaccgtacgaagcctaaacatcgcacacggggcaaatatattatgcacacgaagcctaaatacatatatattatgcatgtatatacatataatataatataatatatatatatacatataatatatgtatgcatatatatgtattgaaacatacatatgcatggtttatatatatatatatatatatatatataaaccatgcagcaacaggggcatgcaaaaaaaaaaaggtcagctcgatctggactaaagatggctcagccacgtggccggctgagccatctttagtcccggttggtgttaccaaccgggactaaagatagatctttactcccggttatttcacccgggactaaagatagcgatctttagttccggattggtactcccggtttggaaaccgggactaaaggggggttacgaaccgggactacaatgggtttctccaccagtgatttccaaatatatcggttggcttattcaccgaataagcgaaacgatgggccgttagctagaaaaatgcggtcaatctttttgttggggtctggggagagatgatataatagaaaatcggtaattgtgatgggacactaatttagttatagaaaaatgatctcactaagatgaacttgtccattcaaaagttaattagtgatccctttctttgaaaagttgttagtcgccgatataccttatccttgtaatcacggtgatataccttgtaatcacgttaggcagatactctgaatcgctgatgtagtgttcagattgagggtgtgttccgaactttcaacttttccgtcacatcatttcaatttcaaccaaacttctaattttagcgtgaactaaacacacctaaactcggctttatactcctatctattactcccttcgtcctaaaactattgttcatgtccaacgtttgaccgttcgtcttatttgaaaattttttatgattagtatttttattgttattagatgataaaatatgaatagtattttatgtgtgactaaatttttaaaaaaaattgtaaattttttaagtaagacggacgattaaacgttggacatggatttctaaggctacacttatttagaaacggaggtagtaattagcagtatccgaagaatatactggcttgtcgctagctctttgatatacggccctgtttagttcgcgaaaagaaaatttttgggtatcacattggatgtttgaccggatatcggaaggggttttcggatacgaatgaaaaaactaatttcataactcgcttggaaaccgcgagacgaatcttttgagcctaattaatctgtcattagcacatctaggttattatagcacttatggctaatcattgactaattaggttcagaagatccgtctcgtgattttcatgcaaactgtgtaattagtttttgtttttatctgtatttaacgctccatatatatgttcaaagatttcatgtgatgtttttgggaaaaaaattttggaaacaaactgggccagtctcccggaataatgtatactgtgcaacagtgcaagtgtaatgtaattaagatgcatggatggaaatggcacaatagtcaacgtagacaggggttccaggagggagcagaggaacagatatacgacaaggactacctaccctgttagtagtaagcagccactgcaagatttatggtaagataatatgccaaaatgatcatctactggaccatacagtatgccaatgttggtgagagcggtcagaaacctgcgttaaatccttactggatacacgccctgcaataaatccttgtttgtcttgttcggcaacatgcatttgcaaaatgaagtacagtatatacattgatgcaggaccgtccagtgtgaaactacatcatcatgatcagttagcttcgggaaattaaatactgactacaatacatgtactcctccgtaaaaaaaaaagacaaactctatgttttcgtgtccaatgtttaactgtccgtcttatatgaaatttttttataattagtattttcattgttgttagatgataaaacatgattaatactttatgcgtgagttatctttttaattttttcataattttttcaaataagacggacggttaaatattggacatggaaacccacggtttatttttttagacgcagggagtaggacagtagaaaaaaaattataatctgttatatccaagttattttgggtgctgctctcagctagtgagaaagttggacgcagatactcagtagttagcgagaaatcagttcgaagcagataaaaacacacacaacgtgcgtgctaacctcgtccaagtagcttagcttaactccttaagcaagttaggctctgtttagttcatggaaagaaaatttttgggtgttacatcggatgtttgacttgatatcgcaagaagatttcggacacaaatgaaaaataatttcataactcgcttggaaaccgcgagacgaatcttttgagcctaattaagacatcattagcacatgtaggttactgtagcacttatggctaatcatggactaattaggttcaaaagattcgtctcgcgatttccgtgcaaactgtgcaattaatttttgcttttatctatatttaatgctctatgcatattgtcgacgtttgatatcgcgactacggtatttgtatagtatgtggatcgttggtactagggtatatgcgagattgaggtaaaagagatgaaaacaagggtttttatacaggttcgggcctttatttgacaggtaatagccctactcctattggccgaagccggtgttgctcctttattcatattaatcacacaaatacaatatttgggataacctatcttgccgtcgtcgacttggcggctagataaccaactcgtagtcgacgacagggtagtcttcctccttaagtacgaaattgtcgagattagagagggcgctagatcccttttgccggcttccgtaggcaccgaatggagtatgtctaggcttatatatgatgttgatatccgacggcgtgtgttggcttgtgtgtatgttgtgtcttatagctttgtggcgtgtcccctctcctcgtaggggattgtatttatacccatagatgcccccttgtccaagttgaactaaggagataaatatggaaacgatccgagtagtccttgtcattttcatatagaactctttttgtcattccttatccgaaactccttttatatttgaggtttgtttccgtataagatatgatatgtggtggaccctgccgagatttagccaactactattaggtatgtggtatccataaccctgacagtagcccccaacttcaatgcaaatgaacgagttgatgttcttgaccgaagagcttggaacaactattgtcgtgctcattggaccgttctcggtgagatcagagatagtgctagattccccttatcggcctttgtaggctccatattgagtttgtctaggtcccgatgtcgaccgagaaggtatggagcatgcgactaagtctcccgtcttgctgtatcaagaatttggattgaagtcaagaaatttcgtctcggtgggtacaccatcactttattccatattccttctcgagctccatcaaccattctcgagtaatctagaaggtgcaaagtctgcgacaaagccttgaaaatctgacttgactattctaatgtctgactttcctaaaatcaatactcaaaacataatattaaatagaaatagacctcgagcgaatgctcaaagggcaatatgtgtggaaaaattgaaaatctgtgtgcagtacgctcgctagagttgccctcagcaaacagagtttggtacccttcctagccccaagctgtttttatggaaaagccatttttcacaaagacagcttgaatcttataacaaaccatgctgaagctgacaaatcctagcccccagctataaagttggaaaacttaatttccgattacacggcttgattaatacgcatcgagtgagaacacttacatgaccaggttttacatggtccttcggctcttagaatctgacaagaccttacacatccgtttagcactcttaccttaggttttacatggtttctcggaggcttgtcagatcagcgtaaagggacaataggaccgccttcatgacaaggcgatataagaaaagaggatcaccggacaaatattgcacatataaacacttacagaagttgacgtatatgaagtgatgagacgatttctacaccgggtgaagacgaggtgtatagttgtactcaacaaatcgtagaggtagtgggagaattgctacaccgctggtcgaaggccagttatagtcataactcgaccactggagtttaaggtgcgagaggtcgctacatcctcttagttgataaccagaagtgagtatctctcgaccgtttgaaatagaggtgcgaggaccgctacgttgctggttgaaagactagtcgtagtcgtacctcgatcattagaagttgtggtacgaggaccgctatgtttgttgttatttcttaacgacattactagaaatataatttccagcaatggtgcataaatactccttgtataagggtgaaatgctataatggtttatccatgccttgcggatgaactctgtaaccataatataccaggagtatttttacgccattgccgggaattatatttctagtaatatcgttaaaaaataccaacaagcatttctggtgccgttgccggggattatatttctagtaatgttgttaagaaataccaacaagcatttctggcgccgttgccagggaagattcataaaagagattacctgaactaatattttatatttacctctttataatcactgccctttgcaggctaaccttggctgttttcacttttgttgtggaaacagggtagtgcatgactggtttcaacttgccagaaaatttcaaagaaaatccagaagctttcttccggagcgttaggctgcgagtcgctgctccgcagaaaactctaccgacagagaaaccagccgtaccaacactaccgactttcaagattatggctagcaagactctccgcgagttcgctgctccctctgctgacaatgtggccattgggccacagatcaacatgggagatgtggatttggacttgaagtccagcctcatcacgatggcgtaggctagcccattctgtggcaagcttaatgaggatgccaatgctcatctgcaacagttcctgaagatctgtagcacgcacaccatcaagggcgtcagtcctgacgccgtcaggctatggctgttttcgttctcccttctcgggagagcgaagtagtggttctatcccaaccgtgctgctatcaatacctgggacaaatgctttacggcattcctctcgaaattctttccgatggacaaaaccaatgcccttcgtggaaggatttcaagtttccagcagacaagggacgagtctattcctgaagtatgggaacgtctgcaggagtatgtggccgcctgtcctcgtcatgggatggacgactggctgatcctgcagaacttttacaatggactcacaccgatgtcccgcgatcacctggacgcggcagctggaggagctttcttctctaagacggttcaaggagccgttgatctaatagagaagatggtctccaatatgggttggagcaaggaacgactccagacccgtcagtgaggcatgcataccatcaaggagacggcgttgcttgctgccaagctagacctcctcatgaagcgattggacgaccacaacaaaaggccacaaggcatcgtcaaggccttggactcacacgttacgtgtgaggtctgcggcggcacgggtcactctgggaatgactgcccggaaacccatgaggaggcgatgtacatgggcaacaacaacaacgggtaccgtccacaaggaggttagcggtggaaccaaccacgcccatattatcaaggaggtaacaacaacggtaatttttctaaccagccttccttgaaggatctcgtttttgcgcaagctaaaaccactgatgcgctaagtaaaaaactcactgccaatgacaagatccttgaaaatataaatgttaagctagatagctttgcttccgcttttcaaaactagctaagcttcaataaaataatggaaacccagctagctcagttagcatccttagtccctggaaataaaactgggaggattccggggcaacccgactcctccgttgaaaatgttaaggcgatcacgacgaggggaggaaagtccactcatgatccgccataacctaaccctgcaggaactaatggaatatcaaaagaagcgccatctagtgactcggctgacaaggaagttccgccagaaaagaccatgccgtaggaatactgcgagacacggttgttgccgtttccccaacgaagtaggaaaccgtcagtggacgagcaattcgctcactttgttgaagtaatccagaagatccacatcaacgtgccgttgttggacgctatgcaagtgccaacatacgcctgttatctcaaggacatactcaacaacaagagaccactcccaacaacggagatggtcaaactgacggagcaatgcagcaacgtgatactccacaagctcccagagaagaagaaagatccagggtgtcctacgatcacctgctcgatcggggcacaacagttcgaccaggccttgtgcgaccttggagctagtgtcagcgtcatgccaaaaggcgtcttcgataagctcaacttcacggtgttggcaccaacaccaatgcgccttcaactggctgattcgtcagtccgttacccggcagggatagcggaggatgtgctagtcaatatacgggacttcttcatcccggttgacttcgtggtgctggacatagacacgggaaaagtgacgccgctcatcctgggacgtctattccttagcaccacgggggccaacattgacgtgggaacagggagtatccgcttccacatcaacgggaaggaagagaagtttgagtttcaaccaaggacggaacaatgctccatggtcaggataaagtacgggtcgtatccgcagaattatcaagtggtcaaagtggagcaacccaagatggacagcctggtcaagtttatgcaaaatttcctggagaaggaaacaacgtggcccaagaaccggtattataggccgtcggtaaaaccacccatactggccaagaagctagagcagtcggctcagaggaagccgctgtccgcaccaaagccaacgaaggtgtggagggagaagccaaagatgcccgctccatcacctccggagatgggtagaaaatccgcaaagtgaactgaaaggaggtacggtcttgcacgtcggactttaaatgacgcgaccttcgccaataggtaaattggtatgtatctgcatctttatttccaacaatttgaatttttgcatcatcgcatgtttgaatttcaaagttgcatttaggatttttgaggtttaaggaaatttttcaaatgaatttttcagagcaaaccaaaataacattttcatcgaaaattcactgtgccacgaccacactgaccgttggattccaacggttgaaagtgggaccggttgggcccaccaggggtttggccgaacaccctggttcggccgaaccggccaggccaacggtcggctgcctctctttttgaggcaatggctagtgggtcccacatgttattcatgaccgttgtgggtaccctataaaagccagccggccgggagagggaactccacaccatttcaacacattttcattccctctccaaagtttgctctcaagttcattcaagctttgatggattccctcaaattcaaacacttagttgcatatatgcaagttgctttggtgaaactaatcggcgggtgaaattcttgtcattcctaacccccgtcgagttagtccattcttgctccattgtgcagaatgtggaggcgattgtctcgtctgttaaaggggtccggctcttcatcaagtcatcatgacgagtctagtcctcgttcgtcagctgatgtctcgatggaagatgccgaagctccacgacgactcctgaaagacatcgacctcgaccttgtcagtgattgggagagagaagcttactacatgctgagcggctgggagtatgctcacacacgagaatactcaccggagctgctgaaaaagataggtatggatgttgaatttcgttctatttggaaagttattggttggcagagatttgctgtggtagatgagcctggttttcgttttcttactttgcaatttctgtgcactttgaaagaaatagaagatggaatttcctttcgctttttccataaggagtacacacttacatggaaaggcttaagtacacttcttggttttcacgattcctgtaaaatcgatctctagaaaggagtttctgggtttgagaaaaataggttttgggaaaatatttctagtgctccaatttgcaagaaacatagaacgactgatatccataatcctatgcttaggctcatgcacaaatggattgctatgactttgtttcctcgaggtgatttgagacccattaggggggatgaattgattatcatgtttgccatggttagaaaaatcaaaattgctcctgtgaagtgtatgataaggcaatggttagaaagtataaagttctctgctcctgttgagtgcacttctctgattactcggatagcaaaagggctaggggtcattagcgatcaaattgcttttatctcagctgctcatccgtgtattgatgagacttatctagtgcaagggcatattctgaaacatggagaagatggatctttgatttactttttccccggttgtacaaatgaaatcccattgccaaatgcggggtatcatttgtacaactgccatgaactaaccattcccctgcagaccatagaagaatctagtgcaggtggagcatatagtgagacgcgcaacatgacaacgaatgaacgagaatgttcatcatcctcaacacccgtaaagatgtatgtggcaggttgggaatcgactgtggatgcacccggatggacccaagctccacgccacagcatcagagtctcaacctgggcgagtgccagtgaggaccggtggcgtgcgcctcatgacatccaatggggggacaattaacctcccagatcaagtggtgtgcctccatctccaagtgaatggcgctcaagttcctctctttgggacttgggtgaaatctctaggagaatggacacccttaatatgcagacgggggagatccagtgcaacctcacggaacacatagctcaaacgcaagaatgacaacaatctgctgatgctcagttccccaacttcaacaacatgatgcagcaatagcacgatgaccttcaagcgtactttcgctttcagggattcaatccttatcaaggaccctgagtaaaagccaagcttggggggagacatctctccccccactgaggtaacttgtattacattgcatatttccctttccaattgcatatttgctttccaattgcatcttataaaaaataaaaacaacataaaaatttgcaaaaatagaaaataccaaaaagataggataggtttgaggcatgctgggtaagacaagctagttctctttgctgaaatgatgaatagttactctctcaaagattaaatataagtagccaacaattattcgggaacctgaggtaaatgagctgcacttgctgatctaagtctaagatgttgcgagatatgagatagtaaataagagttgctatgatcctgatactagtttaacttgaatttcggttgttttgtttttcaaaatgataaattgagagttcctcatttgatataaattcctaccagagccaaaaatgggctatcatgattaaaccttatacattttggttgcttgccattccattgaactttgtcaaactcttgtgacttgtgtagatacttctcatgctctatgatcaagatcatacacccacatatatgcacatgctaaactcctacattgggagctaagcaatattccattccattcccattttaccaccatcttgaattctccatgctttcacgtgctttcttctcctaaagagaatgtcctttcgaaaaaaaaagaggagggaaaggcatggttataaaaaataataataataaagttatgctccatcaggcatgaacatgatgttgaaaaaaaaatgtagccatgccctctcctaatcaataaaagaaggatttttgggagaagtaagcataaaggagaagcatttttctttattttttttcctcatgtagcattttcatcatataccacacacacattgcacaatcatgatcttgagtatgtttagttatctgctttagtatgagtttttgacttattaataaatgtgaatgcaagtatgccatgtttgatccctacctagctccacatatcaaaaccttagagtaggaatcaaaaaggcaaattggtaaggaattcatattgatacacttggcgagactgagtgaatcaattgaggaacttggctttcttttgcaaaatcatttgaaaacttctggaataagagttgaataaagattgggtgattggtgctctaattgctgttttgtctttcaaccgcgcaaggcaaggagaaacagagtctcgtggaaataaggggtaagggtaagccaccgtgccaaagattatttaatctgagagagagtacatataccttgcacctgtatctttgagatatgcagcatagtagcaactcctgatcaacaagcaagtctttgtttcctttcttccttcactcgggacgagcaaaggttcaagcttggggggggggggggttgactactggatctcctatgatcctacatcagtggacacttaagcaggtgagccattggttgtagtgttgtcgaccatgagtgaactcatatggtcactgttagtcaagagctgtattaatattacgtcggataacgtaaaattaccttataacggatgctattgtattaatccgcatcccaggaaaaggtcggggtacacctaactaacttgattcaatttgcacatctttattatatcgataattgttcattattacaaagggctatattgccgtgccatacaaaatttacttttattgaatttgggggctacggttacattttcaaaggcgctaacttgggtttattctaatacttccacctaaacttgtttttcaaaggctgatttaactaatgtggggtgacagatattgctcn

SEQ ID NO: 6553 - DNA, 7720 bp, Oryza sativa
tgtgtcccagggtagacttctcgctactccgctaacactgtcaattgccccacctgtttcatctcttcttcctcaatatcaacctctactgcatcctcatcatcctctagaacctctccctctgggaactcctccggacccaggtagccgcttctcgaattgcatgttgggggaggactcatctccccaacctcctttgctttcaacttcagagtttcttcatctgtcgacgacgccctcaatgtggaatccttcgaactcggccccaacaatgctaattccttcccctgctgaccactcatgtcaccgtcctgcggcttcgggcgggtaatcatcgccttgatgatcccttgatcgcccctaccagcagacggctccatagattgatcgtgggaaaactgatgccaagacgagatccaatctgcactgcctgtcttcaacgaaagggtgaaacacagagatccccctacctgagtatcccttataaagggccagatatacaaaactgactcccatccgggcctaaaccagggtatccaaaaatgcctagaacaaattccagatccatcataaccaatttggatagtgtttgatctcgtccataagaccctaggcttacccagtcgtaccggttctgatttgatcttaaaatctgccgatcctgaaaggagtatgcccgagtccgatgatgatcaagatcatggtactgtttccttcctggatcccatagcacctgaagaaaactaaaggtgggcgatagccccacagacacaccaagcagatcgggaataatccccatccaaaacccactccacacgtggattacggccgccggtgacccctggttgcccgagcgccaccatagccctaacagcgccgccatttgtccggtaagcacgtctcttccattttgtattctctatagtatctagtaggaataaagcttaggagcttcggtgctatagtcctcttggagttttgggtatgtttctagtacttacagttttcgtaagactatagttgaattaatagaattatcttctttatttatttatgctcgtcgttcatatatttctttattgagtatatgttctatgagtagtatatactttgtatatccgtttcatcctagggtagtcaatccctacaacgataacggtccaaccagctttataggttgctctagctccaatttgttcatccgtatggtgagagtcccggtggagttactgatattatttacgagcataagcatggtaattaggctagataaatattgttggatgcaggtgtgccccacagaaagtgaggtaggcggcatgtggtaacaaccctctccgtcctttgtattcctccacgtttgagtatgatataagaatacgtaaatgtcataatcacgctagcaggcgagtaaagagtggtccctcggtagtaccaaggtgcctggaacgaagtcttatgttgtaaacatgtatatgttgagtgtatactagacatgattaatatagaagtatagatgaatcgtagtttcctaatgctaattttgtactagagattcttattaaagtgaatctcctgtgtgtcgcaacgtggatttaacattccaatttgggcaagagggccctggttgtgtcgcaaaagatgacattctaagttttcttcctcctctccggtctacatgtacctctggtcctaagcacccccgaatagcaaccatctataactaatgtcgacaaccgatacggattctctatcgattgaaggagctcgtgaactggaagtcatttttcacctttgaagtttaaaagatagatcagtcttacatcttctccggtgtcagaagtactatgtagcggaagtccgaatgcagcagagaggtaagacaagcctaaacttttcccatgggacataaacctttttagtagccggagtcatttcagtcctcgcctttctcatctttcgtaggggcctttagtcttttgattatagtagaggtcgcgagagagcagagcgtaccgcccttattcttgaaccctccaccgagctctaccctacccacatttatttggaagggggccaaagaaatgtctccacctgctgccacagtagttcttcagaattctacagaacgggtcgatcctccactaccttatcaattattatcctaacccctatttagaccacggtgaattaattataggttgattaaggatatataaaaaacatatttttatgctgccgccttttcctgccgaaatataaatacgataaccttgggaatactcatggctgaaatgctacagcggtatccgtgcgcttacggatttatatgtgaacgtaaaaattaccaacatattttcgtcaacaaaatagtccgacactagaagtactctcgtttgtatgcatcctatatccgtgcaccatccatccatagtatcacaagatcctctactagcggctcaaagtacacatcaatatcgttgctaggttatttgtgcacctgaaatagaagtgacatcatgatgtacttatgcttcaaatattcctattaatagagccgagaaggtggttgtagataataacagcgactggccatgtgctatgatgactgctcatgtcaccgaaatgattcatgccgtcggtgctgttcagttgggtgtcttatcgttccaactcatttacgttctttgtggtgccattggtgacggtcgttatcgatcagtttcgacctttaatattactaaaatagaggaaaactagtggtgcttgcaatgcatatatctgttagaacaataatattccactagtattaggtctactaacctttttgcagagaatgataataaagtggaggagaatcgacatcaacatagatgataaatcaatcggacaatgtcgagagttggacttatgcatgaattgacaagaactcagaattgacacgacacactgggccaaaattcacatgtctacagaggagaataacaaaggaggctacctgccgaatatgggccaggttgggctgacccctggttcggcagaaccaggaggttcggctgaacctcccctggcgccgttggatccaggttttggctggacggtatggatcactccccaatgacagttggagggcaattccgaccattctaactaccacaaccgtcattggcagcctatttaaggagctcctctcctcacttcactcacacacctcaagcaatagctctctcatttctctcaagtttagtttagtagtatctagctggtggaataggactagaatagaaatcaggagtccggaaagagttcgggtatggctctagtagctttcctttcctcttttataagctttgtactttcattagaatacttttctatattcatttatggtattgaaatactttccgagtatatgagtacctactttacattatgttcatgttatactgaatatacggctagcttatctgggagatgcattggtgtgggtataatgtttgcttatgcaattactctatgtcatgacgatgatattagagtactatctggtagtttagacatggtgtctagattacgggatatcattatttggggttatatgctgcggatgagaggtgggccgctgatggtaacaactcagtatgggtattcctccgcgcctgtttataatcctaagtttattcccttggaagggtattcctccatatttagcctcggttatatggtcatgacgggctgtcgtaaggaattcagccgttgggggtggcttctcgtagtaccaggagggcatcggatagagggtattagctagtatatcggttaactagaataaatgtatactatgtatattagaagtataggaatagattatctttctcttttctgtcaacttaccttagataatatattatgagaatgagtagctaatgcttgtgtgtcactctacccttggattatcttaacccctgcttagaatatgattatcacaagtaacatataaactattagtcaatttctctctacatgatcttcccacgggataaaataaatacgatacccttggaatactctcgggtgaaatgctacaatggtatatctgtgcgcttgtggatgaactctgtaaccataatataccagaagtatttctgcgccattgctgggaattatatttttagtaatgacgttaagaaataccaatagtatacttggaaagtatttcaataccataaatgtataaagaagattattctaatagtagtacaaagcttacaaaagagaagagaagagctaccagagccatacccgaacacttccgaaggcttccggactccgttttcaactctattcctattccactagcttaagaacactaaactaaacttaagagaatatgagaaagctttgattgaggtgtttgttgaagtgaaaagggtgaggggtttatatagcctcccaatgacggttgtgatggttagaatggtcggaaataccctccaatcatcattgggagctaatccaaatttggctggtggcctcctggacttctccactccgcagacttctaaactttggcccagttagtcgtgtcatttccgcgttcgtggcccgttcattgataagtctgattctccacatcgtccgattgatttatcgtttgatttgatgtcgattctccttcactttgtggttattctctgcaaaagggttagtgaaccaaatactagtggaatattattattctaatatgaatatgcattgcaagcataactagttctcctctattttggtaatattgacggtcgaaactgatcgctaacaaccgtcaacaatgttgcaggtcaaataccagtcgtagttgtacctcgaccattagaagtcgtggtgcgaggatcgctacgctgttgatagaagaccagtcgtagtcgtacctcgaccatttgaagggaatccagagtaatagatggacgacattctcgtgacgtgcgagaactgcctcctgatgacgacgaagacaatgagggattatcgtagtcggtggttcgactcctggacctactacctcgtcctcgggccctctagaagtctagggatctcgagtttcgttgtcgtcgtgtgatgttgtgctgttgttaaccttttctgttgtcgtcctgatgtaattaatcctagacgttgtcgtcctgttgacaacgacgatctagccagtcttggttgtcgctatcacgacaatgttgattgtcgcgttaggtgtcatgagattgctgtaaccgactggtcgaggaacaggagtaggcgtatctcgatcacctgaagatgaatttttaggtggtgagagatcgctatgatctattggtcgaggaccaggtttagacgtacctcgatcacctattggcaactgacaggcatacggaaacaaaccgtattcgcgaaagcatctcttgttatccgtgactccccttatcaatattttccgtactaacttggtcaatcccggtgtaagatcatagagacatggagttttcgacaacgacagatggagttcaacggtccacaagtgaatttaagttgataggggtactagagttggttattacatgtgcatctcatgtggccagcatgactcacatacccaacttatggcatatccggatgtctattcgcaatcatgtcgggtgatcaagccgacaatgcttgcgaggaattatccgttaacaatctttcctcaaatagaccagccgtagccggcgctatacatgagataagtcatcagtctttgttggtaggttgggtgcgacaactcagcattttccgagaacgttctcgataatggggtgtactcaaccacaacttactcgagtgctcgattgttcctgaaaacattttctagaagacaagatatatagcagagaatatcgagcatgtactgaaaagactgcatgtaacttctaatattatcaggatataacaagcagattaaatatcaggcaatatgtaaaccgtaaataagcatgatttatacataaggaaatagagcgagcccctagcattaaaccgtagtcagcctaacaccggaaacactcgtacaatagatatcatataaaaaacatgctctaggtaaacttaataaagtatggatctgacaatattgtattgatatgaagaataggtacgataaatcacatatagaatattgcgtacctttgtaggtacatgccggatgtatctacgaaattagtagattaatttaaaaaattaatctcctaattacctgatcggtcttatttgcaggcacgcgtcgacaaaccaatacatgcatccctgagtacgtactgattcggcacattcgcatgcatgtgtatatctcacgagcaagcagtgcgtggtgatcttggacagtgatatattcaacctgaaaaaggtgaactatcatgtgctttcttgccacgtgccgtcaggatggatgttctcactatgcatcagggtccaaaatttggatcctagtcggagtgtgcgatgttgatttcggttcctcgaaggccggcgtcctaaacagttagcggcaatcaccgaggttaccaaaatcaattgacgatgtcacttaccgggcagtcgacgtcttgaagttcgatcaatctcgatagattgaattgttgatggggatgatttcgatcttgtcggaagatatactccgatcgggttagatctccctatagtcgaagtcatcgagtagcttgttgttggaaaatctatctcttggacccatctcgtcgaaatcttaaagcaccaaattcccctacgtggcgcgccactgtcgacatttgatatcacgactacggtatttgtatggtatgaggatcgttggtaccagggtatatgcgagattatggtaaaagagatgaaaacaaggatttttatacaggttcgggccctttatttgacaggtaatagccctactcctgtttaccgaagccggtgttgctcatttatttatcttaatcacacaagtagaatatttgggataacctatcttgccgtcatcgacatggcgactggataaccaactcgtagtcgacgtcagggtagtctacctcctcaagtacgaactcgtcgagatcagaaatggcgctagatctctgttgccggcttccgtaggtaccggatgaggtatgtctagtcttatctctgatgttgatatccggtggcactactacataaaagattttcctatacgccaccctcttttagttgtaggcagcctgtgaatggaaccgcacgggataatcgagcgactggtgccgggtggacgccagcacgggaaaatcgattattccgtgcgggcatcctaatccaaccatatgggataatcctcattatcccgtgcggtcgacttaagtggaccgcacagaaaaattgattttcacgtgcgagctttttaagtggaccgctcacaaaaatataatatcccttcctattttccctctcacccacttcaaattttttacacactatctcttcattttccctatttactcctctcctccccttccctctctctatcctctctctctccctctttcctctccacccctcctctcctcaccgagcgcacacggggcgtccaccgccgccgatggcgcgggaggcgacgcggtgcttgcttgcggaggcacgccgccacggcggctcggcgatgacatgccaggcagtgcggcgagcgatg

SEQ ID NO: 6554 - DNA, 4303 bp, Oryza sativa
  unsure (1)..(4303): unsure at all n locations
aaaacgaattgcaaatgcactggataatattttgtcgagaaaatttcgtagccaaactgaccaaaagtgtcgcgcttggaattcagtcgaacagaagcaccagtatgatcgataattgtgctctctgcactgctgcctcaatagatttcgtagtaaatcctttatttctatttatctatgaatgcatatatatatagtataaattgaacttcataacaattaacaagaacccagccctggtgtgccaggttctttatcctgcatccatactagttactgctgtctagtagtactattttttagcgaaattagactacagttgtttttacaaaattagatgcaacataactctatctactagcaacaaatgggtcagattctatcaaacagacaaatgtaggccctatttagatcccaccacaaaactttatacctgtcacatcgaacgattaaacacatgtatgaagtattaaatataggctacagaataactaatagtacagattacgactaatttgcgagacgaatcttttaagcctaattgctccatgatttgacaatatggtgctacagtaaacatttgctaatgacgaattaattaggcataataaattcatctcgaggtttactaactgattctgtaattagttattttattagtacccgaacaccacatacgacaacctatataatacacacgccaaaactttacccctaaatctaaacaacccggtagatgaaaggagaattttatttcagttggtacgtgccaattaagtggcagagtttgaataagctcactggtggagaaaccatttgtagtcccggttcgtaaccccctttagtcgcagttttcaaaccgggactaccaatccaggactaaagatcgctatctttagtcccgggtaaaataaccgggactaaagattgatctttagtcccagttggtaacaccaaccgggactaacgatggctcagccacgtggactaaagatcgagctgaccttttttttatttgcatggccctgttgctgcatgggttatatatatatatatatatatatatatatatatatatatatatatatatatatatatatatatatatatatatatatacactagctatatatatatatatatatatatatatatatatgtatgtatatatatatatatatatatatgtatgtatatatagatatattatatttatatatgtttcaatacatatacatgcataatatatttgtatttatacatatatatatgttatgcaaatgcatatgtatatatatattaaagcgcttaacattttatgtgcatatatatatgaccaaaatatatatttacactaaagtaaatgtgtacatgcatatagaaaaatagacatgtattaattacaattcattatgatgtccgagctagctacgacttcgacgtagtagtaggcgttatctcagaagctaacgacctatgaattgtatttctctcgggatcaaggatttgttcgttgatgaatcccatgagttgttcttgaaccgccgcgataaattacttgtgtgtgaggttatccctcatgcgaataacctatatgaattaattagtcaacaacaaatcgatacgtacccaatgaaattttgaatttatttgtatgtacatcgagctctcttgtggtgatgatttggtatgcaaggcagtagcaatactcgcacacgtagtagccgcacaagttagttccctgggcttgcttttgcgcactatatatatatgacaaacggcgagagatctaattaatatacacttgtatgtatttgaattggagattcaatataaatgtagagcaggtgtactcacaggaaatttaaactttcgcctaagtctttctctccaattgccgcggaccaaacgacggaaccgataccaagccctacatggagtttaaagctatgattcgtagtagcaattaattataacaagattcgtaattaacattgaacttatgacagtacctgtctataagttcaaaaaccttgtcaaacgtagactcttttttatccattgagtcatatacgttaactacgcaggcctccaagtcgaagagtaaaaggacccagtggaatgtgcaatgtgcgtcggatgcattacatatgaaacacttagcttgttcgtacgggaatgaaatttggtaggaagacagtaaaaactaactctgtgttgtatggcaatagtatgaacatcttgtaatgctgcgccttcaggagatggacgagattgtcctctgtggcttgcggatactggtcgagcattgtgatgtttactttccgagggtcgatgaatccagtatcgaaaaccccccaccgtcgggccctttgaatctccattctacaacgataaaaggaagtatatattatatatggtgtacttatatacaaggacctaattaattattaaagaaaacgtaataagaaatctaactgaacgatacttacaaagtccaacaactcataatagagacatcgagggcgtccagctggtatagttcgtagatacccttgaaattgatccagagaatatcttctccttgcaagaagtccgtgtccctgatcatcgctccgatcatctctctaccggtggcgcttatctccatgtacagttgatggaatttgtacatttgtgtcggtagggactgcagctgcttaggcttgacaagcggtttactgagttcgtacatgtatttcacttccaccttttcgattggcgcgcctcgtagcaattgatccgtagttaacctggtgtcattaataaaatcttgtattccaaattcttcaccggtcaccaacggctcgatctcctggtttggttgctctccaagctgagggactggtttggactttccagaagatgctttcttaagtgttcgctcatagtccgccgatagctttatggcctccttggcaggtgcagacatacccctgaagaagttcctgacactcgggtctataggaatcttcttttctgaacttcgaggcttcaattgtctccttacttctgatgccacataagcatcaggctcctcttgcgtgcaatcgtaccccgggtccttgtttttggcggcgtcaactttcgccttcttcgttgcccttgtgggggcaggcggtggagcttggggggcccttgacttggaaggtgccagacgaggagcttgcggaggagtcggtgcaggagcctgaggaggagtcggtgcaggagcctgaggtggagacggtgctggagcatgaggagaagacggtgcaaaagcctgaggaggagatagtgcacgagacgccggtagtcacccagggaggatgatgtaccgcttgcgccatagtataatggtgtggcttgtgtctcgtagatgcgtctcaccgtctcctacagggtagtccaactcgaggtcctcgtacgtggctttcaccaactcaacttcgaccttggagtattctgctggaatcggcctgcagtgttaagtccctgaagggtccgttgggatggccatgcctgacgccaccttcacgtggtgagaggttatttattcgtaatcaacatatatcagcagcaatttgcggaatggacaagtctaaaatctataaactacgaacttacctttattgataagttcttgaagggaatatgcagctcacatggtgtccgctgagtgatgtcatcaacggggcaggtggtttcgtcctgggtttgcatggtgtccatgctatgtgatcctacctgccccgttgaggcgcagctgcttcgattgcctgaagggctgaccattgcaggagaaatgtacggctggggatcctgggactgatgtgcggccatgcgttcatccaccttccttgccacctcctcttgcatgctgagctcgtagctcgataccctttactcaagatctgcaatcttcgcctcggtatctctcttgctcctcatccaactcctgtacgtctggatgccctccttgaatccaatcttctaaggaatcgcccctttccctcgtgttcgtcctggatgctcgggagtcttcagggcgagtgacagctcgtccttctctctgttgggtcggaacgtgccctgagaagaggcttccactgcgtccgttagtcgactcgcagcctcgcgtatctgatcgctgaagactagggagccatcaactaggttgagcgttccaccatgagcatagtaccagaacttcgatnnnnnnnnnnnnnnnnnnnnnnnnnnnnnnnnnnnnnnnnnnnnactgcatttcaaaannnngggactc

SEQ ID NO: 6555 - DNA, 1602 bp, Oryza sativa
ccccttagctttgggaaatgtgtcaaagttcggtgtttggccccttcagaatgtatttctggaacagatctcccttgaagctctgaaactgttctgccattttctttagagtccaccttttcactatgttctctgtacccgcgggaagggtgaatgtctcgagcattgtggtccacagcatctctttctccgaatctgggacaaagctctcatgatctctgcgtgcccttgttctgcgccaggacaccgtactgacaggcacgttatcccggacaacccaaccgctgtgtcgtacgtagttcttggctgcttctgccggggcactaggtcggccgtcttcgtccactttcgttatgatgtgccgaccctctagcttcttcacggcacctcattgtccgcgtgccctcttctgtccaacggagggttgacttccactagcctcctcctcctcgttcccctccgcatccctctccacgtttccctcttggttcccctccgcatcgctctccacgttcccttcctcgttcaagtactggtttggatcctcgttcccctcttcttcgttccagtactagttgcttccatctgtgattatatcgtacaatatctgttcctcttcgcgatcagccatttgttcatacaagaaatatttgccaagtctataggtcatatttgctttaacaatcatatatgctaacaatcatatatgctaagtctaagtgtagtatattagaaccctagataatcattaaaactgtactaatcttgtattagaactctaacaatcatatatgctaagcctaagtgtcgtatagtagaaccctagataatcatatatgctaagtctaattacaaatataataatcttatattaaaactcaaataatcttgtattaaaactctaataatcttatattaaaaatctaatagtcatatatgctaagtctaagtgtcgtatattagaacactagataatcaataaaactgtactaatcttgtattaaaactaactctaacaattttatatgctaagcctaagtgtcgtatattagaaccctagataatcatatatgctaagtctaagtgttgtacattagaaccctagataatcatatatgctatgtctaagtgttgtatattaaatctaatagtcttaattacattaaaaatctaacaatcatatctttacatcacttgcctacgcgaattccttcgagggctagctaccactccggcttgagggacgacgacgatgacgtcttttccgtaacatacaaaaaaatgtattagtctaaacgcaaagtaacatatattgtatttcacgtagtgtcatataaagcgaccgttcacgtttcattcacattcgttcacgtttcattcacgttcgttcacgttcgcggtctcgttacattcacgtttcattcacgatcattcacgttcacgttctcattaagtgcacgtttcgttcacgtacgttcattcatgttaacgtacgttaagttcacgtttcgttcacgtacgttcattcgttcatgttcgttcacattcacgttaagttcacgttcgttcaccatcggcgttatataaaccccaggtttaaat

SEQ ID NO: 6556 - DNA, 5676 bp, Oryza sativa
cgggacgcagtgacacattgctccccttagctttgttcggaccggaaatgaaatttggttagaacgacagtaaaaaccaacatttgtgttggaaggcaataggatgaacttcttgtaatgcgcgcccttcagaaatggcaccatattgtcttctgtggcatcgggatactggtcgagccatgtgatgtttcctttcccagggtcgatgaatccagtatagtaaaccccccgctgtttctcatcaaccaggactaaagatattttcctgctattttgaaattctttttaaacccggttagggttaagaaccgggactacagataatagtactgaatattgaatttcattacatatgtgtttctaaaatagtaaataatgcattaaaattatttaaagtcaaaaaattaatgacaattacttcgaaaaattattgttgtctgtagtaaattaagtggataaaacgtaataagcaattatatgatttaaactagttaaaaattctaataatcatatataattagcatatgcatgatattaaattgttaaaaattctaattaacatatgtacataccacatgcatgatttaaaattaataaaaattctaataatcatatataattagcatatgcatgatttaaaattgttaaaaattctaattaacatatgtaaatgccacatgcatgatttaaaacttttaaaaattctaattatcgcatataactagcatatgcatgatttaaaattattaaaaattctaataatcatacataattaatatatgccatacaacaattgatttatatggatattcaatacatccaaaatagttcacatcgtgtacacaacaattacggcaatacatcggcgatgacggttgaccgcacgtactttctcctcactattgttccttccttgtgatcgctacgtgagtaaggggtatcttcatttgataggaggatgctagggtcaatcgtcaccgtgaaagggggttgcccatccaactgatcgtaatcctcgtcagtcttgtcctctactccgacgatttttcgtttgcctgggagaaccacgtggcgcttcggctcgtcaggccctttgcccttccttcctttgctagacatatccttcacgtaaatgacttgcattacatcattggcaacgacaaaaggttcatccaagtatccaaccttgttaaggtcaaccgttgtcatcccactttcatcaatcgttacgtctccactagtcaacctaacccattggcaccggaacagagggaccttgagaggaccatagtcaagttcccatatgtcctcgatggcaccgtaatacgtgccagttgttccatcgtgtcccatggcatcgatacgaacaacgctgttttggttcgtgctcttcatgtcttgggctctcgtgtagaatgtgtacccattgatatcatatccctggaatgtcgcgagccagatggtcccctcgctaggaaggccagttattggttgatcgtctcgttacccatgagatgttgtcgtagccacgcggggaaagtatcaatgtgatgccgtgtaatccttgcatcggacttaccgatgtttccggcgcgaactagagccaagtgctcctcgatgtaaggagccaccaatgaagattattgcagaacagtgaaatgggctttacggaataaattgttgtctaccgtcattattgctttccttccgagagtcccctttccccgtagtctcccttcatggcgtgattcaggtaccccgattaggcgaaggtcttaaataaattttacgcaaaatttgatgacctcctttgttccataccccttggcgatgcttgcctctggacgagcacgattacgaacatacttcttcagaacgcatatgtacctctcgaaaggaaacatgttgtgtaggtacacaggcccgagaataccgatctctttgacaaggtgacaaagcagatgcgtcattatattgaaaaataaaggtggaaatatcaactcaaaactgacaagacattgcaccacatcattctgaagggcttctaatctatccggatcgatgaccttctgcgaaattgcgttcatgaaagcacatagttttgttattgttgcccggacattatctggaaggataccccttattacaactggtagcagttgtgtcatcaacacgtgacagtcatgagactttaggtttgtgaacttcttatccttcgtgcttattattcgctttatattcgtggagtatccagacggtaccttgatgctctccaagcattcaaacatactttccttctctgccttgctaagagtgtagctggctggactgaagtaatggcttcctttctcctttggttccgggtgaaggtcgccgcgttgttccatacacttcagatcattacgtgcttccagtgtatctttcgactttccatatacacctaggaagccaagaaggtttacagaaaggttcttagtgaggtgcatcacgtcgattgcgtggcggacatccaagaatccccaacaaggtaactcccaaaatatagagttctttttccacatcgccgcgtgaccatctttgctctctataggctggtttccaggcccctttccaaatactactttaagatctttaaccatagcaaacactgttttcccgctgcaatgtttaggcttcgtacggtggtccgccttatgttcaaagtgcttgcctttcttttgtacctggtggtttgtggcaaggaatcgatgacgacccatgtacacaaccttcctacagtgcttaagattcgtactttctatttcatccatacagtgagtgcaagccttgtaccccttgttggactgcccggaaaggttgctaagtgcaggccaatcgttgatggttacgaacagcagcgctcgtaggtaaaactcctcctgtttgtcctcgtcccacacggggacatcttcctttttccacaacagtttaatatcttcgaccagtggtcttaggtacacatcgatgtcgttaccaggttgcttggggccttgaataataatcggcatcattatgtacttcctcttcatgcatagccaaggggggaggttgtagatacacatcgtaatgggccaactgctatagccgctgctcatctctccaaaaggattcatgccatccgtacttaaaccaaaccgtatgtttcgtgcgtccttttcaaagtctttaaattttctgtcgatgtttcaccactgcgaaccatcggcgaggtgtctcagcatcccgtcctgttgacgttcttcagcgtgtcatcgcaacattctagcattccccttgttcctgaacaaacgccttagccgtggtattatagggaaataccacatccccttagcaggaattctcttctttgttagctgcccgtcaacttctcctggatcgtcccgtctaatcttgtatggtagtgctttgcaaacagggcatgcttctaggttctcatactcctccccgcgatataggatacaatcatttggacatgggggaatcttatgaacttccagtcctaacgggcagactatttttttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcaccttcgcagtcttccctggcgtcctgcaacatctgaccaagatcatccacaacgtcgttaccatcagcagctatttcctcctcgcccgtttgatttccttcaaatccaacatactgagcaaagttcggaatattgtcgtcttccacttcatcttcttccatttcaacaccttgctctccgtgggatgtccaacaattatagcttgccatgaaccccgactcaaacaagtggaaatgaatagtcctggatgcagaatactccttctgattcttacacttattgcatggacaacaaataaaacccctttgcctgttagcttcagccactctcaaaaaatagtgcacgccgtcaataaactctttggaccgccggtcagcgtacatccattgccgatccatctacatgagtcaaaaaaaccgcacacaaataattattcttacaataatgacagtcatacaataattataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagtaattttgaagcttgctcgggcagctggaggaggaagaagacatatatataggggtgggactttagtcccggttggtagcaccaaccggggctaaagatcaccgggatctttagtcccggttttaagatcccgggggggcctgataggtcctgacagcattcgaaccgggactaaagatgatctttagtcccggttggtaacacaaactgggactaaagatcaaatatgcccgtttcccttttgaaccgggactaaaaatcatctttagccccggtttttattgcatccgggactattgtggaaatcggccgaccgacgaaagatggtttctccaccagtgaatgaaaaataatttataaataaaatttttatatacgtaaacttaacgatctaaaaacaaaggctgaaaaataaacatatatgaagaaaaacctaaatttaactctaaattcaagtttgaaaaatccgtttttggttgataagtataaagaaaaagatgaggccgtgagacttatctccgacggaatatcacataaccatgcacatatatataaccttcaaaaaacattccattgccatatggaaatattaattagacccaattgaactttttacagctgtgactgcttctacattttactagtttactaccgtgtacaaagtaaactactccagtatataatactacggaagtttctacgatgaaatctgcaggaatctaattaaaaatgtatccattcatgattcatcagtggttcagtgtttgcctcgaatattactgttcaaaaagtatattttgttgttatcgtgccgtacgtacatggaacgtgttaggtactgctgccaatgccatcgcagtataaaaaattaaattaattgctctagctacagatctacacacagacgaggtaaatccatttgacggtaagtgtttatgcccctggtgactgtcacggattatcaaataacgtgacatttaccaaatttatatgccgaac

SEQ ID NO: 6557 - DNA, 10352 bp, Oryza sativa
  unsure (1)..(10352): unsure at all n locations
cgccccccttgaattgtattctcatctcnnnnnnnnnnnnnnnnnnnnnnnnnnnnnnnnaaaaacattggaggatgaagttactaaccttttagacacctccaatttgtatataatcactaaaaaaatttcacaaaaaattttggcatgacctcccctctttctttgagaaattttgaagcttgctctcgggctggaggaggaagaaggcacatataaagggggatctttagtcccggttggtgttaccgatctttagccccggttggtaacaccaaccgggactaaagttaggatctttagtcccggttggtaaccgggactaaagatcccgggggccatgacaacgtctgacatctctacaaccgggactaaagatgatctttagtcccggttggtgttaccaatcgggactaaagatcacatatgcccgttgtagccaccaaccgggactaacgatcatctttagtcccggttttaaaaggatccgtgactattgtggatttcggccgaccgaccaaagatggtttgtccaccagtggctgtatcgctgttgttggcggctctggaaacagatatgattattggagtatatacataaaaataaatttatttgatttattttgaaaaggttttttatagaattattttacataaacgtactgaacagtgtagtaaacatgataatcaagccttgtttacttggggaaattttttgagtttggttttcacatcgaatatacggacacatatttaaagtattaaatatagtctaataataaaacaaattacagattctgccaggaaactgcgagacgaatttattaagcctaattaattcgtcattagcaaatgtttaccttgtcaaattatggcgcaattaggtttaaaagatttgtctcataatttacacgtaatctatgtaattattttttttttatatttaatactctatatatgtgtctaaatatttgatatgacagcgtgaaaattttagttctgttaactaaatatagagttacccaaaccgatcgaacagcccaaacgaacgggcccagtctttcacatggaagttaacgttggaagtggtgccgagtcccctgaacgggcactgcagaccatttgactatcaaattctgtggcggctttcgtaatttcattatttcttaaatcgtaattctgacacattaaattacatatatttggatgcagattgtttcggacaatgacaatttcatattgttggacaaccaccaatcacggctggtcaccggacgacaaaaatgtacgtatacgtccggcgaaagcactaaagtactccatgtttctctttacaagcctaaatatgactaaatcttgccactagcgcatgtagtagttaacctaacacgttgcttcagatgcttcgatctatgcagaaatcccaggcaaattaagatagtttattccccagtaacgtcttgttcggttaatccctctcacaatggtattgaggggatatgaaggggatttattccatctctattgggaatggaattatttatcctcaatctcctccaatctctattttttgggattaaacgaaaaaaggtcaaactgtaacctcttctatatccataattattcttgtatatttttagtggtcttggtacaagtacgaaatttttttttgcacgcgattgttaacctatttatgcatgtgtttttcgagccactgcaactaagagccaatagctatcgaggttttgccatagaaggattccattactatccattaaaatcaattttttataggcggctctaacgaaccgaccataaaatgaaacttctagttttacttttttagaaaaaagggaaaattgatgccgtatttcacgaggcatctattcatgcaagttctaagtcacacgtgagggaattttatactcaaaatatgcgaatctagaacatctctctctatgcgtatccttcttaccatcccatatgatagcatgacattggcacatgttgcacttttattttctcattgacatgaatggatataaatcaattgccaaactttaaaataatgttgattataattaatagatttgtcatcaatcatcaaaaaatgagagattataagttcaagtgtttaagattgttggtttaggtatcttaatttgatgattaatgataaatctaactatatgaggctaatgtttttgtgaacttttcttttactagtcccatttgaatatgaaaatggcatgtaataaactttccatattctaaattggtctcactcgtggatccaaaacgtagggtggacacattcatttacttatttgattatgtgcatacatgttcctttatattcttatgtttgcacatcttgaggggagctcattctatatattgatctctaccatgatttgaaattatgtcacctcatttatatattgtttacatcgggttatcatccatcaccaagaagagaaaagattaaaagatcgtacattaaataatttgcgtaattatggctttggtgatttatagtaaactaacttctatcggaagaatgtattgacgatagaagcattctatatggaatgttattagttaagtctggtgttattagtgtttataatgagcagcactttagcaggccggtgtccaaaacttgtagcttgaagatgtcaaaaagataagagaaacccactatgatatagccgtgtagccctaggaagggctctctgccgtgctgccttattatgggcgttcatattcattatcatggagtttgattcctccatgtagtatgtcacgtcctgataaattcattccgaaataaaattcattttctaaaaggaataatagaattaattaaaatttgaaaagaaattggcaaacactaaaatacgtacaagaaaaattcgaatgtggtccggagaatttttgttaaattctccttggtctaaaaggagccctcaaattttacttgaattttcagagcaccggaaataattattaagcaacaaaaacaattatcaaagtttaataaaaagaaaatctaaaaataatcctccttttcctttgggccaagtctagcccaaagcctccctcactctccctcggcccgcggccgaagtccttccctcctccctctctttttccttccctctctctctcttgggccgccctccctccttccccggcccactccctcctctccttcccggcccaccttctcccgcctcctcccgcctgggccgccgcccggcccaagccgccccacccagcctaccgagccgctcccctcccgcgtgcgcacgcgcgctgacgcgcgctgcgcgcgcccgaccgcgtggggcccacgcgccaggccggtcgcctcctttctcccggccggcctccttcctctctctctctctcccgtgcaaacctagagccgttcctcctccaaatccgcgcaaatcaaaccatggattccaaaattaattggggggttttaaatcccattgattcctcttcaattccccccaatttcccccttggatcgtgcccccaatcgccgggaacgcccgcgtcttctccggccgctttccatggccgccggccgccattcccgtcgccgttccaccctctcccgtgctcggctcgcttccctccgctataaaatggaatcccctcgctccgttctatcgttttagccccctcccgcgatctctcgtggtccctagccacctccccgccgtcgtcccctctctcccgtgccgccggccgtcttcagccgcccctgccgccgcgttagcacgccggccggccgtgccgtcgcctcctccagcgtcgccgccacctcctcttcgccggcctgccctccgtttcgcgcggtgaccgccggaggcgcgttcccaccgtcgcccttctctttcctccgcgccggccgcctacagccggctttccctcctcgcccgagcgctgcccggccgtgccgtcgccttccccggcgtcgcagccgcctcctcttcgccggcctgccctctgttttccgcggggacctccggaagtgcctccccgccggcgacagtggtgttgccgccactgttccgccttcggccacctctgccgcgtcgccggtacgccgatcgacgtcgccatctcctccgtcgacgtcgcagcgttgtcctcacctccagctgctcctctgtttcgccggaacgccgtcgcccgtgccggcctccatcctcgtcgtcgccgacgtcccttcggccgccccgttcatcctcgccggctcgtcgtctcgcggcgccgcctccgtcgtcggcatcgcagcggcgtgttccacgccagcctcgcctccgtgcagccgctgccggctgccctcgtcgccttctcgccggccccggtcgtcgtcgtcgtcgtcgtcctctcgtcgtcctcatcgtcgtggcgttcgtccctccgtcaagccgttctcgttcgtcgtcctcgcttcgtcaagtgctgcagccccgtcgtcgtcttcgtcctcggctccgcgtcgtcaagcctcgtgccggccgcgtctcgccttcgtccaaggatcgccgccgaagccgtcccctcgccgttcgtctccgttgtgcccgtctgtctccaccgcgcccgttcgtcgttgtcgttcccacgcctcgtcgcgtggtggtaaggatccgtcctctcgctgccccgtcctcgtcctttcggtgtcgccccgtacccgttgtgcggttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggagtccgtttgttggccactcgcctcggttgacacacggggtccgcttccgtcgacccgtggaccgtctctgtgtacccgatctaccgcggtcctttaggttgacatgtggggtccgcatgtcaacggcgcagccttcctgtcttttccaggctagcgcttacacctgttttatagttgcaaaacctaattacaataatccgcaaatctccatataacagcattaaacttcggatgatcatatcttggtcatacgagctctgaatcgacccgttcaagtctcctaatgtttgtataacctaaagaaccctgtgctttcttcttatgtattgttattgcttctttttaggcttgtagctttgcttgtgtgcttcgcgtagctttcgtcgtttcggaggttcccgaagcgtggttcgtggtcgtcgccgaaggttcggaaggccgttctctctgagcaaggcaagtcacatcatccttgagcatattgaatcccagtttataaaattattttaatttaaattaatgcattaccgctttatttaaattcccgcgttatcactgttttatttagccatgcctatttacctttgttatgacattattattgctattgttattattaccttgttcaccctaggataaacaaaaccccaactagtgggtactctatttatggttccactagtatgaatttaggtagatgcttcgctgattaattaggcaacattaggtggttttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtaaaacctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacgaccttgattaataatactgtgtagctttaggatcgtctttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgatggtcaggccttaagtgcctttgtaataatgtaaatattatcgatataataaagatgtgccttttgtatcatgtttgttcggtgtaccccggcttttcctgggacggggattaatacactagcattcgggaaaaggtaattttctcggtcgcgacaagctggtatcagagccatctcgactgtaggataagcccagtggataaaaacctaaggacatattttataaataaaactatttgcgaaagttcctctttttctccttcccctaatgctatttgcaaaaggtttacccttttcttccgtcttcaattttcaactagtactagatggtcagctttgcgaagaagaagatgtcgtcagtcgtttgccgaagctccggaagactgcaggatccgctagcgaagcaaaggaagtagtgaagccagctgtgaagcaggagtgaagatcttggagaacccgtcgcagaacctaagccaccctatagggtagtgttgttagtcgtgtgttccttgcttgtgtgtgtagcgcgtggtttgcatcggtgggtggtgatgtaaccatgcttggttgtttgcttaatcaacttgcagaataagtgaaacaaacaacacatcaacaagaagagttagttcctttaaggtcctgtccctagttctggtctattctttcctggcttgtttcctctctcaccacaatccctgtaacagatgtttaacagagaaaaaggaaagaatgtcagcgggtatgcctccagtaactcaagttttcaactcaatccaccactagcctcaagagagttaacaagggcacacccttggtccattccaagcatgctgcttagttcacagcgaccattggttggaagtcgagaccaaaatcagtatgtgtttgatcgagcatttgccacccaggtcaatgagcttccaatgccagaagagcatgtccccttttgtcatgattgtagagaacaaggacactatgcccttaattgtccatgggtatatgccaaagaagccccttcctttggtttagcagggcagacatcgctaaaccagcctcctcgcaccaagtcaagcttgcagcctagtgtacaaagaagagagcccattagagagaatccattgaatcccggaaaatgctttcctcctagcctttcgtaccacgtggggtcacgtactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccatggcggcagagtatctgatagtgaagggtcagatcaagtctcctcggattatgaagatgagtctctccgacatctcggcgaggaagagatggaatcaaaagcatgcccccgttgtggagaaattggacacgttgctagcatgtgtctcacactttgccctcattgtgaggaagaccatccaccaggtggatgtcccacccgcaaggtcacatgttttctatgcgaaggtacaaaccatgtgcccaaggattgccaactcagtgtgttgttgaccaagactgcagaaatccaacgaacaaccctacgattgtctcatcagctagtcagctccaacatcaacatcgacgatatcatccccagcaccaatgctcctcctgctgcacctgactctgcagtaaatcatagcaataataccttcaacaccaaccattctctgcaccgacggcctcagcaaagaattgtcgtcgatggaagaagttgtgtctctccccgacctactccaggccgagcgaagggcaatcaatctcaggagtgcgataccaagcagaagaccgttatctgcttcaaatagcaatcagaaggaagcttctcctgtgaatgatagcaatatgcagtcctaacacatcatcacagaaccaatcaaggatgcagtcactaggacaatgccagctatatctctccagaatcaaaatgagtagccacgtttgtggtttttagttcgctacttatcattgtgtaatcgggagtttgcagcaatcatgtaataaataaatacattcatgattataaacaatgagtttgttatgtttatggaagattcatgttgaggatgcaatgtactgatgttaagcaccttccctttttgtttaaggcaaggccttgcattcatgtaataagggagacatgtgtaataaaaacaagttctatgaggattatttcggaagatgctgatatgggattatgtgtataattgtttactgtcaaaggagacctagggtctcatttcagaggaaccatgttctaacctcgagttaataaccaacctgatgatggaaaagaaaatcaagcgattaaccaaagagacatttgtttggactaagagtttcagacgtgtctttttcggatcaaaggcaatgacagtcagtatagcttttggcgaaaacacttcaaggtttcactgaaaggcagcagaccaaaggaccacatcgtcaccagaagcatccacaactctcggagtgaagagtacttggttgacaaagttccaaaggtgactaatagaagataccagcaaaggtgtttattgtcgggcaaagaagtaggtcgaaaggtgattgatacgagaaatctgaaaagaatacatcagggttgaatgtgtgaaggaatactttgaatgctaaataatgacaacatgaagagaatagcaggaagtaaactgaatgtaaagaaagtgaatccgagttgtctgttcatgggaactattcccagttatgaaccaagtgatatgttcgaagatagtctatagaggtcagattaaaatcgcatctaacagtgaagcttcagatttggcagggtaacgatcaaacaataacaagtccagcagtaaagtcatctggaaaggcgtcaaagcatgtcaagtgggataagttgactctgttgagaaacataattgaaaggcgaaaattatcgaccctcgcatcgcatagcagaagtagctagcacccggagaccaggaaaactaatatgaggcagtttgtggcaacttagaagtagatgacaagcatggtatcctagtaatgacgagctgatctcgacgcatgacatgaagtgggtaacttgtatgaggttgactccaaagatatgaactatgcgaagttctggaactgaagccccatcttcaagtgccgcaacccagtcgaagtcagctaaaggttcaaccagggacaagtcaggtgaagagaagattccatctgcaacaggagatcgagccaagcagtccagagtggagaagttgtgctaggcaagtttgttatagaagacggagcggaagaagtcaggcgagaagagaagaccgcccaacctatcttcttgctagcctcctcgaatctcggggacgagattcctgtaagggggggtggatttgtcacgtcctgataaattcattccgaaataaaattcattttctaaaaggaataatagaattaattaaaatttgaaaagaaattggcaaacaggggatcctctagagtcgacggcgtgcacaccaatgagatctcatnngcacgg

SEQ ID NO: 6558 - DNA, 775 bp, Oryza sativa
  unsure (1)..(775): unsure at all n locations
ngtacaagacgacccgtgtagtgcgactgaagctcgcaataccataagccgtttttgctcacggatatcagaccagtcacnaagtacaatgggcatcgtattgcccgaacagataaagctagcatgccaccggtatacagcgagtcgctctttgtgaaggtgacgattacctaacaatcggtcgattcgtttgatgttatgttttgttctcgctttggttggcaggttacggccaagttcggtaagagtgagagttttacagtcaagtaaggcgtggcaagccaccgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagtgttaagcaccttccctttttgtttaaggcaaggccttgcattcatgtaataagggagacatgtgtaataaaaacaagttctatgaggattatttcggaagatgctgatatgggattatgtgtataattgtttactgtcaaaggagacctagggtctcatttcagaggaaccatgttctaacctcgagttaataaccaacctgatgatggaaaagaaaatcaagcgattaacggggatcctctagagtcgacatgcnggcatgcgaccatgtgctaatacgaatgtcaaaggtgggcgcagg

SEQ ID NO: 6559 - DNA, 1344 bp, Oryza sativa
  unsure (1)..(1344): unsure at all n locations
ggagccnatttgaanatcgatatgcagctcganacccncacgccgttnccttgcaccgcccgtttncggcgagctccggccgcccgccactcgtggtacaaccaacgtctggccaatccgacaccaccatcggcttcgcggacccgtgccacagcccggcctatactccatttcccctctccgcctcgggaacaccgccgcctcgtgcaccactgcctaccacctccggccgcctctagccgccatcctcaaccacctcaagccacgccactgcctcggttagatccaccaccgcaagggcaagcccggccgcccatccttttttcccctccaccaccagaaccacctccccaccacgccaccctaccggccatttttttttccgtctccggtcgccgttcgccatcaccccagctgccgccgcgacgcgccggccgcatcgcctccttcgccgcgtcccgctcttccccgtccgccgcccggtcgccgccttccgcacgctcggtgagcccctcctcccactccccttccctttcgcgtgcatcgccactgcccgtgagcgccgccgtcttccgcctactcgccgccgtttggcgccgccggctgctgcctccggaggccgcacgctgccccgcaccatggctcggccgagccggtttcatgccgtgcccgtgccccagccgcgccgcctcgtggccatctgatcggctttgggccaatccgggccgtcggttcccgtggaccggcggtggaccgcctcggtggtcccggtccacggtggatcgacgcccttgtgtcgctgaccggtggggcctgcttgccggcgccgcccctcccccttgatgacgtcagcacagccttttcctttgagaaaataagtaataattgcgcaataattcgtgaataattctagaaattcatataaatggctcaaaacttctaaaattcatatctaattcattcgaactccgaattgagccattcaacttgcaaaattcatttaaaattgagctctacatgtttgtttagtttttatgtactgtttccttggtttttattagagttttcctcgttttgcgcgccagcgtgtagaatccgttgtttcggaagttcgcgttcgcaaggataagagttcagaagatccaagtgaagaagcaaggcaagtcacacattccccttgagcatgttgatcccaatttataaatgttttaccgtttacaaataaatatgcatgttttgctaattacatgggatccgggtattacctatnnnnnnnnnnnnnnnnnnnnnnnnnnnnnnnnnnnnnnnnnnnttgtctatcgaattcaaatnnnctagccgcca

SEQ ID NO: 6560 - DNA, 939 bp, Oryza sativa
  unsure (1)..(939): unsure at all n locations
cgccgatactaagccaatcnnnnnnnnnnnnnnnnnnnnnnnnnnnnnnnnnnnnntgggttgattaaatgccgttggatgtgatgggggggttaggtcccgatcttccgataggtattgataaacaacgagttcgatggagtcgtgacacaactcgatccggcttccgaacgaacacgctactgagcccggcaatcgcagcaccacgtctcctctggttatcaaccgtgccaaaacccggttgacctcgccgagaaggctaatccctggatgcgaatcgaagaacacaagcaagaacaggatagattgcaaccaaattgcatatgaatgattaagcactcgaatttggggttctacaaaccgatctagcggcgaaactgttcttgacagaataatctaagcaaaacccgactctaaacgatgacggctactgaataaatgtgcttagggacgtcatagggttgccctagggcgcacacccccttgagctaagcccatgacacaattacaaggctcaaaactcaaaatcagattcggactggatgagatacgtggcttgttttgcagattcccggcagctcggtaggaattttgacatgggaccaaaaccatttgaaagtagactccataatctttccaacaagtactcatgggcctcgaaattccttctagatcagtggctaggtccgtttgaagttgatgctgtcaggaggcccgaatccgaatccaaaacgtgtacaacttgatctcttgtcttctatggaccaatagtgacgtggtgaggtagaagtagacttgaagaaggtcttggtttggtccccaatcaacttatttaatcatccatgcattagttacnnnnnnnnnnnnnnnnnnnnnnnnnnnnnnnnnnnnnnnnnnnnnnnnnnnnnnngttcaagaatccaaaannggggttatcag

SEQ ID NO: 6561 - DNA, 702 bp, Oryza sativa
  unsure (1)..(702): unsure at all n locations
gagcgcattgagnnnnnnnnnnnnnnnnnnnnnnnnnnnnnnnnnnnnnnnnnnnncccggacattatctggaaggataccccttattacaactggtagcagttgtgtcatcaacacgtgacagtcatgagactttaggtttgggaacttcttatccttcgggcttattattcgctttatattcgcggagtattcagacggtaccttgatgctctccaagcattcaaacatactttccttctctgccttgctaagagtgtaactggctggactgaagtaatggcttcctttctcctttggttccggatgaaggtcgccgcgttgttccatacacttgagatcattacgtgcttacagggtatctttccactttccatatacacctaggaagccaaaatggtttacagaacggttcttaggggggagcctcagctagatagcctggtggacatccaagtattcaccaaaaggatgttgacaaaatttacaccttcttttacacatctgcgaaggaccaactttggaaccaatgggcgaattccagggccttctcccactgcttgtccacaaagtttacgccctcccaacgcgttttcaccgttgtatgtttaacctcccaaacatatggccccctttcggccacaatgctatgctatctcctccaccctggacttttgcgttactgttagactacatagacct

SEQ ID NO: 6562 - DNA, 745 bp, Oryza sativa
  unsure (1)..(745): unsure at all n locations
gcgcgccatagtagatagcaaaccnnnnnnnnnnnnnnnnnnnnnnnnnnnnnnnnnttgagagatgaagtgaataattcaagtcatcaaagaaacataatgaaacattcgacgcctcgagagaagaatattggagacattgctgggcttttagcctgccagtcaacttcagcctgagatgtgcccgtcaaaccactcgaaggcggcgaccagatgtgttacacattcaggagacttgacaaaaatggctaaagatctacaacatctcaaatattcttaacacatactcatgtgaatctacttcccaagatgtgcactagattcacactttcatcttaagcatggaaatacatagcaaaatacacttaagacgaaaataatctaaatcacaactacttcatagttacataggccgaccggcgaaataaagatatagaatagcgggaagcttgactacccaatcctcaagcacaccgactaggggtttaccccattaagttcaagtcctagaagaagcaatcgatcacccgcatcactcaaagactaaatttaaaacatgcaagcaaaagttaattcaacagcaagagtcagtacattattaaaaataatgtactggcaagtgccaagacaagcctaacaccctactggcaggcatataaacaaaggaaggatagtatgttctttttagcataaagcaagttttatttgataaaacatttttaaataaaattggtttccaataatg

SEQ ID NO: 6563 - DNA, 778 bp, Oryza sativa
  unsure (1)..(778): unsure at all n locations
tttccgggatattaaatcacggtatattatttccaacccaaagcctaatattctttaatgaaataagatcttggcataaagggcggatttaacatgtcactgaagcatatagagcgaatatggttaaatcagataagaccgactgaagctccgatactaccctaatcggcaatcagaaggcaggctagagattgatattctaagcacgacttgatagatcaaactcaactaatgcagcattaagtataaaaaaatgaataatatctagacaatcaagccgctggaagtttcatagagtggtagatatcttatataatctaaatcaacatcaaaatctaacctaatcggctgccctctactaacagatgttagccgattataggttagatagcgatcttgccagagattatgtacgatatatgataccttgatgaattacgtaaacacgattagagtatcataaagatggaagctctaatcccgagaacacaagccgtcataccaagttttacctcttattgaagatcgaaaccgatgcagctcaacccgaaagcaagaacccgtcgaaataaaactaaagcaaaaaggtggcgatgcgccgaaattgtattgaacgtgtgtgttttttattacatagggctcggggtctatttatacccgagaattacaagatatgtccataccggacatgactattatctctaacaaactctaagatannnnnnnnnnnnnnnnnnnnnnnnnnnnnnnnnnnnnaagtatttcaattnncgtggcc

SEQ ID NO: 6564 - DNA, 716 bp, Oryza sativa
  unsure (1)..(716): unsure at all n locations
ctggcgnccnnnnnaatatagattctaaatcctgcatgcctgcaggccgactctagaggatccccttccttcatatccaacgtactgagcccagttgggaatgttctcgtcctccacttcatcttcttccatttcaaccccttgctcaccgtgagatgtccaacaattatagcttagcatgaaccctgactcaaacaggtggaaatgaatagtcctggatgcagaatactccttttggttcttacacttattgcatggacaacaaataaaaccgtacacttgttagcttcggccactctcaaaaaataatgcacgccctcgataaactctttggaccgccagtcaatgtacatccattgcagatccatctacatgaaatgaaaaaacatcgtacataaataaattttcgtacaataatgacagtcaaacagtaatgataacataattaaaaactctttcgacaagcaattcttattaacaatttttgaagttctaaactaatatttatgttgtacttctcttaattttaaatttaggttggtttctattttttaagattaattttcatcatattttaaactatgagaataaaatttctatatattcttcttccccacacaaattttctctctcataacttacaacaaaatttggagacaaataaaaatgtgtgaaacatagctccaaaagttatataacaacaaaaaacatttgag

SEQ ID NO: 6565 - DNA, 938 bp, Oryza sativa
  unsure (1)..(938): unsure at all n locations
aatagaaacaattgcctttccaggtctctatccacgtggggcaatcatcttgaagcatatcaactcaaacccaatgttggatacgagtcatattgctggaatcggctgtatcacctaacccagtctgattcagatttagccgattctagtcgtagccgatctggactccagccgattcttactctgttcccgcaacaatccttatctctggttccgcttcgatcccatcttcacctccgatgctgatattaccaaatttggtcgttaacacagacctaaggagcaagctttgttaattattctctgcagcaactcagcaccaagaacaaaaaagcaatggtgagagtggatctcattgcccaaccccccttctgcatttaaaagagtttctaggtaccccattaagtagtactgaaaaatgtgccgtagaaaaaatcatctgtatccactgtagccacttttcaggaaaccccatacatttcataatggatatcaaggtggagtgctctatagaatcaaatactttagcaatataatttctctctttgactactggcattgatgaatatactctaaagaccatgctaaacagtcttgaattgtcctgcctttgataaaaccatattggttctcatgaaccagtttaggcattacactctgcaacctatctgccatcaatttggttatgaactttaaactgatgcccatcagtgaaattggcctgtaatcattgactgtttctggagaggacttttttggcactaaggttatgtaagacatgtttagcagctgcagatctgtatagcaagcatgaaagtgagctgctaacctgtaaaagtcctgtgatatgatttgccaacatttcttaacaannnnnnnnnnnnnnnnnnnnnnnnnnnnnnnnnnnnnnnnnntttactaccatcaaaggggcgcca

SEQ ID NO: 6566 - DNA, 1100 bp, Oryza sativa
  unsure (1)..(1100): unsure at all n locations
tggcccgccnnnnnatagnnnnnnnnnnnnnnnnnnnnnnnnnnnnnnnnnnnnnnnnnnnnnnnntttgtcatatatatatagtgcgcaaaagcaagcccagggaactaacttgtgcggctactacgtgtgcgagtattgctactgccttgcataccaaatcatcaccacaagagagctcgatgtacatacaaataaattcaaaatttcattgggtacgtatcgatttgttgttgactaattaattcatataggttattcgcatgagggataacctcacacacaagtaatttatcgcggcggttcaagaacaactcatgggattcatcaacgaacaaatccttgatcccgagagaaatacaattcataggtcgttagcttctgagataacgcctactactacgtcgaagtcgtagctagctcggacatcataatgaattgtaattaatacatgtctatttttctatatgcatgtacacatttactttagtgtaaatatatattttggtcatatatatatgcacataaaatgttaagcgctttaatatatatatacatatgcatttgcataacatatatatatgtataaatacaaatatattatgcatgtatatgtattgaaacatatataaatataatatatctatatatacatacatatatatatatatctatatatacatacatatatatatatatatatattatgcatatatatgcatggtttatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatctatctatatatagatctctctatatagaaaaatatatatatatgtgtatatatatagagatacatatatatatatatacagatatatatatatatctttttttatttatatacacgcgcccaggtaagagggtttttc

SEQ ID NO: 6567 - DNA, 809 bp, Oryza sativa
  unsure (1)..(809): unsure at all n locations
gtgcttccactgatnntcactctttgaanaannnnnnnnnnnnnnnnnnnnnnnnnnnnnnnnnnnnnnnnnntcttgacgaaaaggatgttgagtgcactgccaccatcgatgagggatctgcgaagcttgacgttgcgaaccactgggtctagtaccagggggtaccgccctgggtggaccacacggtaaggatgatccaagcggtcaaacataattgttgtctctgaccaccgaagatattggggcgtgtcgggctgaatagcgttgatctcccgttcggttagcttttgctttctcttggattcataggacaggggtccgccaaagatgtggttgagttccttgcgatggtcttgaaaaccagtcggggcgtcaacttcatcatccttctttaacgtgctttgatctccgtcagaggccttgcgtgcattcttggcgtattgttctgcaaactgtttatagacgaagcaatctttggccgcgtgattggagtttggatgatgcggacattgggagttcatgatcttgtcaaaagtgttgacccgtgaacgttgtcgggaggatggtgtagtagttgccacaagttccttgggtttacgcttgcgatccttgtgattggtacttccactcccccctgtagttggcgtatctttcttcggcttccaagtggtgcccgactgcttggacgcggtaatgacatcttctgcttgaccgtcctgggaggcttgcgcccgaacttgccgnnnnnnnnnnnnnnnnnnnnnnnnnnnnnnnnnnnnnnnnnnttgtcaatcaaaaggcgcagt

SEQ ID NO: 6568 - DNA, 10214 bp, Oryza sativa
  unsure (1)..(10214): unsure at all n locations
cgagcccctttgattatatnnnnnnnnnnnnnnnnnnnnnnnnnnnnnnnnnnnnnnnnnnnnnnnnttagctctgttatgggatgagtcagtttttgtggatattaaaggaatgaatgaaaggtatattgatgcgtatgtgcgtttgtccccggatgctcctatatggcatgttacttttgtatatggtgaacctaaagttgagaacaaacatcacatgtggtctctgttgaacttgctgcgacaatcatctactttgccttggttggtgatgggcgattttaatgaaacactttggcagtttgaacacttctccaagaccccacggaatgaaagacagatgcaggcttttagggatgcccttcatatctgtgagctacatgatttgggtttcagggggctaccatatacgtatgacaataagagatagggagttaataatgtcagagtgcggctggatagggcggtggcagatgacaattggagtgatcggtttaaagagtcacaggttgaacatctggtgtccccatgttcggaccatgcccccattctgctgaaatttgcggttgaagagagccgacgggttaaacgcaaatgtctgcattatgaaatattctgggaaagagagaatgagctcccaaatattattgacgaggcctgggcagtagcaggtgataaaatgaacttatctgaggtccctgagcaaagtcatgatgtccttacacggctggagtaagaggaaatgcaagaatgtgggcagagaaattgagaaatgtcgaaaggagctagctgccctactggaatcaaactcggatagtttagcgattcggggagccacggataggctaaatgaacttctatacagggaagagatgttatggctccagcggtcgaggataaattggcttaaagaaggtgaccgtaatacacggttttttcatagtagggctgtatggcgtgcaaagaaaaacaaaatcaccaagcttcgggatgccaatggagttgttcatagttcgacaaaagtaatggagaatatggccacacaatattttgaatgtataagagagatgaaatgcttgatcactctcctataacccagcttatccaagggaaagtcacggcagcaatgaatgaggagttatgtaaggatttttcggacgatgaaattgcaacagcagtttttcagattggtccgctcaaagcgcctggtcctgatgggtttcctgcacgggtttatcagtggaattggggtcttttgaaggatgatatcagtaaggcagtgaaggttttctttgatacttgggtcatgccaaatggagttaatgagatggctataatactcatccctaaaatagaagccaatggaactaaaagactttagaccaatcagcctttgcaacattatctataaagttgtctccaaatgtctggtgaacaggttgagacctttgctggatgagttggtttctcaaagccagagcgcttttgtcccggggcgtatgataacggataatgcccttcttgcctttgaatgttttcacagtatccaaaagaatagtaatctgaataaaggagcttgcgcgtacaaactagacctctctaaggcttatgatcgagtggactagaaattcctggagcaggcgatatacaagttgggtttttcttgccggtgggttaactggatattggagtgtataaccacggtgaggtattcggttaaattcaatggaaccctgctatctacacttgctccttcgcatggacttcgtcagggagaccctttgtcaccctttctattcctgttcgtagccgatggtctatccttgctcctggatgataaagtggccaaaggagaattaacgcctgtgcatatctgtcaccgggcgccggggatatcgcacctcctgtttgcggatgatactttgctcttcttcaaagcaaacgtccaacaagcaaggatcatcaaaagagatatgcagcagcaacaagccaattgattaatcctgcaaaatgctcgattatgtttggagagtcatccccggtggaggtgagagaagctattaagcagaaactgcagatcgctaacaactcctttgaggataagtacctgggtttccccatcctagaaggaagaagaaacaaaggtaaattttagagtttacagaaaaagatctggaagagggtgctccaatggggagaaaacttgctgtcaagtggtgggacggaaattttcataaaatcggtattgcaggcaatccttgtttatgtcatggtgatttttcggctgccagattcggtctgtgaggacttaaacagattaactaggaacttttggtggggggctaccaatggggaaaggaagatacattgggggtcatgggacaacctgatcaaaccgaaaaaccaaggtggacttggttttagggatgttaagcttttcaatcaagcacttcttgcaagacaggcttggcatctcattgataaccctgaaagtctctgttctagggtcctcatggcaaagtacttccccaatgtttcccttgttgatacttggtttggaggcaatgcctctccggggtggaaggacatcgagtatggcccgtccttgctaaaagaaggaatcatctggcgcattggtaatgggagatgtgtgaggatctggagggatccatggctgccaaggaacttctcaaggagaccgatctcgcaaaagaacaactgcaggttaaaatgggtgtcagaccttactgcggatggtgtttggaatgaagagaaaatcaatgaacttttcctatcgatagatgctgaaataatttcaaaaattcgtatttcatctcgggaggaagatgttttccttgcgtggcatccagatgtacacggcaggttttcagtgaggagtgcatactatttggctctgaatctcgcgaaccagaatgtggctgggccgtcttcgggaggtggtaacaagtcttggcatctgatatggggatgtaatatcccccagaaggtgaaaatttttgcatggaagatagctaccaactcccttgctactttggttaacaaagcttaaaggaagctcgagcgtgttgccacttgtgtgatctgtgggttagaagaggaggatgcctagcatgctctttgccgctgcactcaatcaaaattcctgttactagcgatgcagagagccggttactttccaagattttcagatgattatagcgacaacccttcttggttttttatgcatctggaacggctttcggactcagagcgtgctgcttatatgatggtgatgtggcataattggttcatccgaaacgagattgtcgatgacaaaattcctccgtcgattgatgcctccaaaagattccttgagagctacattcaaacactgtttgaaatccgacaaaagtcgagggatgtgtcaggcaagggaagagttctgagattgattggaataggaagctccttgcttcctccgggcctggtttggcagcgaagaagagatgggtgaaaccatagcgagggtggatgaaagttaatgtggatggttcctttgatgccctgaatggaaatggggggattggtactgtcatgagggattgggaagggaaggtggtcttagcttcttggaaattcctcaagactggcagtagcgcacttaaagcagagctcttggcatgcaaggagggaattgcaatggcacgcacctggacaaactatccagtttaggtagaaacagattgtgatgtagctgtcaaaatgatgcagtccaaggacaaagagctctcagagctagcctatgtgatacgcgagattagagatctcctcgctggaaatcgggaatacacacccaggaagacttacagaagccaaaacttagtttttttttactggaaatactgtcaggactttgcctcgcagtgtaattttataaattgaaaaagttatttacaaattataagagaataaacaaaagagatcaaaggatcacattgtttgtaaccaatcaaaaacaatctgttttagcggatccttcattctgcacaaatgcagaagaacttcggctttgaattaagccctccaagaactgaacgagggaagctcattgtgaaatttttttccatttcatcgcttccaaatgtgccaagcagcaatgaagaaaatttccaagaaacctctctgattgaactgaatgcgagccaaaaccaccatctaaaaaaattctaggccaggattccatgtaattcccaaatgttgccagcaaagttgactgaaagggcagaagaaaaaaagatgttatcttgtctccttgatattattccggcataattcacaagtgagatcatctttttcctttgcacaatgtcgcctatccagcatatctcttgtgttaagtctgtctctgaataaaagccaagcaaaaactttaatcttcattgcacatttggtcttccagatccagacaaaaggcctcgacacatgcacatttgagtatgtcagcttatgaaacctcttagctgtgtatttgtcagagttccggatgaaagaccattcatcaccattaccgttcagcagagagagaagaccattcctcctctagaacagtgaattctccataagcctgggtgctcaggggcagtaaaaaacaatcctcaagaggagtagaacctatttgcttaatagagagagttttatctaaggcaaccatatataaagatggaaaagcattgcttcttatcttatcattccaaatgtcatcctagaaaagagctgaagatccagtcctgatatggcagtttgagattcccctgaaaacatcagtcagagccactatatccctccaccaaaaagatcctttattccaaactaaatgtggcactttagagctataataagagttccatatcagttgaacccacggcagatcatgtcctttgtaaaatttgactagatgtttaagcagaagcgctatattctgaactcttagattgatgactcctagtccaccttcatcctttggtctgcacactagatcccaagaggctagagatcttctggttgaagttggattgtttcccctccaaaggcaatttttccttgcagtgtcaatagcttttaccactgaaacaggcagctgcaaagaacacatgtagtatgttgggattgaggaaagcacagagtttatcaatgtgagtcttccaccttgtggcagaaattgtgagcttgctattaatcttctttctaccctgtctaccaagggtgcaaaatccactacccttggcctagttgttcccatgggcaaacccaaataagtaaaaggcattgtgcctatggtgcacccaagcacaccagcaaaaagccctgcattctcatgagataaatcgattgggtagagacaggacttatgataattcactttgaggccagtagagtgtgcaaatgaattcaacaatgccttgaaacaaaacacctctctctccgaagctttgagaagaattagagtgtcatcagcatactgtattactgggaaacccttctcatcaagttcattaattggcttggtcaatagactgttgacgtaaaacacgaggcctgggagatccgcttaactccagtgcaggtccaaagctcgcctttgggtttgttagcgtgccagttgatttgatcctgcaatcaacaagaaatagaaacaaagagatcgcggttaaatctataaatgatagccaatcagctaagtgccgatgacatatcatttatctttgagccgatgtcatatgtaaatcgatcggtgactataaatagataataaagaactaaacctactcgatcggctgtagatattaccaatatatagttcttatatcgatatatatttaaatcaagtgattgggatagatcggtcaccatgccgagacagtataaatcacttggatcgaaatatatattaataacaggactatatatgtttatagcatagccgatcatatagatctagcatgtatcggctaatactccgatactactctatatcaggatattaaaacaagtataatatatcaaacaaaagcttaatatacttaaatgaaataagatcttggcataaagggcggatttaacatgtcactgaagcatatagagcgaatatggttaaatcagataagaccgactgaagctccgatactaccctaatcggcaatcagaaggcaggctagagattgatattctaagcacgacttgatagatcaaactcaactaatgcagcattaagtataaaaaaatgaataatatctagacaatcaagccgctggaagtttcatagagtggtagatatcttatataatctaaatcaacatcaaaatctaacctaatcggctgccctctactaacagatgttagccgattataggttagatagcgatcttgccagagattatgtacgatatatgataacttgatgaattacgtaaacacgattagagtatcataaagatggaagcactaatcccgagaacacaagccgtcataacaagttttacctcttattgaagatcgaaaccgatgcagctcaacccgaaagcaagaacccgtcgaaataaaactaaagcaaaaaggtggcgatgcgccgaaattgtattgaacgtgtgtgttttttattacatagggctcggggtctatttatacccgagaattacaagatatgtccataccggacatgactattatctctaacaaactctaagataccataagtctttgcggcagacttttgccctaagcatatctctatggaaattacataaaacatcctaattaatagatacaattgccttttcaggtctctatccacgtgcggcaatcatcttgaagcatatcaactcaaacccaatgttggatacgagtcatattgctggaatcggctgtatcacctaacccagtctgattcagatttagccgattctagtcgtagccgatctggactccagccgattcttactctgttcccgcaacaatccttatctctggttccgcttcgatcccatcttcacctccgatgctgatattaccaaatttggtcgttaacacagacctaaggagcaagctttgttaattattctctgcagcaactcagcaccaagaacaaaaaagcaatggtgagagtggatctcattgcccaaccccccttctgcatttaaaagagtttctaggtaccccattaagtagtactgaaaaatgtgccgtagaaaaaatcatctgtatccactgtagccacttttcaggaaaccccatacatttcataatggatatcaaggtggagtgctctatagaatcaaatactttagcaatataatttctctctttgactactggcattgatgaatatactctaaagaccatgctaaacagtcttgaattgtcctgcctttgataaaaccatattggttctcatgaaccagtttaggcattacactctgcaacctatctgccatcaatttggttatgaactttaaactgatgcccatcagtgaaattggcctgtaatcattgactgtttctggagaggacttttttggcactaaggttatgtaagacatgtttagcagctgcagatctgtatagcaagcatgaaagtgagctgctaacctgtaaaagtcctgtgatatgatttgccaacatttcttaagaaagaacccattaaacccatcaggtccaggtgctttgtctgatggaatgaccttaataagactgtccacctcctaagtgtagaactgattaaccaaacaatccaagttttccggattggggaagagatccctcaaatcaaagtccattggaggcaagagcgaaattcccattctgtttttgaaactatgaaaaaacagatctgctttgtgattgtgtccagtggctatctgcccatgctgatcctgaacctgagaaatggagttcgatctatatctttccgtagcaatggcttggaagaatttagtattttcctcacccaataatatccatctattcgtgctcctttttttttccaataaagccttttaaactcaagaagcataaggatctgtattttgataatttctctgaagttccattcaaggatggacaagggccgatgctcttctattaggtctaggaaattgattacagcattacaattaaccaaaagggcagttaacttagacaagtttttactccaatgtagcaaacttttcctcaaacactttagcttgaagctaatgcattttgccggatcttcataaccagggtctattgcccatattctgctaacaagctcaaagaatccttccatttcaacccaataattctcaaatttgaaaattggagactttggaatcttggtatcaatttgatctacacagggcacatgatctgatatattcctggtcaatgggtggacagtagtgtttgggaaaaccaaagtccaagctggacttgtaaagatgtcacgcctagaaatttaacctaaatttccagactattttgcgtagtaaatccctgtccaggaccagccagggtacgcaaaacgacaagtaatatacagttccaaacgtaaataaagcgtaaaatacttacggaagagacacttagtcctcacaccgaaacagaacgacagcagcggaaaaaggcgatcctagcggggcttcagctccactccacaggcaaaactcaactggggtctgagccttggtcctctaacttcgtcttcagctcagaagaactacacttctgaaaaggggaaataatagcaaggctgagtacaaccaccgtactcagcaagccacaccaacgatgcagatgtgcaaggggatacaaggatggtttgtggctatttgcataaaggcagttgtaaaacattttattgagcaaaacagtaaaacggttgagtaattaaagtaatattgaatctccactgatcaacgctacaccacgttgaacaggcccaaccaacccacctggactacagtgcattgagtcgatttattaaggtgggactaatcacggtgaatctggtcgaccgcccataaccgcgggcacggctattcgaatagttttactctgatcagaggtgtacaactgtacccacaagacagccccacgacacgtttccgtgcaccgacatgccaccacgacatatcggaaagaggccgtgacaggacccttcgtataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaattgccatgggtgcgactagcaaaaccatgcacccacagcccaccattcagtcgcattttagttggataattacgaccatgaagcatggccagatgtctcgagcacgcagctcattccgatactaaaaggtctaatactgtaattatcccatcaactgagctagtggtaattaagcatggctaagcatatagttctagctagttcacataagtaacatgagctagtcgattcattacccaaggttgacaaagaacaaatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcacttggatcttctgaactcttatccttgcgaacgcgaacttccgaaacaacggattctacacgctggcgcgcaaaacgaggaaaactctaataaaaaccaaggaaacagtacataaaaactaaacaaacatgtagagctcaattttaaatgaattttgcaagttgaatggctcaattcggagttcgaatgaattagatatgaattttagaagttttgagccatttatatgaatttctagaattattcacgaattattgcgcaattattacttattttctcaannnnnnnnnnnnnnnnnnnnnnnnnnnnnnnnnnnnnnnnnnnnnnnnntgcagggttctcaacgcgc

SEQ ID NO: 6569 - DNA, 4475 bp, Oryza sativa
  unsure (1)..(4475): unsure at all n locations
nttgtgcacgggtcccccaaaccaattggtgttgncggattggcccgccgttgggtgaacaancggtgcggccggccggagctcnccggaaaccgccggtgcgtgggaccggcgtggggaggggaaagagagcncggctggctcgggtaaggaggggaaaagagagaggatgctccggggttcgttttgatagggtcggagcggcggaaacggggccgagaggggcggcaaccggcgcggaagtggggcgccgacggggggtggtggtggctcggccggcgccggtttttgtgggacgagcggggaaaatggtggaggacgtggaggggatcgtgcccacgtcgttggatgcgagctcgggtgcgggagggcgccggattttgcggcgacgtgggcggcaatggcggttggggttggccggcgagaggtaggaggaggagctgataggtggggcccacggtcccacctgtcggccggatggagagagaggagggaaaccgggggacgtaaagtagactttcgcaaggcgcgggccggccgagagagggaggtggcgcacggcccacgggagtggaggggaaggcttgggccaagcccaaaagggaagggaggggattttatttgttttctttttttttaattgattaaatgaactttgtgctattaaaattatttcttgagctccgaaaattcacagaaaatttcagagagtattttagggcaaaagaatattgcaaaatattcctggccaatgatttttaagggaaaattttaattctcccattaattcactcgaataaattgctttaacttttaatataatttcttgaaatgcattattaaatgattttaaaacccgaacgaaaatcggggcgttacaaaagacccaatcaagccgctccaggagaggactgttctgcatattgctccaggtaaaacttctcccttttaaaggaatttctagcagaccaagagaactaattacatcattaaaaatgaatatatcattcatgtcggcttccggcttatttctgtcctcaactgatcggtagaaattaaagtctcctagaaaaatcctattatccattgtcccaaaagacatatttttcagccaactaacaaactctgtacattctgggccactacatgggccatatatgcaggttaaggcccaagcttctgaagattgccttgaaacaaagtttactgtaacagaaaaactatttatttcccctggggttcccgaaaacactttagaggcccaaaccactaatattccacgtgaagcacctcttgagggtgagaaagcaaacacatcaaaacgcttagaagcaaaagtcctaatatcagccaaagagaaattttgttttttggtctctcggacatagaaaacctggcagccactttcctctatcttttgcctcaaagaaaatagtttggtatcagcattcatgcctcttatgttctagcacagcacattctaggatttaaacacattattcatgaggaaaacatttaggagtgcatatagatacagagctaactaaattagcctgcatagagccatataaaataagttcccagcaaacacaaaaggaactgacactgatcacagtccgacagtactgaaaaacaaaagatcctgctctgagcaaagaaacattattcattcctaatcatccatgtttggtcggggaagcttcttccttttttctccccctaagcttgattcagccacatcctcaggattcaggccacatagatccacccccatcttttgcaacaaagataaagaacaatcagaaggggaagaatctgagtttatatcatcttccagaacattgaaatcagattcagtaatcttgctgccagggataaggatttttgatatacctgccaactccttcagctttttagctgactttccccttggcttgcctattcccagtcgatgatcaaatttgagctattggttggcattaagaagcctagagctatgccttctagtaggattgtacataatagtcttcccatccctttttttcacaggagcaataggaatctgaagcactgctgggatgacttctggacttgatggctaggcttgcaaaggtgcaacatctaaaatctcctgatcagaatgcccatcatcagagggggaagacaataaagcccagctagaatgtgctctttttactacaggaggagcatgatcaaacattgccttccgctttaggagtaccagggtcatgaaaggggaactgaatggcagagatgtggggctaggaatttgagctgcctgcatgatttctttagctttgcatagatggtcaattttctccagcaatcctgccataggataaaaagatgggtgctttggtccttccctgtcagctatatccttgagcctggccagaaacagctgcacttgttgctcttgatcaatcagattaagctcctgctcctcttgattaggcaagataatcaattgccccgagttttcttcgacctggcccattgggtgatcctgaccccaagcatcctctatttctgcttccgcagcctgttgctgttgcacgagatcatcccaaacaccacctcccccctgattaccaggatgtcctagttgccaaatatttccatcatctgggtcatcggcattatcatcattaggcccaggctgtggtccagcaggaggtaaatcatcttcaggtgggatgtttgcaaaatctccatctagtacaaaaacagaaatagtccatgattcacctccaccaccattacccaaaggttcctgtaacactatctttcgggggacagagtcaagatccctatactttgctctcacaaacactcttcccaacatctgatctctatcaagctagaaagaaagttgtccaaaagaagctaccgctagatttatatggtgacgatcaacaaaatctagcgggaaatccaagagaagaaaccagccttctcgattaaagtggcaagcacgccagttctgcccttggtcatgcttcacaagctcaacagtatgcatcccatcatatgcagcagggggagagtttactaaggcatctctatgcatgactgaacgaagctggaacataccaactgtcgaagggtgacggtaagcagtacgaacctcatacatgtgtacttcaaagatataatccgagataagcgcccggtgatgatcccattcatgctcagggatggccggctctacaatggtgatgcaaacatcctcatgtcttcgaggcggatgctgtgggatggtgagatcaacacgcggcacacgcaagttaccaccttgatgaaccacttgcgcttgacgaagaaaacattgcggggtagggttgagatcagccattgcaagcgaggggaaattttgcggattagattgaacagtgttcctgggagaggaaggtatatggggagaaaccgccgtctttttggccggagaagatttagatctccaaactaagttatcctcagaactcagtttcggaaacttccccacaggttgatgggccttagtgggcctagtggcacagaagcaggacatatgaccagcctccaggcaggaatgacaccgaacaggcccagagcaattagaagcaatatggcccttatccaaacaacgcacacaggaaggcaagaaatttgaattcaagtaacgcagagaaataggatcatccttcgtgattggctccaccgtcttggtnnnnnnnnnnnnnnnnnnnnnnnnnnccttcaacccttgaagtctcgtgaaaaccgatcttctctcctggagaagggccttcaaacattgaaacacgaatttaaccgagacgtctctttgttgaacagcttgggcataagatttgtctttctgaaccttagaacttttgtgcactgacctcttcttagaaggcaccaatgcccactcctcagcacaatcacggctccaagactcaaattcccactgccaattaggacccccatttctccagagataaaagcgaagggaaaaatcatcacaggaaaaagatctaagacgataaatccatagaccaacttgcttagagaaaacatcaaaagaaaaactccggtctaacaaatgctggacattgagatccgcaggagaaccaccaatggcggctcttaaagccaaagccacagaagaattggttaaccggaaattagctctcaggagatcaacagctaaccggtagtgcatagggctgaacttcaaagagaaatgcaccggagaacgaaatcgaagacgaactttctctcgaactgcatcaccaggggagaagtcccaacccctcggcggtgccggcattaccattacggtgatcactagaaatcgcccatctcatcgcctccgtgaaatccggaagatcccccactgttctcaacacaactaaatcttgagagccaaaagggtaccgagctgtaatatcatttcaaatgggcccagg

SEQ ID NO: 6570 - DNA, 2668 bp, Oryza sativa
  unsure (1)..(2668): unsure at all n locations
ccgcgccattgatgatcgnattcctgctcggtacccaatacaaaatggaagagggaattgctccttgaggggtgtttgtgaagtgaagtgagctcctctatttataccatccaaatgatggttgtatggtggttactggtccgctaaccgtgcataaccgccattggggtgcagcaggaagcaacacgtggaggatcaggccgagtggtgccaaccagggttcagcaaccaggccaaccgtcatactccaccgacttttgtcggtcgatgacgggtgggcccctatgatggttcctgggtggttggttccgccctgagtcggtttgagctgacttgtggggcgttcaatctgtgtgctcacacgtgattctccaggtgtttccttgaaggccagcttcatttctccttcactttgatgtataattcctgcatccaagttaattctccaatcctaatgcaactattatttattattggtacgcatgtaagaaatgctaatttttcctttattcattgtgctagttagcggtcaaaaatgatatttaagaaccgtcaacacaatataggactacacaacacttggtaacacatcgggccaaacagtgaagggcatgaaagcatgtgtgaggtgcctgattcaaataggaggcatgtggctgaatcactggcggaagaccgtgtacatgcaccatccgaggttccttaggctgaatcatccgtaccgccaaaatacaagtgatttcgacgggatggtggaagagggagcacgtccaaagttcataatcggtagtgatatatgggatgaggtgaatgatctcgaagttttatgtggtaaagggagtggaagcacacctgcatccacatcaagcggtgagagccctctttggaaaaagaagtctatctatcgtactggaaagactcccgtcacgcagttgatgtgatgcacgtggaaagattgtgtgcaaaaacatgctctgagtattgttgaacacatcggtcaagacgaaggacagtttgcaagcacgaagagaccttgaagacatgaatatcaggaaagagctgcatcctcaggacaaaggaaatgaccgctactacctccctccagcatgctatactcttagtgctgcagaaaaaatgagtacgtcagaatgtctgtagggtgtcaaagtcacatccggttagctgctaccactcacaatcaaaggtattcttccagataaggcctgagatccaatcagcaagttgtgttagttcttcaaagtgatgaatcacaaggttatcgattcagcttcgttggacaagcttcaggaggacgagattcgaactctttgccagctcgagatgttgttctctctctcatttttcaatatcattgtgaatcttgttgctcatcttgtggaacaagttaagatgctaggtccaatgcatctgcatagcatgtgtgtttttaagacgtttctgggcatcgtaaagaaatatgtccggaatagatcgaggcctggagacagtaaagtcaagggttgaattatagattacgtggatttgtaacttatcggtgtatctgtgccatgtcatgagggcaaaatgtttggaaaaggaacattagggcataagagaaccactgccgacaaaccacgagcatgtcgtgtaatattggagtacgtaaaatggctcatatgtccttatgttttcacacaaagctcatttgtccttattgtttcacataaaaggaacggttagagtataaatgcatattatctcatgaacgaaacttttgagttgcactgatttgtataccatattagcgtatcaggcacagatgtcccgagtcgaattttagctgagacatgagtgtggcctgaggaaggtcgatgaattgtttctttactcgttaaatcaaacttataaaatgttgaacgtactggtgagtggatcaagtctataggattacctgcactactgcacaggaaaagcaatcaaggcagggatttaggtatctcaacgaatcattcgtacggatcagcgctgcaaacctggagtcccgtcaggttttcactcctattaaactaatagtttcgcatatatatttggtgaatgtcacgtaatttgataatccgtgacagtcaccaggggcataaacacttaccgtcaaatggattttactcgtctgtgtgtagatctgtagctagagcaattaatttaattttttatactgcgatggcattggcagcagtacctaacacgttccatgtacgtacggcacgataacaacaaaatatactttttgaacagtaatattcgaggcaaacactgaaccactgatgaatcatgaatggatacatttttaattagattcctgcagatttcatcgtagaaacttccgtagtattatatactggagtagtttactttgtacacggtagtaaactagtaaaatgtagaagcagtcacagctgtaaaaagttcaattgggtctaattaatatttccatatggcaatggaatgttttttgaaggttatatatatgtgcatggttatgtgatattccgtcggagataagtctcacggcctcatctttttctttatacttatcaaccaaaaannnnnnnnnnnnnnnnnnnnnnnnnnnnnnnnnnnnnnnnnnnnnnnnncaatcaaagngggcagg

SEQ ID NO: 6571 - DNA, 746 bp, Oryza sativa
  unsure (1)..(746): unsure at all n locations
acnnnnnnnnnnnnnnnnnnnnnnnnnnnnnnnnnnnnnnnnnnnnnnnnnnntcttccagatccagacaaaaggcctcgacacatgcacatttgagtatgtcagcttatgaaacctcttagctgtgtatttgtcagagttccggatgaaagaccattcatcaccattaccgttcagcagagagagaagaccattcctcctctagaacagtgaattctccataagcctgggtgctcaggggcagtaaaaaacaatcctcaagaggagtagaacctatttgcttaatagagagagttttatctaaggcaaccatatataaagatggaaaagcattgcttcttatcttatcattccaaatgtcatcctagaaaagagctgaagatccagtcctgatatggcagtttgagattcccctgaaaacatcagtcagagccactatatccctccaccaaaaagatcctttattccaaactaaatgtggcactttagagctataataagagttccatatcagttgaacccacggcagatcatgtcctttgtaaaatttgactagatgtttaagcagaagcgctatattctgaactcttagattgatgactcctagtccaccttcatcctttggtctgcacactagatcccaagaggctagagatcttctggttgaagttggattgtttcccctccaaaggcaatttttccttgcagtgtnnnnnnnnnnnnnnnnnnnnnnnnnnnnnnnnnnn

SEQ ID NO: 6572 - DNA, 1648 bp, Oryza sativa
ccagacgctcgatggttaggtatgagagggttccatatttctgtttcatatgtgggttcataggccactctgacagagactgtgttaagaaggtagctaataatgatgcgcccttccaatattctgctgagctacgctgctcgcctttgaagccatttgagaagaaggtgagcactgttaaggggacagaggcttcgactgcttctcacaggttgtcgttccgcaaggctggtagtgcaagctcatcttcttcacggagatatcagggggaacaatgggatgaagcagtccctccaagggtggacacacattacggctttgatgctcaagagaaagtgggagatgaaacacttgatgaacagttagctagtcagacagacaagttacatgtttcagatgaaaagggatagctacaggacatgatggctacaggatcgacaaaactgaagatgggatccatgtccgggttgtcgtcggcgaagcagcagatggttgacatgatcccggctattgcgaatttacatcaggcagcttcttttggggatgtttcttcagaagacactctcagtgtccataagagacgatccacagaacaactcgggaacaagaagtcagggaaagtccaacaagccttgctgcagcatgtgttggaagcagaggaagacatgaagaagaaggaaggtgcagggctgcaaggaagagaactgaagcgtttcaagaagacagctgcggacggtatgaatgtgggagaattggaagtgaccagcgccggggctgctggtacactggcaggtcctatgttgggatcccgccaggaacaatgagttgcctaagctgtaactgccgtggaattgggaacgccacgacagttcgcgacctatgtgccttggttcgcgaggcaggtcccaagttagtttttctttgtgagactagacaaaagatcgaaacggttcggcgtcttcgtaatagattaggtttaaaaagttgtgttggtctcagttctgatggtttgagtggaggtttagctctgttatgggatgagtcagtttttgtggatattaaaggaatgaatgaaaggtatattgatgcgtatgtgcgtttgtccccggatgctcctatatggcatgttacttttgtatatggtgaacctaaagttgagaacaaacatcacatgtggtctctgttgaacttgctgcgacaatcatctactttgccttggttggtgatgggcgattttaatgaaacactttggcagtttgaacacttcttcaagaccccacggaatgaaagacagatgcaggcttttagggatgcccttcatatctgtgagctacatgatttgggtttcagggggctaccatatacgtatgacaataagagatagggagttaataatgtcagagtgcggctggatagggcgggggcagatgacaattggagtgatcggtttaaagagtcacaggttgaacatctggtgtccccatgttcggaccatgcccccattctgctgaaatttgcggttgaagagagccgacgggttaaacgcaaatgtctgcattatgaaatatttctggaaagagagaatgagctcccaaaattattgacgaggcctgggcagtagcaggtgataaaatgaacttatctgatg

SEQ ID NO: 6573 - DNA, 756 bp, Oryza sativa
  unsure (1)..(756): unsure at all n locations
atgatcgcnttggttgnnnnnnnnnnnnnnnnnnnnnnnnnnnnnnnnnnnnnnnnnnnnnnnnntgatgaagggataaaagaattaataaaaagaatacaggagaagaaggacaccgatttctcaaatagacgatcaaggcacagtttggtgcggtccacacatctgtgtaccggccaagaaggagttaagagatcccatcctaaaggaagctcatgagtccgcctactccattcatccaggaagtacgaagatgtaccaggatatcaaggcatatttctggtgggctggaatgaagcgagatgtcgcagaatacgtggcgttgtgtaacatttgccaaagagtcaaggcagagaatcagaggccagcgggtctgttgcaacccctaccgattcccgagtggaaatgggaagagatcggaatggatttcatcaccggtttgccaagaacccctagcgggtacgactccatctgggtaatcgtggaccgactcacgaaatcagcttatttcgcgccagtgaaaaccacctttgatggaaagaaactagcagaactctacatgacccatgtcgtgtgtagatttggcttgtccaagaagattgtgtcagaccgaggcactcagttcacctcagggtctggaagcaggtgcatgaagctctcggaacccgatctaaattntagtacaggttaccattcgcagaccgatggtcaaacagaaaaggtgaaccanattctagaagacatgctacgtgcgtg

SEQ ID NO: 6574 - DNA, 755 bp, Oryza sativa
  unsure (1)..(755): unsure at all n locations
cgagcnnccttggttatatataaacctnnnnnnnnnnnnnnnnnnnnnnnnnnnnnnnnnnnnnntattgctattgttattattaccttgttcaccctaggataaacaaaaccccaactagggggtactctatttatggttccactagtatgaatttaggtagatgcttcgctgattaattaggcaacattaggtggttttataactttagactttgggaattctcatatcatttggacactatggaatggttggcttatggtggaattggacatacccctctcttcctctttcaaagcccctaaaacctgtttttcgggggggtttgggtgcatgccagttgtgggaagtagcaccccggccactataaggattaagctcgggcctctgttgcaaagcactaccgtactttcacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctggctgtcccgggggttccggccgtaggtggggttgggtcggtactcttgtttatggctaggatgggttgggaactatgtcaacgttttccgtcccgataccgtggtggtatgtggcacgtggttacacctgaggcaagatgtgtcttg

SEQ ID NO: 6575 - DNA, 7586 bp, Oryza sativa
actgcgcccctttgaaaatcgagttgcagctcggtaccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgatggtcaggccttaagtgcctttgtaataatgtaaatattatcgatataataaagatgtgccttttgtatcatgtttgttcggtgtaccccggctttttcctgggatggggattaatacactagcattcgggaaaaggtaattttctcggtcgcgacatagtactgatgcagctcttgactatcagtacccattctaggtaactcatggtcgacaaaactacaaccaatggcatccctagctggagcgctccctgatctaggatcttatgtagatctagttgttttggaggtaagaatgactattacgcctttccttttcttttaaattttcctctttcacgatgcagcctgctagacaccatcagtggagatgaattggcctaagtacttttttgaaggagggcgatctacggacatttcatcgaagtctgtagcgtgggactgaaaatgagcttcattggccagaggaggtcaaggaactttagctgtcgaaccagagcaaattcggaatgctgctaatttgaccttggagtaatctttatgatgatgagtgttggtatttgatacgatcaaacaaacatccgcaagtgcacgaatactgatgtagcagttccccttagagtattctaagggtatcgaacacgagaaacgtgtgtgtactacctacgaacaaaattcaatccatgggcaacaactgatgttcgtttggctagaggtgatccctatctcttttagttagctacataagttaaaagtaaaactctatcgaatgctttgctggtacaagccctccttggtctactaggctgagtccggccttaacctctatgatgtacccgaatgtagagggatacaacggacgaataaagttgtcaccacccatcggctacctcactttccgtggagcatacaacaaacaaaggtaatttctaacctaaacacaacgcctaagttattaattactactctagtcttgcgcatgaacttcgttctttatctagagtcttagtactagagcactcagttgcacactaagcgatgagcccgcaccaatgagaatttatcccacttaaataaaataactaaagaacataagaaaacttgaatacctactttataaaaggaagcatctgctgaggtacaagcgagagaagaaggccaacaatcccggttttctccggaactccgttggatgaatgccgatagtccggcacaactccgtaaaattattaacgaggattatcttgtgcaagggcatactttgaaacattgtccaaatgtctctattgtattttctttcctagatatacaatggaaatttcgttacctaacctggaattttacttgtataattgctgggaactaaccattcctcttgtttgcacaagagggagctcgaaggataagtgtttctgccggacaacttcgagcatggcacgaaatgccgccatggagtagatgccactcattctcatcccgaagttttcgtgacttcgggcgagaatttgcggttgcccctcaacagctgggaaagcaggatttctagacaaatgagatgcatgacatgttaaaccagcatgtctgggagacccattcgtggcggcagcataccaccgactagatggtggacatcaacaccgccatacagcagaattaggccgacatgatggcttacttctgatcacagggattcaaaccccatcacgcaccccaagaagaagctagcttgagggagtgccacccccaccaagataacttatatctttacatttttgcatttgcatcataaaaagaaaaaaaagtaaaaatttgcaaaacataaaaataccaaaaatatttacttttgtatacgtgataagaatgttttaagttttcccagttgaaatgacgaatagttgcgatgtttttatttctatctagtacttagtttggagcttaaccttcactatagtttttgagtttgttagttaaaaacaaaatctttgccatgaacttgaaacttgtgggttgcaaaaagcatgatccaagtctagattgttgttggatatgagttggtgaaatagagttgctatgatattactctaagtgatattggaatttcagagcatttttttaaaaaagtaaatttaaaagttcctcaacgatcataaattcccaccaaagccatatgatgatcttaactgaataaacatatgctcatatgccagagtcaaatggttgtgaccctggtgagattcttttcatgcttcattgatcaagatacccactcacaagtacccaccatatatgcttgatctctacattggagattagcaaaaacatacctttcacctacgatagttgtttaacctctacactaggggtgagcaacatttccatccaccacaataaatactccacgatgtcatgaaaatatctctcatagtaatttgcaataaaagatggctgaagaaaaaaaaagtcgagacaaaaggtaaaatattgtcaaccatcatgagaagaaaaaaatgaaaaaaatagttggagaaaaaaacagccacatctcaatgttagaataaaagagattttatgacaaaggagtaccatatacaccaccatatagccacacattttgcacatcttgatcaaggttgtatgatttgttttctccttggatcctctatgtgattttgcaatatatgttgctggccctcaatcctttgctgagatattctctaatttttatgacgaggaacaagaggaagttcctgacattgcgtacgaggaaaaagaagaagaggaggatgagatccaggatgagcccatgcccgaggcggctcctgctcctgagcatactgctagtggtcctgttgctggcgaccaaatggatgacgatgctcaaagtggtgacacatagattctttactatagtgacgtctccggttgtgagtgattccctcctcctgcttctctctttttggtgccttgatgccaaagggggcgaagattgcagaatggaggggattcgcacttctcttttttatccttttgcaacatcccgtcagcgggctggaagttttgggctattggtcaggaagtttggaccgggctgttgttggtattttttaacgtcacagataaaatccgcaagcgcatggaagataccgatgtagcacttcacccgggagtattccaaggtatcgatttcctcagcaaacatgtgtgttcagctcctcttcaggctcatctatggacacgaagaaaatgtagacaaatggtagagatgatttcctagtgagaaatagtgtctacggaaaactcagtttaatcctaacgcggtacttctagcactggctagctcgctgctcccagatgtcactgtactgcgtacccggacagggataactttagtgtaattacctagacaccgtgtctatgcaattaataacgactctagtgtttataactcaataaagcaatcattgtattttagtggactatagtgaacaatgatcctgcacgctaattaggaactaaccaagaataattctcacgtaggaattcttacttactcagaaagatatttctattaaagtagagtaattagcaaggtacaaaaggtaagaggagaattaccgacaactccggaattcctccgatttcttctatcttactctctccctcatgctttggtgtgttggaatgaagtgaggggtatttataggcctagaggtacctcgggaatgtggagatgctaagcatccaaaggagcatcttcactcttgagctatcatctgtcctctaagatggtttctaccagtagaaacggtcttggaaagtcggtaactaccaacctatgaaaattggggccgattgggttgttttagagttcggccgaacccttgccagttcattttgccccgaattttcttgtaggctctagtaaagattccctcaacccatgtgtatggtggatttgcccatttgaatgtgtttcgtttggtttgtgggctcaaaactccataagcttgaatatggaagtttaattcacctccttctttatgtatctcttgtctcaactttgataatttgtcacctacatctaaatatacaccaacactcgtgggaattattagaaataaaccataccactatattgcatgttttattctttcagatttatgcacgtattgacggcataaatttcgcatttagcagccatcgacagctgtgttatcccccttttaagcctatttaccttattttatctaatggattgtgtgatattcatggaaatttggtgtattgttgttttattgtttttgtgtgcttgctatgtcatatgcatctctactcatttcattatcaaacattgctgcaccacacggatgagaactgctgggaaaagctgtccacatttatcactcgtattttgcatgcctacattaagggggagctttccacatctcttttcgttcagaaataatatatattcatgattttgtaagctttaaccgagttttcatcaatcaccaaaaagttgaagattgaaagtgcatctagccccttaagattgaaaggggcaaatgattttactgagataagcacggataaatagttccaagtttgttaggtgtgagatagtgtgtagaggatgccctccccccaacaacaaatgcaaagtggcgagaggactcgaagagttatttaaaattctttttaaatttcgcatgagtctaggaaaaccgtactatcaagagaggtatcaaacaattgcctcaggtgatacaagtgcttaaaagtcatatcccacaaaacagagacacatttgcacaacacttgcacagactcaatgtcaaataacaagtgtgggctagaagttcctagcaccctggcccggaacctcttgccaccacttttcagccaaaaatcgtaagtgttgcccataagttcctagcactctagtccagaacctcctggcacctttctaatttaaaaatgtgagacggctacatgacgtcaacacaagcctatatattccccacaccccccacagctcacttttggtaattaaactttcgtttttctgtcccctaacttctcccatggtattcttgcaccctccaccttgttcttcagctccccaagtgacattgagtaagatttgagtgtggcattgtggtttgctgaagttgttgagagctaggatgacttgagcacttggagatcttcatgggctactggttggtgcttgttactcttggagagcaacctcctagatggctaggtgtcgcccgtgagcatccaagagtgtgtggattgcctagaaaagattgcgaaggttttcctcacctccacaagggaacaaggtaatgcgagtaaaattcctagctgagccttcggatgtagtcttggtagagcaatccacatccgtggtactcactagggattcaagttagttatctttgtggtcacttgaatcctagtgagtgatatagggaagtgggattgaaaaccagggacttcctcctagggttttgcttggacatctaggtaaggggttaatcgtgaccaagctattatgagttcctcaacggagagtaggattcttgtaatccaaactcttgtctcacttgtgtatgatctgtgcaattacttgagcttttttgtttcctgttgttttacttcatctccaacactttggtaagtcttggggttctatgagaattgagacttaagcctcaaagtatttgaatattggaagttcctagatagaacaccggaagttctggacaaaattagcttccagaaagttttaaggctcttgccaagaagttatgggccctgttgaatttaaccgcaatgattgatgaaattttcaggaacgcttgaacccccatataggcgacatctacgagctttcaaggaagtggctttcgcggcaaacagattcgcacatcgctggcccgacaggtcagtttcgtgctggctccactgctatcggaccacattggggccctttccattgtctctacccagcgccaccatcatcatcaacacctccgcccggggcggcaagtggaggcggtgggagggtgggagagggaaagatgtggtgggagaggaagaagtatagagattgatatgtaggacccaccgtcagattggagagtgtaaatggagaggttgttagagtggaaagtaaatttgactctttaaatttttggcaagctggccaaatgaacatttggaaaatcggatttagagaggttggagatgctcttaactatacacctttgaaagaagttatggtggtggctggtgaatctgtcactcaccaactttgttatatttctttcatctatagaattgaagtttattatgcaaagacatttacagagaatcaatgaaattgttccaaaaactttacaattagtttatttcaaataatgttagcccatgtattatttatttttatcggttgtaaaaacataactatttaagttactataatacccaaacgcaatgcatatgtatggcaagtgaccatgctttaaaaccgatctgcggcggccagcaatggctcgttaataaaaagatatagcgagagcacgtacgtaggtggtgccagtgcaggggagcgtggtcgtggaaatggactttctgaacttcacggaggataagcaataaaggactggtaggaataaagcaccagtacgtccggaaaatccacataaaaaaagtgagggggaagaggtgaattaattggtgatttggtggttacatcgacttcatcatcccgacatcccgcgcatatgtattctttgtgtgtgggtgggggtaggtgaaaccccgcgcattgtcgcgggaatttagtatgataaaaaaaataacgtactcactccgttttttaatagatgacctttatgccaagatcttatttcatttaagtatattaagcttttgtttgatatattatacttgttttaatatcctgatatagagtagtattcgggtattagcccgatacatgctagatctatatgatcggctatgctataaacatatataggcctgttattaatatatatttcgatccaagtgatttatactggctcggcatggggaccgatctatcccaatcacttgatttaaatatatatcgatataagaactatatattgggaatatttacagtcgatcgagtagggttagtccttattatctattataggcacccatcgatttcatatgacattgggtcaagataaatgaaatggcatcgggacttaaccggttggtttgattatagaataaccgcgttctttttttctttttttgttgattgatgatcaatacttggaccttcaat

SEQ ID NO: 6576 - DNA, 4870 bp, Oryza sativa
  unsure (1)..(4870): unsure at all n locations
tggggctcnnnaattgtaattacanattnnnnnnnnnnnnnnnnnnnnnnnnnnnnnnnnnnnnnnnnnatcttatacatttgcataaaatttttgaataagacgaatgatcaaacatgtgagaaaaagtcaacggcgtcatctattaaaaaacggaggtagtataagatagctagataacatcagactaagtaaattaatgtggtttatgataatttacacttaaattgtagaatgatgattcaaacgtaaaaagtaaggtggtatgactttatggaataacaaaagtaaggagatagtttagaccgtagattaatcatctaaaggctaaaaataattgatgtaatatgacttaattagaggaaaaaaggagaaagataatttgaaccatagattaatcatttaagcactaagtatataagatatcataaaacataataaagatatacattgaaacattatgtgaattatattggatgataatttaacatgtttgtatttgaaaagctcttaaattataaaaactataaagatatagcatgtttgcatgatgtttaaatgtgatgattgttagtagataatgatgtggcatctttatatgttaagctcaaggagtgagtggggaataattgtatagtaagataggattacatatgaatagtgtataatgccacatacttcttccgttttgtgtcatgagtcctctgacttatttcatatcgtctaacttaacaagatcaagaaaaaattaagcaatatctaaaatattaaattagtttcaatatatctatcattgaatatatttgttttgcgttaaaaattgtactatatttctctataaactttatcaattttttttttacgtttggttaggaaaattgacaaacgacttataatatggaacttatggaatattatatagtacattaattggcaatttggttcaacttaattaatcagaagaatggagacacagtacgagctgaaaatcaaagtactcaaacaaagtaatatattttgtggactctatatatatatccatcctcggcttgaacaactaaggccttgtttagttcccaattttgttttcccaaaaacatcacatcgagtctttggcatgcatgaagcagtaaatatagattaaaagaaaaactaattgcacagtttacatgaaaatcgtgagacgaatcttttaagactaattagtccataattagccatatgtgctacagtaacccacatatggtaatgacagaataattaggcataataaattcgtctcgcggtttctaggcgagttatgaaattagttttttaattcgtgtccaaaaaacctttccgacatccggttaaacgtccgcagtaacatcccaaaatttttttttcacgaactaaacacaccctaaacgtggaaagaaagaagaaaaaaggttgcatggggagcatatacaggtacgtatagcattgaagagctaggacagaagagctaggacaggggaatagcaggattgcagtaataagctggaactgtatcaccgaacaacatagatcatcatatcagcaggtagctagcgtagagagatgacctgtacgtggagtactcgacgactacatgcgcgcgcatgtttcgcataaaagctgtgggaaggtgagagcaccttaatgcacatgtacattaaatccttaaacgtcgacatgcagagacatgcaccttaaatccttaattataccccccagctactacactactactcctacatgcattcacgtaccccagtatcgtgcagaaaacactatttgctcgatcaataacttgcccaaagcagtatacctacgtactagccatacacactactacagctactgctactatacaaacgctttaattttactctccagcagtccctccgacttagaaaacaaattttatgaaactggaatatatcacatctaattttaatttttttttgagagagtagttattaacactgcaagctcggtgaggaaggagcgacgacgacagtagcatatctttgtcactgtgtgcacgtgctcctgcgtagagatatataaccattaacaattttagggggtctttagatctagggatctaaagttttagtacgtcacatcgatattatataggatgttattggtaacgttttgtgacaagtcgataagcacgattgtagcacctaaagctttgcggtaatatggagtctccaactgtcacaaccggaaataacccaacgggcgttccttacgtgcgtgcattattccttgtcccaggaggcaaggtacaccaaaagttgatacagttcagagtttaacaagcggaagcgtaaatagttaatttattacatgggcggcgaaggcccagcacacacaaagacaaacgggaaacagcggaagactagggcgatgaccacaggcgcttgacggcaggcacgagctagacaccaaagccttcatcttccaggggctcctcttctgggtttgggaaaaaattgagcaagactgagtacaaccaccgtactcaacaagacacacccacaaatgcaggataaatgcaagggagtacaatggggttataatataaagggttagggtttgcagcaaacagcattaaaagacacttagttgctcaaagctattttgtaaatacgatcctagagctatacaagattattaaacaaggccgtgaacccacacgaacctgccttaacccaaggcctacgatgattcagaccgaactggcaacccgaccctgggtcccagctcgtcccaagccaactcaggccaaccattccacattttagttgttaagcagattttaagaattaaaacactaacttgggtacattgctcggcttgcccataaccgagggcgcggctattcgaatagattatactcagatcagaggtgtacatctttacccacaagacacatcttcctcacgtgtaaccacgtgccacataccaccacggtatacggacggaagacgtgacatagtttctaacccatcctagccatagacaagagtaccgacccaaccccacctacggccggaacctccgggacaggtaggcaggactgagcccctagcagcaggacaccggccatgtgccatgacatcttgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaacctttttgaggattttgaatagagggggaggtgtgaatccaattccacaataatccaacaattccatagtgtccaggtgataagagtattcccaaagtctagagttgtaaaccacctaatgttacctaattaaccagcgaagcatctaactaaaatcatactagtggtaccatgagtagagtgtccactagttggggttttgtttattctagggtgaacaaggaaataataacaataacaataataaggtcataacaaaggtacataggcatggctagataaaacaatgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatctttcgaagctacaacgtctacacgaccaacggaaaagaaaaggcttttactctaataaactccatattacaagctggaacaaagcacaaaaatgggttcttgacttcttaagaaaaaattagagacttgaacggtccaattctgagttcaaatggccaagttatggtcatttgaagtttatatgctctttaaatgaatatttgcgaatttcttcatttaaattttaattttaaaagggtttattgcgtcagccgagcggagggggcgcgcggaccgggtccacgggagtggggcccacgcggcagcctcacggtccacggtggaccgggtgcacccgggctcacaccggccggcgccgtgggtcccatgcgtcagccgcacctaagggcgcgggcggctgacggccgggccccacgcggcagccactcggcgcgcccgagggcggccaagccggcgcagccggcgggaggcggcgcccgcgcccctatggtcgccggcggtggccataggcacggcggagcggcggccgagagaggggaagggaagggggaaaaaaagcggcggtccacggctcaccctaggtcgacggcgacgacgaaaaagccggccggagcggagaaaggcggcggcgcggctcgggtcgacggggtcgacggcgttccggcggtcggtgagcgaaacggaggggtggacgaggtcggcgaggatgcggcgaagccgaaggaggcggcgccgaggtggaaggtggaccggagctcgacggcgacggcagagagagagcgacggcgcgagctcgattccggcgaggaggaagggcggcgagaggcggaaacagatggaggaggtgcggggagggtttaaatagagccgggtcgagagagggtggccggggaaggggggaaaccggcgcgggaggtccggctgccatcagtggcgccggcgagatttgcgggggcaaatccgcccgtttaaacgcgagagagagagggaaaaannnnnnnnnnnnnnnnnnnnnnnnnnnnnnnnnnnnnnnnnntgtatcttcctccaagggcgcagt

SEQ ID NO: 6577 - DNA, 23129 bp, Oryza sativa
aaggttgcccgggaaaggggggaaaaccggcgcggaaggtccgcctccaacaagtggcgccggcgagatttgcgggggcaaatccgccgttttaaacgcgaaaaagagaggaaaaattggggggaaaggaagaggggatcacggggagtgatttcccctctttattgcacgcggagacggcgggaggcagcgggattctcggcgccgcggcgctagggcgcgggcaagtcggcggagcggcggaagaaaggggatgacgggtgggccccacccgtcagcgagggtggcgggcgggcccgcccgtatgaggcgcgcgcgcggaaataggccgaatgggctgcggggagaaaagagggagggggagggagatgggccgagccggcccaatagggagagggagggaaaggggactttttagagtttttctttttataaaatcattttatctttgtttatttcttaataattattatttgtgctctgaaaattccactaaaatttatttacgcattttagtcttttaggaaatatacaaaaatctctcaagccttatttgacttttaactttgcaccttttaattgttggaggctttcacacggattttaattattctaggcataatttagaggatgtagtttagagtcgttttgggacgtgacaccaaccacctcgatctagccaaaaggccaaatcaagatggattttgtaaaaagaaaaggtaaaccggctagcggaaccgatttagatatcaaaatcagcctctaggccgatttagatatcaaaatcagcctctaggccgatttagatcgatatgaggataactacccgtctcgtggacaaaacggaaggttttcaggataaacctacaaagaggtgtcgcactctctattaacagtgaaaaaaaaaacaacaatattggctcggggggcaagcgcataagtttcagcatgatggagcacatcagtatctgctcatgaaagccgattgcaagaagcaaaggaagattggttttggagttatcaagacaagaaattatgaagcatgaattctcatactccaaaactggggggcatgtgttaacagtgaaatttggtaagcccggagtagtcattggcttagagtcagcatcggcttcgaagtcctgagattagccgatgagagttgtcaagtcgtcagttgtcggattcttgctatattcggttaaggaaattgatctactaaaggaagcttatccagaagagaccgagttcaaagagaatgtggcatggcaagttatctattaattaggaatagtttgttagtttccttttatctttaggaaagtgtgtttagtgtcctataaggactttatcttttccttttatctttaggaaagtttctttcttgtccgataaggacttgaatcaacccatgggtataaatatgtacacccggggtctatgtaatctatcgtcacgatcaatataattcggcgcatcgccaccttttaccttttctactttattttatcgtccggcgggacttggcatctgacgcagggctgcattggtgttcgatctccggtgaaggggtacgtccaatgttccgccgacccaggcaattgtatcgtttacgtcggtgtcgttcaaggctacatcagtacatttgacctcttagattgcttcggtttggatgatatatttgtctacctatttattatatgtctctgttaatctagtcttagcatatcaatttagctctatcggctgcttctcgttttagggtttctgccggtatcggctaaatcgcgttgctagatttgattagcttagacatctaccaccctgataattcaatcaacggcttgattgtctagattttatgtttcttttcatacttagtgttgcatcagttaagtttgatctactaagtcgtgtttagaaccataatctctagcctgcttcttgattgccaataagggttttttcagggtttcagccggtgagttatttgtacgttgcatcggctcatacggattgcatatacatataagttggatttagccgatgacaacaaaggtttcgctgtttaatctgatcttggggatttcatgacattggacttccagccgatgtgtgctttaacctttacatcagtgcttatttatcatatcattgctagccgattggtttatactggattataatgttattgtattacatcatcatcagccgattgcctttatatcatcatctacattggacatacagccgattgcttaaaccatatcgctatcggctggtatcggcatcggctaatatcgactatcggctggaactactccattggcttgtcagccgatcggctgttttatcggttatttacatatcttgtcagttgggggtcaaactaactggcacgcccgcatctcaccaatctttggacctgcacaggaactaagcagatctcccaggctggtgtgttcgattttttcatcaacacaaattggcacgcctggtgggatgatgatgtaataaaataacaatataatccagtataaaccaatcggctagcaatgatatgataaataagcactgatcttaaggttaaagcacatatcagctggaagtccaatgtcccgaaatccacaagattagattaaacagcgaaacctttgttgtcatcggctaaatccaacttatatgtatatgcaatccgtatgagccgatgcaacgtacaaataactcaccggctgaaaccctgaaaaaacccttattggcaatcaagaagcaggctagagattatggttctaaacacgacttagtagatcaaacttaactgatgcaacactaagtatgaaaagaaacataaaatctagacaatcaagccgttgattgaattatcagggtggtagatgtctaagctaatcaaatctagcaacgcgatttagccgataccggcagaaaccctaaaacgagaagcagccgatagagctaaattgatatgctaagactagattaacagagacatataataaataggtagacaaatatataatccaaaccgaagcaatctaagaggtcaaatgtactgatgtagccttgaacgacaccgacgtaaacgatacaattgcctgggtcggcgaaacattggacttaccccttcaccggagatcgaacaccgatgcagccctgcgtcagatgccaagtcctgccggacgataaaataaagtagaaaaggtaaaaggtggcgatgcgccgaattatattgatcgtgaagatagattacatagaccccgggtgtacatatttatacccatgggttgattcaagtccttatcggacaagaaagaaactttcctaaagataaaaggaaaagataaagtccttataggacactaaacacactttcctaaagataaaaggaaactaacaaactattcctaattaatagataacttgccatgccacattctctttgaactcggtctcttctggataagcttcctttagtagatcaatttccttaaccgaatatagcaagaatccgacaactgacgacttgacaactctcatcggctaatctcacgactttgaagccgatgctgactctaagccgatgactactccgggcttaccaaatttcactgttaacactctcgcagcggcggcggacggtttacggcacaaactgacaaagatggactaaaactagggtaaaatagaaaacatagtaaaagaacgattcaagtagattgtattggggggttttacaatgaaccggccttgtctcttaaataagggttggtcttgccctttacagaccctcctccacgtccaactcaggatagaaactaatggaaacacgaaacatggcttcccgagcaaggaaacccgagacccgacgaaaacagactcggactcgaaccctgacggtctgaccgcccacatacctgcggtgagaccggccctactagccggtcagaccgcccacatgcctgcagtctggccggccccatgaaggaaaccgggcactttccaaactttggcaattttccccctatttcgtccataggtgccaaatttgggtgtttggacactaataaaaaatgtaatccgtcatggggtgtttggacactaataaaaaatgtaattacagaatccatcagtaaaccacgtgacgaatttactaagcctaattaatccgtcactagtaaatgtttactgtagcaacacattatcaaatcatggaacaattaggcttaaaaggtttgtctcgcaaattaatcgcaatctgtataattagttatttttttagcctatgattaatacttcatgcaggtgttcaaagattcgatgtgacagcgtgtataattttcgggcgggatctaaacacacccttaattaatgggcgtgcgtacatatatgtcactgtcagtaatagtaatatagtatgtgtacctccaagttagtatagattcttaggatgtgctatatatgctactacctctggttgcataattcattcttatattctaaacattgatatggcctgtaaaatatatctttagctatatttttttattataatatatgacataaataaatatatttttacttttgttatagtaaattataagacaaatatatatatatatatatatatatatatatatatatattatattatatattatgtgtttaaactaaatgttttaaagttactgatagtcatagttataatagttatagaagtttaataatcttaatataaacgtcaagaattataaaatcggagggagtacgaataaacgattgctcttaactagttgatgaacaaattgcagaggaacatgttgggtttaagtcaggtacagctagtctacttctcgttacctttccttttgggggctaccaaattaatcacgttaattaattcccatccctcttcttaccttcttttttttttggggccaattatcatgccaatccagtccttgttagggtaaatggtggtaaagttaatagtactattaaaatagctttattattcaattctgacaacaacctactaacttggatgtaatttactacactctctccatccttttctaattgtaatgtactagtgtggtctttttgcaacgtactactgctggtctgcacgcctacagaggactgaaatacatgttctacctactcggagtaattattagtgcaatgactgctcctttaacctgtaccatacttatcatattactcctacatgcaccttcagggtaattatttttttaaaaaaaaacattacgtaccattactaatctttataaatacaaattatgaaggttctgatattaaccctacattaatcaagaaataaaaaggttagaaatgcccacattaataaaaaatctagtaattctacgttaattaggaagaaaaaagataaaactgtgtgttcatttgtcactatcttttaagagctccatctatcagttgtatggacgacatcttgcgcaccataaaatatatggatttattatatcagttgtattccgtttggagttttaattatttttcttcatcatgatttgataattctagaattagaaattcttatacttggtttggagtctaaattatagttttcgatgatttatatttttctaaaaatcaaaattcgtaaaatacgtaccaagttatactacgcatgcatgcatgcatgtactacgtctggagtctcgtttatacgtttatgacaatttattaattctgaatttcagaattcgtaaataccaagttacaataagtttgaagttttaattaattgtactttcgagagatttaataataactttttaattaataaatataatttgattgcactttttgaggaatttattagaaaattcaagcttttactcttattcgagaaatgaattgaggagtagcattatatcgttcctaagtacttctttacgtgctcttgaggatagattactatattgatttagtaataattaagaattatggagaggaccagggaacacttggagagagaggctaggagatggatcaagtcaagatggagatctaactcatcaagttcgagtccacttcgggcttcatagcagtccacattaaattcgtcgcctaggttgcattcggattccaattttgacgttctatatatgcatggaaagctaacgagatcatctttcgaatggatatagtcccacatcaaaattccttctgagtcaacaggaattttcaaaacaagaaggcgttcagaatctgcccggtgttgcgtcaccgtctttgggcccgttgggccatgtatcgagtcgaagtctaatagtgtcgcgtccacgggtctaatgtcgaccctaaatcctatatattcagtagctatcattatgttaggattgggttttgcttagattatttatgccttcgcagtttcgccgctagatcggtttgtgaaaccccaacttcgaatccttgataatcattcatctacaattgagttgctctttttcttgttcttgcttgtgttcttcgattcacacgcagggattagccttctcggcgaggtcgatcgagcttcaacacggttgataatcagaggagacgtgctgctacgattgcagggttcgggtcgtgttgatcggaagccggatcgtgtgtgtcaagtttccaccaaatcgatagttatcttcacctgacggaagatcgggcatcccgttgccatcatgaatcaaagttcaagcttttcaaattaaattcattagatcacataggtgatacgacatgtgtgagcaagcctagggtgatccagacgcaaatccatcacacgagcaccttcaattttgaagttttcaaaattttgttcttcacctagtattttccaagcactttgaacttgatgaaatcttgcatctttggggtctcttttcttgttttatttaattcccttgttgttgtatactgtcattcagatttttttaaaaaaaaaattcaacgtttgtttgggtggtttgaagcaaaatctacaaatttggcgtgtgctgatttttgcagactgtaagttccagtgcaagcggaagtttgatctaaatctttgagagaatcaattctatgccacttaccctacttcaacgatttgtcattgactttgtctccctctataatatgcgactgactttgtcactttctttttacaatatgtcacagctgggtggataattgtcaataaatgcctaaaatgcccttcaagtcatacaagagttgataattgtttgatcactagaagtttgaaaaaaatataaaagttttttgtgtacttaaccttcttacaaaataaataattttgtatctaagattttctttcatgtttttcttaaaaactatttttacatagtgtatgaaagagtattcacgtacaggtagccgtatcaggaaaaaaattgtatagcatgtgaatcatgatgtaaataaaagaacttaaacacaagactattttattagcataaaaaacataaattatatttttataaatttaatagatgtaaaatgaaattcttgaaatatacatacacctatatattatttacataaggaggttatgtaaaaattttcatattttttcggaaaatctagtaggtcaatcaattgtaacctcttgtaagtcctgaagggcattttgggatttttttaaaaaaagtatccaccctaatggcacactgtagaaaacaattaacatggtagataaagtcgatgctaaatcattgaactatagtaaactcagtggcatagagtggattctctcttaaacttttaagccaaagacatggtaagagtgttacgtcattgtgttgaaactgacggctctaagaggaagtgttttgaagcactttcatgtatctcatgcttccaaaaattttaaaattccaaaaggttaaatttacaacatttcataagagcctatttggtgaaaactcaaaaatccaaagtccaaaggttagcaaaatactttaaagtgtaaaagagctcttgtagtaaaaaagtatttaattaaaaatgaaaatgcatatttctaagatgttgccttcaccatgtttggcccaaagttgcatatgatgggtttagctaaatgagctgaacttcattatgaatattggcttaaattggtatttaactcatgtaagctctagatcaagtttagttttctatgtgatttgagtctctgagtgaaacttcttgtcttaaaaagcatgtaaaccacatttcttgctttcagtttgatagaaaaaattttttttttccaaataatattttgtgaaatgttcctcacaactcacaaatccaaaatcttggaattttgaaaggaaattttattgagaaaatcatggaattttgaaaggaaattttattgtttctcaatgctcttttggaagctcattttgtgtttccaaaatctgaaagctaggaatgctcgattgactacaactttgtgattttttgtgtatcatatttggttgagatatatgaggaattctccctaatgaaatttgtgcatctatttatgatcaatctccaagatttaccacaaagttttaaatcctatggactggacagtccagaatgaagctggattgttgtcataggctctccggacctcccattatatttgagagatgaagtgaataattcaagtcatcaaagaaacataatgaaacattcgacgcctcgagagaagaatattggagacattgctgggcttttagcctgccagtcaacttcagcctgagatgtgcccgtcaaaccactcgaaggcggcgaccagatgtgttacacattcaggagacttgacaaaaatggctaaagatctacaacatctcaaatattcttaacacatactcatgtgaatctacttcccaagatgtgcactagattcacactttcatcttaagcatggaaatacatagcaaaatacacttaagacgaaaataatctaaatcacaactacttcatagttacataggccgaccggcgaaataaagatatagaatagcgggaagcttgactacccaatcctcaagcacaccgactaggggtttaccccattaagttcaagtcctagaagaagcaatcgatcacccgcatcactcaaagactaaatctaaaacatgcaagcaaaagttaattcaacagcaagagtcagtacattattaaaaataatgtactggcaagtgccaagacaagcctaacaccctacttgcaaggcatataatcaaggaaggcatagtatggttctttttagcataaagcaagttttatttgcataaaacatttctaaatcagatttgctttcaaataaatttcagcaagctagtacttagcatatgggcatcaaataggcattaatcatgtataaatatacacctcattgccttccatggcagcaaggagatcattctcaaatctcatcacaatttgaaggtaaattttagcatttagaagaataaatacaagtctatactcaatacatatccacacgccgctcataaccacgagcacggctaatcgattagttttaactctgtagagtttgtacactttacccacatgatgcgaaataataatcatgcaagagcatggcacgcgatacataagtaccagatttattacccgcaacaaagcttttccaaaattcatgatttagccttacaccagcacgatacgtgttactccatcctaagccatacacgttatatgacctagaaccgttaagtggcgggcctaagccttaaacttaacgccgtggtggcggacacaacgggaactcacccacttggcacaataccgttgtattggacagacttagtcatctaaactaccacgtcggggtaaataggaagttcctctgagttatccgaactcatacacaccggcctaacagaatgtaaggctaaaccataaataatttactaagcttgggctatcccatactagcacatgtggttgtactgtatacgaaatgaactgacattgagtgaagtccgtacgtcggtttgggcgcactctccccctatcggtacacaactaatcaccatatgtgcaccacttgaggcccaaacctaaattccatgttttccaccattttatttatcaaaaacacaagtattaaagttctgtccagattatttcaaaatcaattttcatatttgtaatgagcccataatgacaaggaagaccattctaagcatggctaagcattatagtaacctagtgactccaaaattcatatataaagtggtatagtcatattgttcctaaggttaggaatgatggatatggatatatgtggggttaaggtgataatgcaaataataggagtttgtctaacaagtttaacacaattttaatttgttagtgtacaatcgacatgcaagatttggaaacattttcaataacctccaaaacataggttcaaagtgatcaaagagagggaggtggaacttgccttgaatcaggaaaatgtcagcacctaaatcacttattcactgtttaagcaatcatctatacaaagtacacgttatgcaattaaacaccgaaatatgcgaaaaatccaaaatgctctaaaatgcatgatttgtgcacagtggataagtgctggtataaaatgaatttaggtgaaataatttatattttatctcatttcatttgagagttatgaattttagaagtttcgtcggtatagtgtaggatttacttaggtactattgcgaaatgcttgtgaaatgctgttgtaagatgattcttattaagtttatgtttgctgaggtgaagatatgtgttttctaagactaacacatttggtttcataatttttagagttaatatgaattctttatgtattttacaagttataacgtgttataggtgtatagtgttctataggttcatggctttagaggtttaggtccagaacttgcctcatctagctagttatgtataatataagtcttttatttaactaatctaatcttagtttataaattttagagttcaaattactttacttcacattttataagctaggggatattctatgctagaaacttaatatatcaatctagagattattatatgagtaaagggtactaagttttggaggaaggggatggatcttatgccttcactggttcaacaagttttagttgggtttcattatagttagagtgtattcctatatacatttatatatacgtattgcttaatccttactatgtgattagcacctatcctatagatttaaagtttagagctataacctatacagaaggtgccatattttattttactatgttgaagctcaccatttgctggttctataaaaacttggttcactccatttggactaaagatgaattttctacaaattttacaaattaaaggctgctctatgttggttattacttacataaatatttagaggcttttattgtacagtaagcatatatttttattttataacttggaagtatatgttttggtgattctacagaacttgggtatactaaaaaggatctaagatgaattttatataaacttctaaagttcagcttatgtaaaactagttattttaaagataatagttttagaggcattatatttgatgtaaagtgtgtatatgttctattttactttgtttttaaagaacatgttggtggatctgtagaaactaagtttgctctaaaatgagttgttttcaatttgttatagattttacaagtttacatgtttttctgttgaaaatataaagctttaggcatttcatttagatttttccagaatttaaatagattgggtccacaggtcagtctcaggccaatatgcaaaaaggaccctagggtttcaggaaatcaacccgcagtcctgtgactgttctgtgtgtgaggtaggttttacaaactagtacctagagttttgattcttctcaacagaggtccttggtttgagcagacagagctagccatggccgagctcgttctcaagctcgccggtggcaaacggcggcagatctcggtgtgcaacataaggagaaaatgtaaaggggttcaaggcgaggctataggtggtattcttgcaagcattggtcatcggaattaatggcgacggcggcgcgagcggcggtggttctcgggtgacggtgcatgtggagctagagcattgatctagatgtttagctacatgcatgtgcctctatgggatcctaggatgcttaccgagcgtccaatgaaacttggcgaggtccagatagcgatgaccacgagcagaacgactcagcgacggcggggagcctcgggcaatgacgacgccggcttgatatggctgatgatcttccatgcatgcatacacacggtgttgaataggtctcaggaaagcttcatgcccgaggaattgaactgtgactcaccggagagggagaaatcgaaggtggagcttgacggccggaattggggaagacgatgccgatctccaagctcgctgcaccactgccaggggttcatgagggatttaagagaggacactgaggagatgttgatggtgcggtggctcggctcggcttcctccggttcgacggcaacgaagacgatgtcccgatggcggcgcccagtgcgcgctccagagcatcgtcggcgaggcttgcgttcccaccaaaccactgcatgaaatgggatgaaacttagagggatggaatcggcgtggagaggcgataatggaacgcaaaagaagaggaaacgaccgctgcacaatggcgatggtgacggccgtcgtcttcacggcaggcggcaaggtcgagatggaaaagaaaagccggagctctccccctcggtttgctcggctcaggagtggtaatggggaggaggcgatgcagctgggtggaggtgaagccttggttcggcgctgccacgtcgaggccacgcatcgacgccgtccagtgtaggtcggcgccctcggtctctctctcggctgtcactgtgttggatggaggatgcacagggtgtggttcaagccaaagaggctgccatgtgggcccaggtctatgtaagctaggtgggagtctgagggatgggtaagaaactgggtattgattgaattttggacgattttcatattaattctctccctccaactttacatctcaatattttaatgtgtgaagcatataaattagtgtgggtttttctgaaggtagatgaatgtagctagtttccattttctttgttgcacttaaaaatttagattgctcatagaaaattggggaagatgggctcaatagaactttgtttgaatttttagaagacctaaactaagaggataaattctagaaaaaatatatttattcatgataattgacctagtattttaataaattatttcccctatacactttcatgcagttaaatgcacattttagttatgtatggttttagctgattaagaactatatttaatctattatttgacaagtttgacttgtttatttaaggtatcaaatttagttattaaattgtaccaaaattatagtgagttgtatatgttaagtagagcctacataaattttcccatgattttatcttgcacgaattattttagaaaattagcaagacttatctcttatatgtgtttcccttttcctaaatgtatgtaaatgcttataaaagttttatttggactctttttaacctgaggtgatgttgatgttgatatgttagaattacagtttaccttacacaggtcataagctctttacctatttatgcataagtttactttaatattaaattaagaggatgcttatagagatgattaagatagaatataccctatatgggttaatttatttgttcactttcatgttcatgacatgtcttcaaatggatgaccaaattagttttgtgaggcttgacattagccatgttgatatattttaaggtgtatggttcctattttaacttcgtctagctagcactaggccctaatggtttagttgtttatcgttaatattcatgagacctattatgaaatgcaaataaaaaatccaaatgcatatgaaggactcaagtcaaacatggctatgagaatatgcatatgagagtatgcatgcttacacagacgtttacattttgtcctaggttataaatgaaaaggttttaatttgttctcaaattttattcatgcaagagttagatcaacttcacctaggtttaaaatggaaatttttggctctcaaaaatgtaaaggttagcttccaactattttgacatgaaaattttaaggtctagaattttgggtatgttacaattgttttactggcatcacggaagttccaatactgattggtatttgttacgattatagataaatcctaaagtggatggatatccctgtagcattcaacccatgagtattcaagagtattgttatttgttttttatagggaaagcggcggtgtaaaaaaatggaccgttataatcgtaatcctatgattaatataccatagtctaacagagataaatgataacacacaaaagaatcatttctataaagataaattagattaagataaactagattaagaggacagaagagagccatggtttcttatgtacttctatacttacgatggttagtctacacatacattcatatacatatagaagcttaggacttggtactatgcacctaggcactaccgagaccgctccctactggtctacagcatggttacggcatttcacaaactcttacatcataccaaacgcgaaggattacaaatgatgaatagggctgtcaccacctgctgcctacctctacaacccatggggcaccccacatcctgatgaggacataactagctcggatataaccatgactaccttatgtatttattaaataaaggtgcatatgttctacattaggtttacttgttatatatttgaataaacgttgctacacaatgagttttgtgtgttttcgtttgcagaagtacttgcttgggcgaaggaaagagaccgagcgtaactaatgcatggatgattaaataagttgattggggaccaaaccaagaccttcttcaagtctacttctacctcaccacgtcactattggtccatagaagacaagagatcaagttgtacacgttttggattcggattcgggcctcctgacagcatcaacttcaaacggacctagccactgatctagaaggaatttcgaggcccatgagtacttgttggaaagattatggagtctactttcaaatggttttggtcccatgtcaaaattcctaccgagctgccgggaatctgcaaaacaagccacgtatctcatccagtccgaatctgattttgagttttgagccttgtaattgtgtcatgggcttagctcaagggggtgtgcgccctagggcaaccctatgacgtccctaagcacatttattcagtagccgtcatcgtttagagtcgggttttgcttagattattctgtcaagaacagtttcgccgctagatcggtttgtagaaccccaaattcgagtgcttaatcattcatatgcaatttggttgcaatctatcctgttcttgcttgtgttcttcgattcgcatccagggattagccttctcggcgaggtcaaccgggttttggcacggttgataaccagaggagacgtggtgctgcgattgccgggctcagtagcgtgttcgttcggaagccggatcgagttgtgtcacgactccatcgaaatcgttgtttatcaatacctatcggaagatcgggacctaacccccccatcacatccaacggcatttaatcaacccaaatactatgcctactgttgacggtcgttatcgatcagtttcgaccgtcaatatcactaacaggagagaactagtgatgcttgcaatgcataaatatgttagaataataatattctactagtattaggtttactaaccttttgcagagaatgatcacaaagtagaggagaatcgacatcagcaccaatgataaatcaattggacgatgtcgagaatcagacttatgcatgaatgggccaagaactcagaattgacacgataaactgggccaaaattcataagtctgcggagaagagaagtctagtaggccaccagccaaattgtgggctggttgggccagcccaggttcggccgaacccatttctccatcgttggatgtggggtttggcagggactgtggagattatggataccccatacctacatgatatgtatatccgactgggtatggggtgccatgtataggtagaatatctttaaaaggactcgggttaaattctaaacttgaatgtcaaggaaatacccgcgatcctaatcggtaacgattgtattttatctataactacctattccgttagggatatggactgtattttgtaatacggaccccttcccctatataaggagcggtccgggtgcctcttggggcacgtttttcacccagatcatatgatcaataatacactcggcggatctatccccggacaggagtagggtattacttcttgattaaaaaggcctgaacctgtataaaattccttgtctctaaacccatccacttttccagcttgatagccaccccttttagtcttgccgaaatcttgtttcgacagttggcgtgccaggtaggggtagcatcaagttcttcgccgactagtgcaatgggttttgtttcgggcatcgacaacttcgtcttccctcccgggcaggcgttccggttcggcagcctcgacttcatcaccaacgacctcggcaagatttctctcatcgactcggattcgaaccagtcgggaagaggccagatcttcgccccgttcggtatcccgaactcggccgagatctaccccaagatcatctccaccgagtcggcttcaaaccacttggacgagatccaatctactccaacacagcccgatcaagacgatggggcctatccgccaatcctgatgaagctccccgatgatttggctgctgtcttcaccacaagggcgccttctccctgtagatctatatcacatcctgattttcgtttcaggatttataaattacttaataaattattattggaatttatattaaatgatctttaatttacaagtgaagttaaatgtgggaaataaaatttcctaaatataaagcatggatggatttaatttttattaaattctccatgattaagtcaactctctgaaatcctctcggatttttcggagctcaattcctaatttttaatcatacaaagagcatttcagtaattacccacatattaaattaatcattaaatggtctaattataattttgttaagtactttgagtgtccaagtattttcaggatttttcttgaaattatttgagcattggaagtatttttaacaattcaaagatcatttaagtgattattttaattggaaaagtaataaaatcctcctcctcagcttgggccattttcggcccattccttcctttccttcctctctcttccgccggcccagtccgagcctgcatcctctcttcttctatcagccaaagtctggtttatctccctcttctaatcaggctgagaaaagaaaagcccggcaagaagtctacattccctccctgcgctactgttcatcttccagctcaggcagagcccgtggtctcccgtgccgtgcacagtgccgccgattcccttccaaaatccgacctccccgttgctcctatttccaaattggttgcgggaatggaatcgtctcaatctcctcttacttttccccaagaaatacccaaaattttctatggaaatcctttccaatttcgcggatcaaatccttccttttccggcgagaaccctaaactttcccgagtttttcccgtcgttttgggcccggacccgagctcccatggctatataaaggaccccctagtcctcctctttcgtttgccccctctcccgtggtctcccgtgcctcgtagcgccgccgccacgtgctccaccccgccgtcgtcgccggccgagctccatccgcgccgcgccgccggcttcgttgttgccgccggtcgccgtcaccaccgttgtgttcgcaggagcaaggtgaagctcggccgctctctccccgctgtcgccggtcaccggagccccgtcgccgccgtcgaccgaagccgccgccgccacccacttcgtcgccggccgtcgtcgttcgtcgtttggttcgagggtgagtaccgttgggttcgtctcgtcgtcctctacgtgagcatgccttccaaatccgcagccggccgctctagctcccgcaagcttgccttccgagccggccaccattgatgaggtcatcgctgacgtcatcatcgttttttttttctttttcctgtttttctaatagattaaatcttcggaaattcataactaaatcatcgtaactcggttttgagtcgttcaagttgctaaattcatctaaaatcatgatctacatgtttgtttactttatatgtactgtttatttggtttttattagtctttttcttctttttgcgtgttagcttgtcgtttctgtcgttgcgaaggttcgtgagtgcgtcgggagtgttcagaagattaattgaagaccgattattgcaagacaagtcacatagatcctaaacacaatcctttgagcatgttgatcctatacttaaattctctatttatttcaactgtgcatttattttcgaatgtcattgggtggtgtgaatctattcctttgttatggccaatttgcattgattattctattccttgataccttgggttattataacttgactagttgggctatatatatattggttcagctagatattagatatgattgcttagctatgcttagaaacattagcacacttttgagataacttatgactcattgtttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactgagaagtggcggagataagcccacgggggtcgctggggagtccatgcctctggtttttgagggggtgattatgatccaggaatggtgcactgtggtgagttgtgttgtgcaaagggtattgtcacagcctctattcgggtactttccagtatcgcgacgcatggtagacatgatgatgaggctgtgtcttgtgggtacagtggtacacctctggccagagtaaaactattcgaatagccgtgcccgtggttatgggcgggttgagcaatgtttttcgtgattagtcccacacctctcacaataattatggatgttataactggtaacaatttgcttagctcctggtttggagttagatctgtacagccgggtatggttgttcaggatggttgggcctgtacagcatgggtgtgctgttcagtgttgattaaaatttctgattaattactctactgttttactactcttaactctttgctaaatgctgctttcgcaaatgagcctatattatgccatcctttggtatccttgtgcacttgcatatttgctgtgtggcttgctgagtatgtcatatgctcactttgcaataatcaatcaacctcagttgaagaaaaaggatccagaaggagaagacgtttggcttatatcccagttgagctgcctgtgggagtggagccggagcttcgctagattttattttccgctgcagttttcttcttagtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacaatctaggcgggatccggcctctacctcgatccagcctagctccagggaagtcggcgtcatactctagcctctcggcacggtttcgacggaacaactggatggctacctcagctcccccggcgtcgactcacggccaacggagatcattgagtacgacgacttcggctaccgtagaccgcaacctcgacgacttcgactaagactttgaagataactacacgcctctctacttcggcatcttcatggctgaaaacgagacggaagaacagcgtaaagcccgagaagcagaagaacaacgcgtgcaacaggaagccgaacgaccctgactggaagaggagcgccaagcacaagagcgagaacggctgcagcgtgagcaacaggagtgcgaacgggctgcaaaagaggctgaggaccggcgacagcacgccttggatgtcgggcgacgagcacgagaacttatcgggcagcaagacgttgagggaacggctgtttttcgcacccctcaacagaacgcggttgcagcgatcaccctcctcgacaccctcctcaaggaagacgtactcaatcaagccaatcacgtcgtcaacatcttgaaccagaccaagatcatgatctctgccttggtcccggttaactctgcaagcgtccgcacgctgactggtagccgagttccccctcttcgatctcaagactatcaccaaccaagcctcagcgtcgtcggtgcgggatccagtcgcaggagtaagggtcacgacgagcgatctgtccactcgcctcctgaatgacacagggagcatcgagttgaacgacctcgctcctcatatcgcaggcgccccgtcgatcttcgcgatactatcaaccagcgctgcgcggcaagagaatacgcttcccaccattcactagatcgctacgacaacgacgtggatggagttgctgccttcacaagcaaattgcgtcgagtggattggccagccggcttcaagccgactggaatcgagaagtatgacggcaccactaacccggagtcttggctcaccatctacggtctcgctattcgcgcagcaggacgagatagcaaagtcatggcaaactatttgcctgtggccctagcggactctgcccggtcctggcttcacggcttaccccgtggcacaatcggatcttgggcagaacttcgcgaccacttcatcgccaacttccagggtacctttgaatgccctggtacacagtttgatctctataacgttgtttagaagtctggagaatcccttcgagattacatccgacgtttttccgagcaacgcaacaagatctccgacatcaccgacgacgtcatcatcgccgccttcaccaagggcatttgccatgatgacctagtcggcaagttcgggcgcaagcctcccaggacggtcaagcagaagatgtcattaccgcgtccaagcagtcgggcaccacttggaagccgaagaaagatacgccaactacaggggggagtggaagtaccaatcacaaggatcgcaagcgtaaacccaaggaacttgtggcaactactacaccatcctcccgacaacgttcacgggtcaacacttctgacaagatcatgaactcccaatgtccgcatcatccaaactccaatcacgcggccaaagattgcttcgtctataaacagtttgcagaacaatacgccaagaatgcacgcaaggcctctgacggagatcaaagcacgttaaagaaggatgatgaagttgacgccccgactggttttcaagaccatcgcaaggaactcaaccacatctttggcggacccctgtcctatgaatccaagagaaagcaaaagctaaccgaacgggagatcaacgctattcagcccgacacgccccaatatcttcggtggtcagagacaacaattatgtttgaccgcttggatcatccttaccgtgtggtccacccagggcggtaccccctggtactagacccagtggttcgcaacgtcaagcttcgcagatccctcatcgatggtggcagtgcactcaacatccttttcgtcaagactctggacgacatgcagatccctcgcatggaattaaagccgagtaatgcgccctttcacggagtcatctcagggctatctgctacaccactcagccagatcactcttcccattactttcggcacttgggagaacttccacacagagaacatttgttttgaggacagcgtatcacgccatactcggacgcccgatgttagccaagttcatggctgtcccgcactatacctacatgatgatgaagatgcctggtcctcaaggagtcatatccctgcggagtgacatcaagcaagccgtcacgtgtgacaaggaaagctgcgagatggcccagttccgcgagatcacgctcgaccgagaagaaatccgactggctgcgtccacagcaagcgaaggagaagtgcctgcgaccaagatgccaaagagcggggcaagcgacaccaagaccaagaagattcctctagatccttctgatcctactaagactgctgtaataggcgctgagttagattgtaaataggaaagcgcgctcatcacctttcttcaaaataataaagatatctttgcgtggaaaccatttgatatgcctggtattcctagagaggtgattgagcactctttacatgtcaaggaagacgctaaaccaatcaagcaacgactccgccgtttcgcataggataggaaggatgcgatcaaggtagaattgaccaagctgttagcagcgggcttcatcaaggaagtccttcatcccgactggctggccaacccagtcctggttcagaagaagacggggcaatggcgcatgtgtgttgattacaccgacctcaacaagtcttgtcccaaagatccttttgggttacctcgcattgaccaggtagttgactcaacggccggctgtgagctactcagttttttggattgctactcgggatatcatccgatccgactaaaggaatccggggtaccgagagagatgtcatcaatggggcagt

SEQ ID NO: 6578 - DNA, 772 bp, Oryza sativa
  unsure (1)..(772): unsure at all n locations
cgccgcccattganattcgtagccnnnnnnnnnnnnnnnnnnnnnnnnnnnnnnnnnagagaatccattgaatcccggaaaatgctttcctcctagcctttcgtaccacgtggggtcacgtactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccatggcggcagagtatctgatagtgaagggtcagatcaagtctcctcggattatgaagatgagtctctccgacatctcggcgaggaagagatggaatcaaaagcatgcccccgttgtggagaaattggacacgttgctagcatgtgtctcacactttgccctcattgtgaggaagaccatccaccaggtggatgtcccacccgcaaggtcacatgttttctatgcgaaggtacaaaccatgtgcccaaggattgccaactcagtgtgttgttgaccaagactgcagaaatccaacgaacaaccctacgattgtctcatcagctagtcagctccaacatcaacatcgacgatatcatccccagcaccaatgctcctcctgctgcacctgactctgcagtaaatcatagcaataataccttcaacaccaaccattctctggaccgacggcctcagcaaagaattgtg

SEQ ID NO: 6579 - DNA, 770 bp, Oryza sativa
  unsure (1)..(770): unsure at all n locations
cgcccaccctttgtanaatctcattttcnnnnnnnnnnnnnnnnnnnnnnnnnnnnnnnnccgatgcaaaccacgcgctacacacacaagcaaggaacacacgactaacaacactaccctatagggtggcttaggttctgcgacgggttctccaagatcttcactcctgcttcacagctggcttcactacttcctttgcttcgctagcggatcctgcagtcttccggagcttcggcaaacgactgacgacatcttcttcttcgcaaagctgaccatctagtactagttgaaaattgaagacggaagaaaagggtaaaccttttgcaaatagcattaggggaaggagaaaaagaggaactttcgcaaatagttttatttataaaatatgtccttaggtttttatcccctgggcttatcctacagtcgagatggctctgataccagcttgtcgcgaccgagaaaattaccttttcccgaatgctagtgtattaatccccgtcccaggaaaagccggggtacaccgaacaaacatgatacaaaaggcacatctttattatatcgataatatttacattattacaaaggcacttaggcctgaccatcaaaaataaacagcagcggactagcgggcctacggcttcatttcacaggcgctcaactggggtataagccaagactccacctaagacttcttctccaaagcttctcttactgaaggggggagaaagatagagcaagaatgagtacaaccacagtactcagcaagcact

SEQ ID NO: 6580 - DNA, 768 bp, Oryza sativa
  unsure (1)..(768): unsure at all n locations
gcgcccaccctnnnnnnnnnnnnnnnnnnnnnnnnnnnnnnnnnnnnnnnnnnnnnnnnnnnnnnntatgctaaaaagaaccatactatgccttccttgattatatgccttgcaagtagggtgttaggcttgtcttggcacttgccagtacattatttttaataatgtactgactcttgctgttgaattaacttttgcttgcatgttttagatttagtctttgagtgatgcgggtgatcgattgcttcttctaggacttgaacttaatggggtaaacccctagtcggtgtgcttgaggattgggtagtcaagcttcccgctattctatatctttatttcgccggtcggcctatgtaactatgaagtagttgtgatttagattattttcgtcttaagtgtattttgctatgtatttccatgcttaagatgaaagtgtgaatctagtgcacatcttgggaagtagattcacatgagtatgtgttaagaatatttgagatgttgtagatctttagccatttttgtcaagtctcctgaatgtgtaacacatctggtcgccgccttcgagtggtttgacgggcacatctcaggctgaagttgactggcaggctaaaagcccagcaatgtcttcaatattcttctctcgaggcgtcgaatgtttcattatgtttctttgatgacttgaattattcacttcatctctcaaatataatgggaggtcccgagagcctatgacacaatccaacttattcttgactgtccacgtcatag

SEQ ID NO: 6581 - DNA, 829 bp, Oryza sativa
  unsure (1)..(829): unsure at all n locations
cggcttgaancccgtaagaacttgtctttcaatgattttccccattgtgaactagttgaactaagcatggctaagcaattcctagtccaaactctaatcaggttataaccccaagttgacaaagaaacatggtacaacaatagcatggctatgacaataggtaaacatcccatagtaacattataaaacgatgcagtatttgaaggaaaacaatagagcatttgcaatataggatcaacatgttcaagtgacaagcatgacttgccttgctctgctgctggaggaacctcggcgactatttcgaagtacaccggagcgtcggaggaaccggaatcggaggggacggcggcgtccggcgacggggagcgacggagggaggtcgacacgcggcggacggcgaccgggacgaccgtcgcacgatgggaatggcgctccggcggcggacctcgacgaaggaggggtggacggggtggatctcggccacgcgaacccgacggcggcgacagcgcggtgcggcgacgagcctagcggcggctagtggcggccggagtatcggaaacggcggcggcgggtggttgcacggcgcggaagcgatgggaggctcgggagagttcggcgaaatggggaaaaagcgagagagggcgacggagaagcttaaatagggaaggggagggcccgacgtggcccggagaggcgggattccaccggccaacgtnagggagtgggggaagagaaaaaggtntntnnttcaaattacnttaattataatggtgttataaattaatatcttatttaaaaaaaatgttttattaggaaagaccatttagat

SEQ ID NO: 6582 - DNA, 3939 bp, Oryza sativa
  unsure (1)..(3939): unsure at all n locations
cgcgtgcccttgatttacanatcnnnnnnnnnnnnnnnnnnnnnnnnnnnnnnnnnnnnnnnnnattcgaaaaaagggaggaaaaagaaaaagaaaaaggaaaaaggattttccccagaattaaaatattgcttgctcaattttaattggttaaaattatttctagggctctgaaaattccactaaaaatcctgtcagtgaatttcgacatgtagaactcaagaaaaattccacatgccaattccgattattaattgcattgatttaaaagggtttactcttgctttgcaccggtattttcttagggtcatttataaattaaatttaggcttgggaggagaacttcggggtgtgacaccggaccgccgacgccattgcacacggcttggcgctgcccttcaggcacgcccccagccggccgagatggagccgttgcggtgcttgtcgccattgtcgccgctcgctcactcgcccgggtgagagagccgtcaaagagagggaagagattagggttagggttggaaaccctttccccccaccggctggcgatttcatcgccgcaggatcaatccgagccgtccatcggatcggacagcaaagatcgaccccgcgtcgggacgtcgccttcataggccgcgccgatatgggccgcgtccgcctaagcgccgcacgtgcacataatgggccggtccgttttgggcccgattttcgataagagtgggcctttatttttaatttattaagcccacgaatttaatttctcataatgtgttatatcttaattagctaaattttatcctgattttagccttttttatgggccggctaaggaaatgattggccgcattattatatttaagccccccatttaatgttttatttatttccataaattcatttatgagctttcttagctattttaaaatttctggaaaattatggtcaattatttgatcacttagaaaattatttctagttaaatggaaccaacgggaagtttggctagaaagaaattaatgatatgatattatatttgaccaatgttaatataatttcatgtcaatatttattaagattattatttccttaagccacttaatttatttctagttgaatggaaatttaactagaaagtatttatgatttcatgtcaacatcattatgatggtcatttccttagtatattaattatttatagtcgaatggaaccaacgagaaattcgactagaaagcattaagatgtgaagttatatttaacccactttattataattgcgtgtcaattataattttttattccttagttattttctaccaaacggtgatataattgaggaattaattttaagattattcataattatttatgaccaatggtgctttgactatgaaattttaagtttattttgcatatgatcgattaagccaatgtaaattaactttatgcaattggcaatgcttattatttaagatcagttgcaatactgagtaatttatttctagattaatggaaccaacgggaagtttatctagaaagaaagatgatttcattaagattgttatttccttaattatttctgcccaacggtgatgtaattaaggaaacatctaagtatcgtcaatcattattttcattttctttgtcattttggcctttacggtgatatgacttagaattttacttatgccactagtgcattaattcctccgtcactcgtgccttacggtgatatgatcaatgatctctaatttgttactaagcttaattcctttaccatttctgcccaacggtgatatggctaaggactttaatttcatgtcatttactaatagcattatgccctatatcatatctacctgattttggtaatttgatttaggatattaattttcagtaattcattattctctgccatttcataatcttttctaccctatggtgtttgattatgaaaattaagatttatttgtatgtgattaattaagccaatggaaattaattgcattactaatgtttaattaataattaatttttcagcattaggacaacttaaggctattcagcttcgtgatggatcaaattacgttgaatgttgaatggagaaataatgtgcttattaacttagccatgttggattatgacttagccataagagaggatcctccctaggaacctcaactggccgaagaactcaatataattgaggaagaatatgataatctcatgtgggcctacaataagaagttagccaactgggagaagtccaacagaatgtgcttaatttatgtcaagggtgccatctctccagaagttattggaggaatcattgactataatgacattaagatgtatctggcaaacattgaagaaagttttgaatttgcacctgacactcatgccaatatgcttgtaaatgagatgatcactagtcattacaatggcaaaagtggtataaggaagcacatccttgagatgactcatatggcaaatcaactcagatccatggatatgaaaatatctgatggatttttagtgcacatcatcatgagatctcttggtcctaactatgatccattcaaaacaaaatataatactcagaaagaggagtggaccatacaagaattgatcttacactccgtggaagaggaagagcgccagaaagctgaaaagcagaagattaaagaccggctcaacctcactaatgcctttgataaaggcaaaaaggtctatcaaggggaatcctctaataagaatagtgagccagagggtgagcagaagcaagaagggatcaaggcctccacttcagctgttcctttaagtacaagtccctactgccacttctgtgcgtcagatggacattggcagagaaattgcacacgcttcacagcgtggttagtcaagaaaggtataaatgaaattaaataaatcccttgtgatgaattttcccttaatacttagtgagtttgactcaatgccgatgtgcatgtttctaactcattacaggaaactcgcaccgtccaaacggtagcaaagaggggagtgaacactcagagtaactgatggagtgaagatgaaagtgaagtgttgttggagacctcacacttagtttcacagcaattgcaataatgtcttatttgttcactctattaagagaaactttactagtttaattttttaaattcatatgagaaacgggtcatgtccgttattttaccaaatagaacatgatacattaagtgtgataataaagtgattggtcttgtccttgtgcacgacagtcatatttgttcttttggatgatcatgtgactattataataattgcctgtaatgacaaaagatgagacatcattgaaattgtgacattgtaattgatgtcacatttctaggggaggttagaacgtctcataagttggagatattctttcccttggattgattttagtgaagttgtgcactaattaaacacagttttctattctagtagcaacatattgtgtgttttctgcctaacacattgatatggttgtgaaagacatgtcccaggatcgaattattaagctaagcatttgctaatggatccatactctaaaggctcataaaattaagattaattaagattatgttctggccagtatatatgtaaattagagccttactgagatcctggatgagggggactaaatttttcaatcaacacccactaagttaagcttgagtttatttgagtactatagtgagctataggtcttgttgtctcagtgacgcataatgttgttgaagacacattgccttggggagctattttatttaataaactcgtaagtaagtctcaaaatcaaggggagaatgttggttgaccctgnccacccgtgncaccagggttagggggntcctntnnnntnnngnnnnngacangncnntcgaattcggtgacag

SEQ ID NO: 6583 - DNA, 4426 bp, Oryza sativa
  unsure (1)..(4426): unsure at all n locations
atgcccctganntcgctttgcaccttcccctagattacgttgcaccagttccacggggaattttgcaggagttagtttgagatatgatgcaagagcttcacatttggcttgtgccttacatgtcctttcagaatatctttcaatctatcatcactttctgatgatatatatatatcaactcataaatgtaagtagcggaaataatttgaccgaacagtgcagataccaaatattaatgcagtaacaccagaagggaagcaaaggcaaaggatgctcacaaaaagaaaagaagaagaagaagaagctattgttccttagtttacaaaatagtttttatgaggatatagtagatactacaattagtataacacaatattgcaataagataataaataccacaatggttatagccttgcaaacaaaattaggatatatggattttaggacccacaccagcatcaagctaaatggaaaagaaagttgcccatgcatgtaaaacttatggtcatggatttaactttttttattgggagtctaattctcaaagtattggagtaaaagcccagaacatggatttcactctgaatgcaatgatacatgaaatttttgtatattctccccaaaaggacgaaacagaagggctttcccagtacactgagatggcattctcccttgccatcccacgtcggcaaagatggaggacacataccgcctttgcttccggacccaccaaaatgaggttcttgtgtccaaataaggccaccggttcttgggcgaaaaagagggcgcgtgaggctaggcacagcgttgcttccgcgctgtggagcgagtggcgtcgccctccttcccgtgcccgcagtcgccctcaagcgcgcgccgcctagcccaccgtcgacgtcgcctcttgccgacgagccgcctagcctgccgtcgccgtctgcaaccgacgagccgccaagccctctgtcgtcgtcgtcgtcgcctcccagatccgttgtggagagagtataggagaggcgtcggcagtcgagggggacaaggagggcggcaccatcgagctgttgtcaccgccgtgccgcccagagctcgccggccgctccgaggtcatcctgtaccgccagatccgcgttgccggcctgggaggagagccgccggtcgtcggagcaaagaaggggtggtccccgtcgtgggagagtgacgaagatcagggtggtggtggggttgccgctcggactgcccaccggcgccgcctccgtccgccccaccgcccagcgccgtcgccgcccgggccctgccgcactccggtcgccgcctcgcttcctccgccgcatcgacttccagtgcctcgctttgttcggttcgactggtggagaagggatagaggagtgagagaggagagaaaaagtgagagtataaaaaaagactagtaggatccactcaaagggatatgcaccatggagcatgtagctaacaatgttcctggtgttcttgagctgagttatcacacgaggaacggtatatttttgcgacgcactcctaatgccctaaaagaggccgttcattagtacggcagtcatgtcgaataagctagagctccaacaaaacactaccatactcaattctttgaccccaattattcaaaagaaacatgaagcttcttccagatgcctactatgtggtgattatactaaccttcttttcaatcgcgaagaaaaatataatgaggtgagaagcacgaagaattcagctggacaaaacattatcacataagcaaataagttgagtcgtagcacttctctttcaaggttggtagcaagaacgcctcaagaactcatcaaaatttcaaggtggaaattatgagagccttctcctccacgggagcccagagcccacaagatttcaaaaccttttcagaaagactagagagaacggtcgtatacagtgggtgaacggtataggtacccttcttcgatagggtgccctcaaccaaaaccacagggctaatgtaggtaaaaaatccacacaattcaatacaagatgctaacaaacaaaaatgacttctcaggatggaagaacatacgtatgtgaatatgtgatgctcatgcggtgcagagatcaaaactcagcagtatggaagcacaggcaatataactcacgagttcagggctcaaaatattaattttattatctcagggccgtggaggcgaggtctttagcatacacatactaattacctagcaataacaccaaaagagtactgctaccccggtgttatgtcttcttaaaagaaatcatttggttttcctaccctgatgttcaactcctgcaagtaacttgtaattgcgttcttttgccatcctttgaagctcctgaaatagaaacaaaattttggttagaacaaccaaacaaaggagcagttctctatcactaattcaggttactgcaaatcagtcacataaataggttagccaagtaaaagggccaactatatggattagtggactacttgcaagcttccttgatctggtggtgttagaacactgtttgcatgtaattaaatatccgtaagtagacttgtcttatgattaattgatttttttgcagcagtatcaattatttatatgtaagttttctatcgtacaaaccacaattttcatattctatccaaaattcaaatcaatgcatgatgcatcgtttgaaatgattggatgcaaccatacactgcatattttagttgaacctactatgataaacactatgcatgtgtgctctgcagctaaacaagattttatttagcaacgtgcaaaataaaaatgaaatgaaaaaattctgccaaatttctcaaaagaatgcatactatcagcagatatgatgattagaattcaaatgttttaatcagagaagcagacagatggaacataacagaacagtcagacaattgaagaagtccatacccttagaaggaagcccctttttactgaaatgtcaatttataaaattccagtgataagaatgccctcaactgatgcatttgatgattttctagattgctggatacaattatatatgtgtaccgtcaaggcaaaatttgaaatggttgttttgtaatctttactgatgaatcaggatggccaatttttaaataatgtgtacccaaaacatgaaatagaataatgttcattaaaagatagtgtattctaatggaacacaagttagctatagattaagccatcttacttttgatcaatatgtgcaataatctctcctcctgggaaagccgcttttgttgcttcatatgaaactttaatggaatgcttccacataccgccaacgtcagccacatttttaccattcatctgcttcggttcctccattggcaaagaatacccagagagcaagtggcccacccatacaccatctttcctgaaacattttcaagatataacattgacgaaaatgctttcaaaaattgaagaaatatactcccttaaatcaatgctcttagatcctgctaagaaagttgtgtcataatcaatgaaagaaaatggcgcttacgttacaatatccatatgacgaggagcataatgaccacctcctatgcctagaaggactttttcaccattcctgcattacatgaaaatatagcagacttaatgcagctcaaattcatagcaaaaaccatcattataatagataaacagttcacttaaaaaaacatatacaagcaagatagtcaagagtacccatgctgggagcatgcttgggcgagtgattttatgtatagttctcaacagagagctgattttgattctaacagaaaaaatctcaaagcgttcggtgtgtgcattatactatcaaaaaagtgccaaaaattagttcttttagcattaaacggtgatacattggtctcctacctttcaaggaataatatcagttgtggtggattatcaaatatgctaattattggaaaatataacgagagttcttcgcatgtactaaaattatgcttactttccattggactagtatggaaatcgacattggactagatgtctatatctgagatcaatggcatgaaaagaatgaaagaaaaagaccaattgcttgtcttccatagcaaataagagctaagtgctcgagagacacacctattggtacaaacacggtctatttgccactcaggacaacagtttctaaagatgtttgatgtatgggggggttgtactgggtaaactccacctgatagttttcatagtaaagcacacgaaaatagagagggagagcaagagaggggatgcaaacatacccatgccaatttccaacagattcttcttctccaagaccaagtccttnnnnnnnnnnnnnnnnnnnnnnnnnnnnnnnnnnnnnnnnnnnnntatcactnnggttntccaacnncagctcc

SEQ ID NO: 6584 - DNA, 31484 bp, Oryza sativa
  unsure (1)..(31484): unsure at all n locations
ccagtgtgcactgaataactgatggtcnnnnnnnnnnnnnnnnnnnnnnnnnnnnnnnnnaagtttagcgggatgttttaagtaggttgttggctaggttttctactcaagtactcttaaatgtactcacaacgtgtcaatttctcaccggcatgggcttcaacaaggagatctcgtgtccttgatgcttgggtttttcaccataaatacaatgggttcacgaactcaaaatcacagaggacacttaggatcaaaaatgcatgtcctttccttagcatcacaaagatgcaaaatgaacaataatatcaccataaagttggaaccaattccagatatctaaggaaaaagaacatgaaaatcatggtagaccatacaaacatctacattgtccacgcccagatgctgaaatggaacacaaacgggaaaactaaccagagcgactgcgtcagcagcatcctgtctaccccagtattcttcagtgcttcctacaacacacaagttaaagaaataaatttgttaaacgtatttggtgatcaatgtcacgtgggcatgcaaggaaaatatattgtttaacaatagaaaaagtgataactcaatggttcatgatataatgagttaagtatcaaatcgttgatgtttatgtactattgctatatgtgcaatatcacctgaaatttattgtcatctgaattgtattttcacatttctttcgcaagttgcccagatatatccttttatgtgacctatcattcaaactgttcatttacaggacaacattacttcttttgagagagaggacataattacttgtacttcaaactatctgtgtgcctgaagaatcaatttgaagattattttctctttctactattataaatatcatacttatttatattatttttattcagggaactgctggatagcatttcaaatatagtagattcaggaagagaaccattgaactagttcatactttggggtgtcagaacaaagaggacctttcggccgtcagtataaaatccaagatctcaccctataattttaggattcaatacaacgttcatcaatgacggggtgcaggcattaattcctagcctatgcaacttacagataaactgtcctgtccaaaaatgaatcaggggaacagaaaaaacaaagaataaacttaatgaacttaagttgatcaactaagatgaagttacaaaacattatccagaaatcactatgaataatctaatttgtgagatatgtctggctgtcgagcaataattaagtaaacacagtggattaaaccccagaaagaaaaggtgtggagaatttcgtaccaatctcaacaaacagcgtcggcgtgttggtcactggcccatggtgagtgccctccagcgtaatctgcagaaacgagaaccaatcaatcaatcaaccaatgcaaacaaccgcgatccccaattccacaaaggaaattaaaaaagcaaaattaaaaaaaaaacacaagtaaagtaatcacctcaaactccggcacgaggccgcggtcggcggcgatccggcggagcaggcggagccagggcccgatccgcgggttgggcggcgcggcccacccggggcgcccgccctgcggcggcacgtccacgccgtccctgaggtgcgggacgccgatggggtggacggtgagcgcgggtcggttggagacggcggtgtggcggctgaggaggaccacctcggagacgcgctcccccgtggcggcctcccaccgcaggtccaggtcgtcctcctccacgatcccgcgcgcgtgccgcagcagccgcacccccgcgccgttcgcgaagctctccacgccgtcctgcgccggccgcgcgaagagttaggcagggaagaaggcggtggcgagggcgagggcgaggcattcgtaccgggatggaggggccgggggtccagccgggcatggcgaggaacgcggcggccggagtggccgacgcggcgtcggacgtcgtggcgaccaccagcaccaccatctcgacgtcgccgccttccttccttcgtgttccttccttctttctctgcaagaagacactgctgctgctgcaactgctgctccttcgttacggcgtcgttgttgtgttgctttatttatggggtggttgtggggcccacaggtcagcggcagtcaaattgggttcgtcttggtcggcagacgcgaaagcttggtgttggtggggtggctgggactgggtggccgcccgtgggaaagttggggaggtcacgaacaatgggcgtgcgtacgtacagggtgtttgcgcgtcggcgccggcgatctggccatgcgggctggcttgcaggggaggcgaaatcgaacaacaagtctgactgcgccgtgggcccttcgttgtctggttggaatggaataagtccacattctctccctcaactcatggccgtgtatgaatagcatccctcaaccgcaaaaccgggtataacccatcccccaactctgaaaaccattgcaaatcaactctccgggcggttttggaggcggttttgtcctacatggcatctttgactctgttgactggctgagtcagcaggtgggacccacctgtcagtgactgataaaagaaaaacggtgggcccactgtcaaccacacttcttcttctacccttttctcgctcctccggccgatcctgacggctaggagctcgccgccatcacagtgcctagccaccgcgacgatgttgctgggggaggcttgccggggacagctgtggatgggcagaagcgtggcgagaccgaggccggcatggcggtcgttccgagaccccgcggcgagcagcgagagtgcgctgagtgccacgaggaggagcagcgccgcccgtaccaccgtcatgtacgacaacttctccccgccgctctttcccctcctcctcctgcacctatgtctgcacatcagtgcacatggattgccggcggcggcccgcggcatagcgtgattcgtgcggccggcctcgggggagacttggctggggcagcacgtgagacggcagtggcaagaccaattgctgcaaaattccatctccagttacatctacaaacggctccaggaagcaagcagtcggatataaaacaatgcaagatcaatggttatccatcaacaaagctgcagatagccaggtaccccaacaatagtatcaatcagaaaattgccgggtggcataccatgctgaccaaatttactaagctatcgatcagcaatttggtcgactgtatcatgatttttcaagcgtgtatgatactatgatgcttatgatcagcactaaatcactctgccaaagcacgcaaaacaccgtcaccagagaatccccaatcgatttgcaaatatttgcaaacccatatggcacgcactagtgtaggcggcgaagcctaggggggaggccgtcatgcacatggacgcagcggcgaagacgggctgcgctggtccacctgcagtgagaagccactccacgtccaagggttgccggccagctccctcatctcgttcgccctcctccgctctggatctgaggagggggatggcggcagcggtggaggcgatagggtgggatgggggtggggaggaggagtcggatcggagcgtggcgctgaaggtcggccgagcaagagcggggcgcagcctcgacgactgacggcggggtggggtggcacatcaccgccgggatcggccggaggagcgaaagaagggcgtagagaaaaagataagtgtggttgacagtgggccccacctttttcttttatccttgtcactgacatatggccccctgctgactcagtaagtcaatagggtcaaaggtgccacgtaggacaaaaccacctccaaaaccgcccggggagttgatttgcaatggttttcagagttgggggatgggttatacccgattttgcggttgagggatgctattcatacacggccatgagttgagggaggaaaaatagacttatcccggttggaattgaatggtcttgtgggccgtagttgcggtgatctaaagcgtatactagctgcatacaaagaaagattagattatgctgatgataaacttggtaagcaggtacagatatataggtagttataagaacttgaaaaaaaaaacatatcggaacatcatgttggtttgtaatgatccattttatggagcaacttaccccttcatcatattctctttattcgtattcaccttttaccgttccatgatccccgggtgttgccctcacctcttccacaaccaaatatcaacgacgtcatctcctcagcatcctcagtcactaccaccaccatctctccccttgcaactcacaatcatgaagctctctctttccaatcccaggtggttattgggtccctcaatcaggtgcggttgccttaatccaccaggtctagtcatcaatccatcatggtcacttcgatctaggagctgatatcgtcgatctagctaagtcatgcgtccttcttcatctatgtcaccagccacctctctcccctctcatcctagtccttttggggccagggcgttgtgtcttctgtaaggcacatgaaggtgggtaagaccacttttgccactaagatgatcgctcggctctgaggtggatacttaaggccacatgcaagagtggagcgttgtaaatgctcttggcttaggcttagttcgaaactgagttagggagcttataagttgcatgcaaaatgagacgcattgttaactaagtattattttctccgtttcatattataagacatttttatctcttcatctcttgtctagatttactaacatccatatacatttagacacatatgtgaagcatatacatggatctatgaaagaatctattcaaaacccaaaacatcttataatgtgaaatggaggatgaagttattttgtgaatgctatgatatccaactttattagtagtactaagttcaccaaaaatgtttagttttaaggaaatggttttgttattatattctgagggttagatttgtttgtacgataacatgttgtttcattagagtttaaaatgcttgtgttttgtagccagatattcaaattgaattatgcgctgagtacgttatttcttctttttttaaaaaaagaaacatataatagttcaagtaacctacttcttattaactgttatatatatgttttattcttacacaacttcaattatttaggatgtgtttgtttattgacgatggagggagattttcagtgtacgcgaaaggagaaagctaattagcacataattagttaagtattataaaataaaaatagatttatttgattattttaaaaacttctatatataatttttttttcataaaatactttgtttagtagtttggaagcatgctaacagaaaacgaggaagctgtcgtttggagttaaagcttagaataggcccttagttagcggtggaagcaaatttacaacatcgatacatatcaatatggaaaaagtccatataccccctaaacgtttatcttggaggcatgtatcatcatgaactgttaaagtgggtattaagttccttgaactttctcatttggtccaaatgaccctctagggttttgcgaagtggttttgcccgcacaacatgtgactcaacatttttgtcatgccaacgcactcattgggccacgacgcaatattaaggagaacataaaattgtcacatatggcttaaaaagaatagtcaatgagtaaacatccgctcttggtatataacttttattttattggtggtataagcagtttgtctacatggtcgactctcatgtaagtcaattcaccaagataactgcaattcgccatatcatcagaactatcaaaatccgaaggtgagagcaagggatcacccaccgaatggacgaccctgaaggaggggggagagagggaggtaagaaccatgcttttagagaagtggcggtccgaatccattctgacaaaagaaaataacagactaaaccgtgccataaggggggcattctccacatggaacgatagcaaggccttcatgtatgaaaacaaaaacagggaaaatgtaaaatatatgatttctatttcaaaagcttaagattttggtcagcaggaatgctgatagtgttccttagatttgacgttgacctccatggcaatcatcggttgagttcggtgaagccaccaacatatctacgactcaaccccaaacctcaattagtgccaaatctgtggaggcagtcggagggattgctggcaggtcaagcgggaatcatgtttgaagaggcccttgggtgcaatcatcgcagcaatgccatgggcccccgatgattgtatccactactgttgtatcagatagtatgagagtttgcttccaccattcaatctctttaccttctttcagaaatatggtccttaatgtttgctgttgttaattttttgcatggtgatgttttagggaatgttcttcgcttccaatgtacactgcttaatatacaataaaattttatgagttaaaaagaagagttattagatcaaataaggtagttcaagagtcaatggtctagataattgccaaaagaaagcccaaaaatacatcccaaaattatattcttgaatccgtaatcagatttttaggtgtgaatagattcatccctgtaagaagataaataaatgttaactcccagtaataaaaaaataggtccatcccataccaagagaatcattggttcactgtcctcctcgcgtatggtgtgatcggtggcctctttccgtgcgttgcgagtccctgatcccctcctgcacatgtctaacacccttagatcgacggattgggagtgagaaaccacatccagcttgtgaagagcgagaaatatggagttgcaaattaaatttttgcatatctgtagaggggaactgttggagccgatttttcaaaaaaaaaaaggaaatccaaaatgttgggattggtttcattttgggggtatgctcatataaaactctagggtgtaagctcatggggttatttggatttcttcctgtcaatatccaagtttcagcttgtatggcaacgatcaggaagggcatgaaaaataactatggaagttgacaaagagaattaatatcagaatttaatttttagtcccatggtttgtttgccaagagaatgaaaggggattggaagttttagaggagtgagttatgggagtttcatttttttattcccagtcttttatttggtagtagagatgagaatcatgggtagtatggatgataattgaattttaagtgatgatgtaaagctcagatttatctcgtcatacttagaaaagaaattccctagaaattacatgcccttacccaattgggagtttgctctttaaactccttctcaaatccctcacaagcttccacatccaccaaccaaacagtaggttgtacctctcaaagttccatccctgttaacaattccccctaaccaaacatgctgtcaattccttatttagttgctagagagaaataataggggatgtttaaaagggaatttatgttatttgttcggttgtgggttttgagataagaaattattatcataatttatgatgaacggttgggatggaatcgatgggagttcgatcaatttcccatttcaatctctctcaaattcccatgttcttcaaagattaaaatgctctaatctcctatgcttccattagcattctcaaactcccccaaaccaaatgtaaccaaaataacacgcgaaaaggattttcaccacctgtctggaaaggggaacatatcttcccgtgcacaccaattagaaagtatcacgaaaaattctacaaaatatatattttttacacatatttcatattcaaattcattatattttagccgtatcaacaaaattctaatagttttaagggtaaaattctatcagaattttgtcgtttttgctacggctaaaatataataaatttgaagataagatttcacatgtaggtgtaatactattgaaagtatgcgtccattttattttagaattttatttgatagttcgcatacatgggaagcctatgtgtccataggatatggaccgttgagacggatacgtacccacacgaggaaaacgtactcgtggaatacgccgtcaaccgaaccaagcctttctgtccttccccttcccctagactctttctctctcgttgcttcatcccccgcttcttccctccatctccccgtttcaaaccctagggcacgtcctccacccccgaaaccctaaccctagctccccaatccgcccgttccggccaccccaccgccccggaatcccttttccgccatttccgccgcttcttccgctcccgcccgctccccgcgccgcccgcggccgtgccttcgaccacccctcaccccttcgcccacggggttcggcgtagtgcggggggctcgtcccgcgcgggcgctctcccgtgccccccgcgggaagggaaggctctccattgaggcctcgctgatgaagttgcggccatgagtaggctctccttcaggccgcgcccgctcgacattcacaagaagctccccatcgtcaagtcggcgcgtgagcttgaggacgatgagaccacgctagcgcttcgggctgcgccgccggtgctgcggcactcccagccggagcccgcggctgatggcgaggtaatgcacggagtgttgcgttatctttctttgctgttttggtggagtggttcactgccagtactccacaattgagttgcttgctaattcatttttgtgcgcagaaatggaataattgggggtgctggttaataaatttgatcagcttgctaatcattgacaatttgaaagttgtttgttaaaactgctgataatgctatgcaaagtgcaaaccttttctttttgtttcggacacatgcaaagcacaaacagtataagccccaaaatccagaggttgctgttttgtttgacctaatattaaatttgtatcattagttttaagattcaagacatgtttagcatccataagctgcaagccagccattatgtttatatcttgaccttatgtgagctgagccactatttctgccatgatatttttttggtgaatctaattttaaattcctagcagagtttattaattataatgagaaattttataatagatgctgcactaaaaaaataagatcagaataaactagttggttggccatagttcagtttgcttgatgacaggcatgatcataatatgatatccttattttacagtttggcagatataaacacttcttttctttgcaggcacatccaacatccagcaagaagaatgtgcaagaaataccctacaccacagtatgatgatgttgatacatacgaaagggactatactcgtacctttgcacagccaacatcctacatacgtgccagaggaggtttatttcttgttaccgcaataattgaaatggaaataaaaattgaatatatcttcagtggttgcatttcttagagaaattactgcttgcagccagggctgagattggtgagtttgttgaatatgatttggacaatgaagatgaagattggcttgaagactataacaatgagcggaaaaatctgaaccctgaaaagtaaggaataaattgctcatcaaaataagttatgagagtggcaatcttatacttaaatacagtgtacaccatcttttctaccatccactaatcgtcctacaaatgggagtggtgagggagagaatgttgggtggaaagaaaatgtcaagtgatgacaaagtttttttttttttgtaaccaaaagttgcatgtcatttctataccatgccacacatgccaatcattctctctagtatatagtaaaataatcttgacatgaaaataattgccttatatcatttgtagtaactgaatagaaggtattatttgctacattactaataagaatacacattacaggttggaggtcctcctattcaaactggaaacattggaccacaaagctcgagaaagagcaggcatcataacccccacctttttaggaccaataccagttattctgcagcttgattctgccatggaggtaatatttcatagagaaatttcatggtcacttgtagtttgcagttcttggttgagttggcgagtttcttgtttatcagtttgatttgagtcacatgacttccaaaaacatttgaactcttcaccaattaccatcaaggcacaaaaagggataaaaaggtatatgtgctgtgtcattgaaaagtaaaaggaacaattgatagcactcagaatggagcaacacaagagtgagtagcatataaattacaatagagtttggttaatctggaacaatgtaaaagtttagttcaatcagtagactaaatattttcttgttatcaatctgcctacctcttcataaagtacacacttttcatttctgaatggtttgggattttctattatcttttccaaataaacaaatcattttcttcttcttttaatgccatgacagctttattcttttttacccatgcgactccagatgtatttgtcttttgtagagtcgccaacagaagtggcttaatttataccttcctgaaagatgcattaagaatttagagaagaagtggacttgacagtaaaagtctctaagatgtactccctccattccaaaatataaggacttcaagccttttttttggagatattaatgatgaagggaaaacactatgatgcccctcattaaatgagggtagttgggggtaaggttgggtgagaattacatgaggggtggttgatgcagggaagtccatagtactttagaaatccttatatttgtggacaaagttcaaacactagaagtccttatatttgggatggaggaatagatacagaaggtctgtagaaggatgcttttgttagatttgatgatttttcgttccttttggagcctacatctttagtactttctatcttaccagatctcctaccatagaacgtactagagatgtagtctcaaaacacctgaacagagcttatcagataagcagatctgctaatgtagtaagtactagagatgtaacaaattgataattaactaaccgtagaaaaaaaaaggggaatatattctacaccaatctggtcaggtctggggagaggacctttccaattggaataaaccttgctctagaaggatgtgactttaaggccttcctattttttttttgtgcatcacacctgtttggagaaccgggttggttaatcagaattgtcactgctgatgttactgctctattagctagcaggtatggcttcgggtattcaagattcacaaaacatatattactgtgctggtgttatctattacttgaaattggaatggaatctctactatatagaagaacctagaggtggtggataatctgccatcacttagagttgttgggatcttctaaggctggataaatatatctttgtgtgtgtggcttggtttattattggatgtttgcttgcaaattatgtttgacaaatacaatttccaagtcaagaaatttagatatatattttgaaatacattgcaaggcatggatactttgctagttatctataatttgctctttacaaggtgtttctttatccaggctttgcagtacttgtctgttcgttatgctgtgttccaggctgtatataactactggaaatcaaaggtatattccatctttagaacatggtatatgtttttgattcttatcatatgacatgtgcatcttccttttctagacaacattatgaactgtctctttctacaggataacatgttatattttttcaaaaccaaatttgagattgttctgttgtcatcaatagcaatatgttttttttgatatatatgaatattattcattgtatgtactgattcgtttttcctttatcagagagagcggtggcaaaagcctattttgcgacgtttgcaggttagcttaggtccttgtattgtcctttctatctttatgtttcacacacttcttattgatgtacagatttagatctgagcttatcgttgtgcacaatatttggtctgtgtttgttattgcagttactttttaaatataatatgaactttttttgtcaactactgtagtatgtttgtagatattatctaagctctttttaaagcagtaggcgcaaaatacaatcaattttactgaattgacagattttgtgactacaagttttgaaaagatcaaagtggttctctagagtaaaatcccttttgctgttgttgatgggttccttcaaagtttgaagagcaacctaccagcccaatctggaccaaatcataataactaggctgctaactaggtcgggctgtgttagtgctgctgcacatggtcgaaacagcaggctgtgtgaggtgcagggttgacctaactaaaccatcaggcttgtcaaagttccatttcccagtctcccatcttgctaaccagatctcttccatacaaggataagtcacgggacatttgctactctaccaaggaagcctctagtggatgattccagtagggatagtgacttttatggtgactggaaagctttctagcaggaagcttggacggcagatggcggttttgttgacagtaattatcttcaacttggaaggcttccccttctccatcttaacaggtcctttccaacagattcctcatggctttcaccaatcatggaggattcaagatcttctgtgaccactgggttcagtttctgtttttctcctcgccaggagaaatggaaagcttttgggacgatggactacttttaaaatttttttcctttagtatagtgaaaaatatgataaactgtaccataaaaaaaatgaagggacaattgcttatttaaccccttttcagagcctaactaccaatgtaaccctaccttttctagttagttcatttgaccccacttttcaataacaaaggtaccgtcttaccctatttccattacaccgttagggttatatatatttagtaaaaagaaaaaaaaatcaaattactattcaaactgaccaaaatacccttgaggacccaaccctatccattcactcccaacctcatccctctcggctggcactaggtgaggaggccgcgacggcagtggtgtgcagagaaagggagcagcgcgctggtctatctgccataacagggtcaaaataagcaagggcaaaagggactatttgcccttagttaacactgttatcttgacttcacagagtagggtcaatcttcatcttcgattttgaaaaacggggtcaaataagcaaactagaaaaagtagggtcagattggtagttagacttcaaaacagggtcaaatgagcaattgccccaaaaatgatagtagggcctgcaaggtgctcctagcatcatggcttatgcttataatatgtttgcattttcaaatgaacaaactggggacaaaggtctacaaaaatgaaagaaagtaattggataaacatgtggtgtttgtttattattactcaagtgcttctctgcccaatgacaggtcttagtttcaagaatttcgttagttgcggaaaagttcaaaagcaagttaaattcactatttatgagttggctcacattcttgagttattattctgtttcatatttcattaaagaaaaaaaaaagtccattttactcccccgaactattgcattttatcacctaagcccctaaactaggttttggctcatttgaacccccaccccaaactagaaactagaaactagtttgggggagtaaaatggactttttctttcattaactgtggtcaggtagaaaattaccacaaaactaccgctgtttatatgtttgctttcttgatcacacaactgtttagagtaactgtttttttcttcttttggtgaagccgcctccgccagttaatgacacaaatccatacaatgtgttcagaccaagggagaaggcttatcgtcttcacacaaggagggtgagtcacaggaaactagtttgacaatagctactcctggacaattttgagtcatcaagaaagcacaggagtgataatatcttcgtgtgcctatatttctttgtgtacttatgttcatttattttttcagatgcaaagacgagaaaatagtgtccaatcattcgacaaactccgtgtggtaagtgtaacagcaatagttgggttttcaaggagcagccgctataattatggaaatatgcatatgtttggtttttggaattgcgtatgtataggcatttcttctttatccaaggattttatggcatgttgttatccttttcttgttgaagtctctgacttgtgcatctttctagatagagtaaattttacaacattacagctatttgacagttgtcagaaaaatataaatttaaaacacaatgttgcagaactacatactaacattaatttgtcactatggctttagttattgcaaactataattttaaatgttccatcagtacaatagtgccagaaacgtaaattcacaaatctatagttttgtgataaattcattgttaaatctgctgttatgttatagtattgtttaaatatgtattcttgtgatatggtgggcttaaatacgttgttttcaatagttttgtcaaaacatatgtagttttttgaactctttagatattttcctttttggacacaaatatacacaggcttgattgaaactatggttctaattattacacaagtattttgacattgtcttagctgtatttgttgttctctatttttcattggaaaggatgaatacttgtgttgggtcccgcagaccaggatagcctcagatcaaaacctaaatgtgccaggggttgatcatattatcttaacatcatatttctatatttcttaattgtatttctagagaagatccatatttggttgactatcactagcttagactgcaaatacattcaagcaatcaagcttatccttaaatatcgaatgttttgctgtcctcttgaatagcaaacttcttgactgtcaagaaagcagagaaggaccaattattgataactcttaatgtcttgatatgaatagtgcagtatgtttgcctctctgtttttttgcttgtcatggtgcctttgtgttcttgtgtagtgcacgatcttaatcataaccatcatattttatgttctgtagtgcttgcaacatggtgtgtatctgaaatatgcacttgttgtctatgtacactgatatttaaatttgcttatttttatgttttaaaaccccaatacaggtccggcgcaatctagagcaggctaaggcactaatgggcgcattgattaaggtatgcaaatgcattaaataatgccaattttggcatgagaaatactaaaccgtgcactcatcctcttcgcagagggaagagagaaaacgtgagactatggagtgtgaggttcaccttcgacgtatccagatgagatacaaggtagataatgctttattaaactatatgaaatgccttctgtcctttggtcctttctaccatttaatgcactagcaattaatttgaatttacatgttgaagaataacaaacaaaatgaaagttctggtaggtgtgtaacaggatgttgctagtaagtattggttgattttggaaagaaaaatgctaatttatgacttacgttttcatcacatgatctcatacatttccgagcataactccctgcttagtctaaaaagagtgatacatggcttcggcatctaagtgtagaagtgcaattttgcaagtgtttaattttcattactcttaatatgtaggttccctcgttttttctgcagtagattagtgtacatatttaagaaacgaacaaaatgaagatgattgcttgtgagtatgatagtgcataatgcccttatgtgttcaagtagtagatggataattcattgtggctacacgatgttgattttattcttgtttttcatcacatgcaaatctccagattctgtcttgttggaaagcacaaagaggaacttgccacttcctcacaaacatgtcacaccaaaatccacatcactgacacagagtgacatacttgaattacaatgtagtggcaaatcctgaaagctcccatcagattatgtgttctagctaaataagtttattctttgatgtgatctgtatggcccgggatttgttgcacaccttaaagtttactatttctagggagtatttgtaaacctttttggtacggcctatatgcttgggaaaaaaattcctataagactaggggccattttggattgatgccaacatgtgccataacaatttattggtagtttgaatagtactagtgaatgtttgtactaaatccaaattgttggtaaggcctttgaacaatttggcattattctctagaactttcttatctgtatcatcaaattttggcttcacattggtaacaatccaaacatgtgtaatacttaccaagattttggcactaccaaatatttagaatcttctcaaagtgtgacacgggccataattactgtctaaaagcatatagttttgtagctgagtctcataggattttttccccaaatgctttacttctttctgtaaaacagataaaatttaagaggcaaaattatctcctatgattaacaattttattccttgttcagcatgaggcacagcttattgatgatgggattgctctatcaggcctccagcaagctggatcaagtgaagatgattatgcagattcagatgatacggccaacgagcaaccatatgtacgatcggttgcttttcatcctagattccctgataataagctatcagctgttccgccattgcgtttgaagcgcgagcgtgagctaaaaagaagaccccaccagaatggctggttgttcaaaagggtatgcttttttttggtaattcttttttaacataaaatcttctctgaagtagtactgccctcccatgaataaatgagctaccttaccaatttaggtctaaatgatgggcaaaaaatcattaataccaatatggcaatattctttgttcttgcacaactccaatcgatttttgcaatgagaggacgtagaatttaccactgttttgcaatatgggtgtgtacgattgccaccccccccccccaacaccccacacaacatatactgagtgtgaccagcacttctactgatgagtatacagtcacttcttttggagctattgtaggcacactgataactaaccaatacattcctagtcaactcttcccaatagggatgaaaatggtagcagaaattcctgatccaccaactactgtttccttattctaccaactgaatcgatcggaataaaaattcgttagaactggaaccagaaacagtgaggctaatcgtaattggtggtggaaatgattttgctctttggtgaccatttccttgatttaccaaattcatatggagaacattgccaataattacactggcctaacagtgaaaagcctgtacacagcgactaggccatgccctgttaaacccagcaaccggcacaaccttcttggaatttgcacggctttgcttggtaaattccacagaaatacctatcggactagggttggaacccactatctactgccagcccatgcatggggcaaaccaacaggctatctgcttgtagttatggacattttcttttagacatattatatgtctgctaccttttgagtatttgtttagtatagcaaacataataagggtgcggtttagttacaggaaagcaagattaatgggaaacttaacatcccctgtaatccttagtgtgagaattagatactgggaatgtaacattatagcatgcacatgtgagaaagaaaatgataagattctgctaggggatggggagtaatccaagctacctgtttcaaaagggatcctaataccacatattaccagaatcttagttgtattagaatcctatattcttaattaacattccaggtgattcaactaaacatgggaatcaactaggattaccccatgattactgggaatccaagtaacatccttacaactaaatgcaccttaagtcataattataaaatgatacatgtggttgtatgaatttattccataatatccgtggctatgagttatatatagtgtgtatatgaatttatcttattagttgctcggtcaaccgcatgaaatagcaaattatgacttggtgtttctggtctaaattaccagttcgagcagccagcatgtttctgctctaatgattccgcctctaatactctgatagttcaaatattcatttgttaccattttcaattctcataaaaatatggttcagaaaaccttttgagcattttcctatctattttgacttctttcacccctaattcccaaatttgtctgaaagaacagccagaaattgatgggcttgctaggcacaatttctgttgctctagatagttgttggatagtgaaactaaaatttaggttcacatggcaactcatctaattttttatttgtcatgtttatatttggatcatgatttaacaggttcctgaaatgcgggatcctgaggagccagtaatgctatttacaagaccaattgaccctgataagctgaagatggctggtatcaggccaccactagatccacctattgatagtggtactactgctccaccattccggtggcaagctagaattggacggggaggtcgcatcatctttgaccgctggaatccttttcttcaagtcccggtcggccaggaaaccaatcatagaccctcaatgccagaaggatgaagcaaaggcttttgctgtcacatatatctctgttcagctggtgagagattaacaagtggaagagctgtttctccatgatccagttggccctcggagctccgagctctccttttgatgtggcaggaaattctaaggtttatttatctgatgaaagaaagacagccatgcttctctcctggatttgctgctgatgctgcttgagggaacacgattgaaagatgagaatggagtcatggattggctttcctggtgctaacatattttcatcagttcctcatctctttgcagctgttgtacaattggtggcgctgtacatgggaaaaaagggtaagaaatctgtttacccggttttttgtctgacctcttacttgtagaggcagtatcagatgttgcaatgattttgacaactatttattgggaagggaaaaatccttctcattgatacatctgcatgttgctcgcccacatggtgattcatcaccctagtgcagttctgcatataatcaaacttgtaactgcatgctttgttgttgcacagtggtagttaatgagaaaatgttgtctgtttctctaaattgctattatctcgtttgctctttttaatggactgtcataatcataacttgtgagctcatggggttatagaaagagtgcatctgatgtgtagaaaacaacggaaactaaaaggggtaaaaaaggtcaaagatgtataaatctttccaggaagtttgaatgatcaggaatatatcacaaatttcgggagtaaatttcaaaatgtgtaacccatacacgagataattgtgacccacccatatggacttatttatggaggttacatgccccgctcgttttttccccataaaaacactctgcactcggagtaatcaacggtcaacagtaagatatgattttatcgaggaaatagagtagagttgaagtgcccactttgttatattatgggcatgtttggtacagctcaactcctaagtttagctctaggagttaggtctggagtggagttgtggagctgtctaagcccagctccacaactctagttcattttgtgagagaactccacccagctccacttctagttttggtggagctgaaactgtttagctgagctccagctccactcccggtggagctggagctggagctgtgccaaacaggccctataactcactttaatcttgtccaagattaaatttatagaaaaacattgcaatatttttaacataaaataaagatactataaaaacatattcaatgataataaatttaatgaaacaaattgggtgttgtggaatagtacatttttctaaaaaaaagtttgactgagggcaaagtcactttaactttgcgtcaatcctactcatgtttgattaagtttatataaaaaattaataacatttttaacataaaataaaaaaacatacttgatgacaaatttaatgaaactaatttgatgttgtgcatattagtacatttttctacaaatttgtttaacttaggataaactcagtaatataaaatagagggaatagaaaaaaaaaagctctccagcagcaattagcatgcactttgctccattattcttatacttgtataacatatgattagagtgtgatggtcttatcgtaatcatgattgataaatactggtattgcacatggaatctgcactattcataatagaacaatatcttagtgttcaaagaagtattatggagaaagaaccatctatgtgtaaagttgacggagctcgtggctcctcaccgggagaccgggcaagcccccctttgccagttcggccgggggcttagggtgaaatctcaagctctcactctctctgtatgtggaaatatcgtatgccagccagaaaacacgagacaccgacgatctatacaggttcgggccgctgagaagcgtaataccctactcctgtgttttggtggatctgcgtatgaatgagctacaagtttcagctgacttctcccccgttctaagctcataatctgggaaagaatcaacccccctctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatggtcagtgtcagaccggtcacaaatcggtcgttcttgtccaccgcgtgtaatcttggcaacgtgcatgtttgcccttcttcacacaacatcttgcctgtaatggttaagatgaagcctggcatatatcgaccgggtctaacgtgtcatctctaagagataacacgcttaacgccggcttgagacgagtgactagaggctttcgtcttgacgggatggggcatggcgtgtgtcagaccgccagtcgccacctaacccgtgatctgaccggtctgtgactggtcacagaccggataaagggacgcgccgtgctgcactgcatgcagcgtgacacgcttgaccagactgcaataaatgctgttaggtgagcacagctgtgctcacttatcccatatacgtggcgcagacttcctaaagggggtcggggtgccccggccctcggggccagggcaagcgcaacccgaccccccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccactcctaaagcctggtgacaggtgggaccggtctgcatagttgggcaaaatccccaacggtcccagtccatgcacattggtattggtaactttggttgtccataatgggcggtctattcaagactgccacatcacttgagcagcgcgcgaatctgggtgagcagatttgtctcgcccggagatacggtaacgccgcttcggttggcgagcgtaattaacgcgcgcacgatacaatccgtttcgattgccacaaccgcatatccacttcaagcgccgtaagcgggcgaatgggattagtggaagcgtgggcacgggaaacgagggagcaagatagcgagatacgagggagcgaggtagtgggcgcgagaaacgaggagccaggcccagcgatggcaagggtataaaagcatcgagaaaaggatttgctcccttcctttcgcctttgttcctcttgccttcgctgcctgagctctaactctttctctaccacgccctactttcgccacacgcgctcgttcccaatcatctcttcctccaccgccatggcacggggctctgctctgctcgacggcagtgtactgccgccttcccgcatcgtgaatgagaggcacgccggactgccgcgccgcttcatgccggagtccgccaccggtcgggagattgtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccatcggtggttggcggctgctacttccagccgcgggggccggtgttgaaccgctacatcccctgcgtcctccgcaagaagtgggacgactggaagagcgactggttctacacccccctcgccgacgaagcgcgcctccgacttccgagccagcccccggcgcaggtctccagctggcgggcgccggtagatctgggggaggagtacgacgccgtcctcgaccgcctggcgggcctgcgatcccaggggctcaccggggccatggtgtacggcgattacctccgtcggcggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatcgatcccgaccgcgtctccattctaaccattatgctgggggtcggggcctcagaggagagagcccctaagggccacgacggcgcgggcgagagccgcccggggaaaaaatctgccccaggagggggtcgtgcttctgggccccgcgtcgggggctcggggagcagccgccctgccgacgccccggggaagaggaagctgggaggaacacctcccccatctcctccccgagggggcggggcagtgcgtaccagcggtcggcgcccggagggggctgcgccgacgtcacagcccgagggggagcgcaagaagaagcggctccgcaagatgggggagacggaaccagcccggggaaacctaatttcccctccaaggtggtcattcaaccgaccccctcgcaggttcgtctcattctcattgcgaccacctttctcccaaagagaagttttttcttactcattttgttcgtcttttggttttttcttctgcttcagcgatgtcccgtcgcattcctcccgccgccccaagtccggccagtccgaggtcgaagatccagcggccgcagaggagcggaggcgggagtctgaccggcgtgaagccgcagcccgccttcgggaagctgaagaggccgcccgggaggccgcccgggttcgccaagcggaggaggctgctcgggaggaggccgcccgggctcgccaagccgaagaagctgcccaggaggaggccgcccgggctcgccaggctgaagcggcagctgctgctggcgcgtcactcgggcccactccctcgggcggccctcaagcgacatccttcgaggcggctcgcgacgagggccggggcgcgtcgcctgggcctacctcaccgggcgacgcccaggaccaaacgggcccgggggacatccccgagccagcgcattctcggggggccaaagccgggtggcctttttcacaggcggtttttctcttttcttcttgtcgcccagtgaggcgcgaagccaatatggaaggctttggccgccgaaacaccggggtgctagatggatttagcgcccaggtggaggccttgcgagcggaacgagcggagctcgaggccgcatgggcgcgtgtcgaggaggggcggcgctcggtggacgccatggtggaggtgggccgtaaggcccaccgccgccacatctcggagctcgaagcccgcaaggcggcgctggcggagatcgcccgggaggtggaggaggagcgagaggccgccctcgtcgccaccaccgcgatggtcgaggcgcaagacaccctccgtcttcagcacgcaagctgggaggcggagctgaagagcaagctcgacgccgcccaaggggttctcgactccgccgctgcgcgagagcggcgggcaacggaagccgaagcggcgtcccggcggcgcgaggaggcccttgaggcccgtgccatggcgctggaagaacatgccggcgccgtggagaggggcttgatggaccgcgaggccaccactgctctccgggaggcgacgctggcggcgcacgaggccgcctgcgccgaggaggagtccgcgctccgccttcgcgaggatgcactcgccgagcgggagcgggctctcgaggaggccgaggccacgacgcgacggctggcggacagcctctccctccgcgaggcggcgcaagaggagcaggcgcgccgcaaccttgaaagcgtccgcgccgagagagccgcgctggagcagcgggttgctaacctcgaggcacgggagaaagagctggccgcgggggcgcgcatcggtggggcggctgcgggcgaaaagcgacttagccgctcgcctcgcggctgccgaacacaccgtcgctgacatgcagcgcgcgctggactcctccacgggggaggccgaggcccttcgcttggcgggcgagattgggcccggcatgctttggacgcggtctcccgcatgaagcgcgccggtcggcaagcaggcctctgggaaggccagacgacggtgccccccaccaatctggaaggcctcgctccgcacctcaacaggatggcttgggttctcgagcgactccccgaggagctcgagaagaccattaaggcatcctcgagggacctcgcccggggggcggtcgaactcgtgctggcgagttaccaggcccgggatcccaacttctccccatggatggcgctggaggagttccctcccgggaccgaggacgaggcgcgcgcgcgggtcggggatgctgctgaccacatcgtcaacggcttcgagggctcggcccctcggcttgcgttcgcccccagctccgacgaggaaggcgacaccagcagcgaggacggcggtggcgacgaggccggcgacccgggcgcatatgaatgagcccccaggcccccgccactcttatcttttttcttgttctttcttctaaggccttcatgcctcttttttgtacaattttaacttaatctgcaatgagaaatgatgaaaaatttttgtgttagttttattttgctatatatatgagttgaggatgatctgtgccatggtccttttgcgacttagcttggaataagggctcgcgcccaagtcccggtcctcgaatggctcgggtcggggctagtgcctggggagatccgcatgtcgagactggccaggccgggaacgtggtgaccgaggggtatgggtgacccgattgtgggtttttgccgattcccccccggagttcaccacgccccggggcacggctcggttctgggccccgtttggcgattttagccgaccgaaccgagcccccgagggcaaggttgagcacgagtgacattatttcaagtcaagattcttcaaaaggaaaaaacggcacagacacaacctttaggaaattgaaactgcttctattgaaatgctgaaaggaatatatatgcatgtgtggtagcccccggctaaccccgcacacccgagggggggtgcggggttagcccgagccaaaacctgacacccgaccccccccttcaggggtagaagcgacgaaggtgttcgatgttccatgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagctcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaaccccgccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccaataaaatccttgacgaaaggccttgccaaccagggtgcgcgaggcagaatgggctccgcactcgccctcatggatgtcagcaagaagctcaacgccttgttcctgaggaatgcacttcaggaggattccattagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggaacgctctcttcgggtcccgaggcctggactccgacgggcctcgggtgccggtcaggcgcatccgtctcccctaaggggtcgggtcgcgccgacggctgggtaagcctttcttcaaaggcgcctggtggggtctgggctcgcgaggacgcgagccttgagagttcatcggcaatcatattatcccgtctgggcacatgccgaagctctatcccgtcaaaatggcgctccatacgccgcacttggcgtacgtaggcgtccatctgtgggtcagagcaccggtactccttacagacctggttaacgactagctgggagtcgcctaataccaagaggcggcggatccccagtccagccgccactctgagtccggcaaggagtccctcgtactctgccatattgttagtcgctcgaaagtcgagacggaccaaatatctgaggacgtctccgttcggagaggtcaacgtgacccctgcaccggcgccctgaagagacagagaaccgtcgaattgcatcacccagtgggcggcgtgaggcagctgtgaggggttcgcgctggcctcgggcattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttccttgaggccatcagaatagcgtaaagcatcttctgggcctgtgggtatcgggtcttggcgtcccggagggcctcactaacaaagtagacaggccgctgcacctttcggcggggccgatcctcctcgttaggggccgtacccccggggcgttcttcgtccaagtggcccctcggggcgcactcgtcttctgcgctgatgacctcggggtcggaggatgacaggagcggccctcccacagtggcctcggggccgtcctgggggtcggggactcctggcatcgtcggacaagcgggcaaagggccaactccggtcgtcaggggcctctggcctccgttcggctcgggggcctcttctccctgctctttcccgggtcgagtcagcacagggttagcctcggggccaaagggctttaagtgcagccttccctcagtggcctcggggccttcctgagggtcgggggcacccagcgccgtttgacaagcgggtggagggccgactccggtcgtcgggggcctggggccaccgttcgactcgggggcctctcctccctgcctgctcccgggccaagtcggcacagagcgggggtgcgcagaatgaggattgtcctcatcgcgctccacaaccaacgctgcactaactacttggggggtcgccgctaagtaaagtagcagggactcatttggctccggggcgactagaaccggaggagagctaagatacgccttcaactgggcgagggcattttcagcttcctccgtccaagtgaacggccccgagcgcttgaggagcttaaacaagggtagcgccttctctcccagccttgatatgaaacgacttagggcggccatgcaaccggtgacgcattgcacgtccctaagtttgctgggggggcgcatccgctcgatagctcgaatcttctcggggttggcctcaatgcctcgggcagagaccaagaacccgagaagcttacccgcaggtacaccaaacacacacttatcggggttcagttttatgcgggcggagcggagattctcaaaagtttccgctagatctgaaagtaaggtctcttggttgcgcgtttttacaaccaagtcatcgacatacgcctcaacattacgtcctatttgactacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacgaatgaacccggcctccaaaagtctagccacctcctcgcggatgaaagcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaaaaccaccgatccgtgtggtcttggatgggccgtcgcccaaggcaacctccttgaccgggacctcgtcgcaagtggccatccgctgcctcggggcggtgggggcagaagggccaagcctctcgtcaccaccctcgggcttggacgcagcagcgaggcggtccgcgcgctgctcaatgcaagcaagcgcgactttaaggtcgccacggacagagatggggccaccggggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcaatgtgacctaatggccacgtgtgccccggcgtcacaccgatgatcggttgagacggctggagcaccatccccggggccttgatagcatcaaaggccgcgggggaaaggatgttgagagccgctcctccgtctatgaggacacgtcccaacttcacgttgcagatggtgggggaaaccaccatcgcaacctgccctccccgggcaatgcacggtgggtggtcagtctggtcgaaagtgagagcgacctccgaccaccgcgcccgacgcatcgcctcatgggtaggggccatggccagaagctctcgtttcatagccttgaagctccggcgagagacgtgagcacacgctcctccatcgacggtggcaatggtggccccaggttcttggaaacctaggtcatcatcaccatcatcgatgtcaacaacgggggccttctgcttggcctcacctcgccgtttgccggatggaaccaccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgccgggagttccggcctctttctttttgtcgctcgcaggcctcccctttcgggtggcccgcggagcgccctcgacggcgaggacatgaccctcgtcgccggaacggtccgacctcttcttcctcctcctatcacgccgccctgtatgagcggcggatccgggggcggccgaagctgccactccggaaccggaggagttccaggtccacgcttcctccttacgagccactcggtccgcgagctgaaaaagctccgcggtagtctggggctctttggaagcgatcttttcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccgtttttnttancaatgggngggggtggcantacaatcgaaagtcatgggcgct

SEQ ID NO: 6585 - DNA, 1023 bp, Oryza sativa
  unsure (1)..(1023): unsure at all n locations
cccgcgctccannncttgannnccctttnggaacccgtcgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtgaagattttaatgttactttaattactcaacagttttactgtttgctaaataaaatgttttacaaccgcctttatgcaaatagccacaaacccctccttgtatccccttgcacgtccgcatcgttggtgtggcttgatgagtacggtggttgtactcaagccttgctattattcccccttttcagaagtgtagtgcttctgagctgaagatggagttagaggaccaaggttcagaccccagttgagttttgcctgtggagtggagatgaagccccgctaggatggcctttttcagctgctgctgcttttgtttcggtgtgaggactaagtgcttcttttgtaagtattttatgctttatttacgtttggagctgtttattacttgtcgttttgtgtaccatggctggtcctggacagggatttaatacacaaaatagtttggaaatttggggtaaatttctgggagtaacacaccccccagcccgcaatgtggccgcacaagcaaaaaacaaaatgctgttngcattgtttngcaggggccnccgtcgcatcgggagccaggggatctntanantnnncngnnngtnnnngcannggctaacgtttaagtgcgtg

SEQ ID NO: 6586 - DNA, 701 bp, Oryza sativa
  unsure (1)..(701): unsure at all n locations
cgcgtgccctttgtttgactggnnnnnnnnnnnnnnnnnnnnnnnnnnnnnnnnnnnnnnnnnnnnnnnnncgacttcccgaggagcttgagaagaccattaaggcatcctctacggacctcgcccggagggcggtcgaactcggctggcgagttaccaggcccgggatcccaacttctccccatggatggcgctgtaggaggatcctcccgggaccgatgacaatgcgcgcgcgcgggtcggggatgctgctgaccacatcgtcaacggcttctagggctcgggccctctgcttgcgttcgaccacagctccgaccaggaaggcgacaccagcagcgaggacggtcttggcaacaaggccggcgacccgggcgcatattaatgagcccccaagcccccggcactcttatctattttcttgttctttcttctaaggccttcatgcctcttttttgtacaatgttaacttaatctgcaatgagaaatgatgaaaaaagcttgtgttagcattattctgctatatatatgaggtgaggatgaactgcgccatggtccttttgcgacttagcttggaataaaggctcgagcccaagtccccgtcctcgaatggctcgcgtcggtgctagtgactgatgagatccanctgtcgagactggcctggcaggcacgtcgtgaccctagggtatgggtgacccgattgt

SEQ ID NO: 6587 - DNA, 2510 bp, Oryza sativa
  unsure (1)..(2510): unsure at all n locations
gcgctgcatgannatcnnnnnnnnnnnnnnnnnnnnnnnnnnnnnnnnnnnnnnnnnnnnnnnnntcaatttataaaattccagtgataagaatgccctcaactgatgcatttgatgattttctagatcgctggatacaattatatatgtgtaccgtcaaggcaaaatttgaaatggttgttttgtaatctttactgatgaatcaggatggccaatttttaaataatgtgtacccaaaacatgaaatagaataatgttcattaaaagatagggtattctaatggaacacaagttagctatagattaagccatcttacttttgatcaatatgtgcaataatctctcctcctgggaaagccgcttttgttgcttcatatgaaactttaatggaatgcttccacataccgccaacgtcagccacatttttaccattcatctgcttcggttcctccattggcaaagaatacccagagagcaagtggcccacccatacaccatctttcctgaaacattttcaagatataacattgacgaaaatgctttcaaaaattgaagaaatatactcccttaaatcaatgctcttagatcctgctaagaaagttgtgtcataatcaatgaaagaaaatggcgcttacgttacaatatccatatgacgaggagcataatgaccacctcctatgcctagaaggactttttcaccattcctgcattacatgaaaatatagcagacttaatgcagctcaaattcatagcaaaaaccatcattataatagataaacagttcacttaaaaaaacatatacaagcaagatagtcaagagtacccatgctgggagcatgcttgggcgagtgattttatgtatagttctcaacagagagctgattttgattctaacagaaacaatctcaaagcgttcggtgtgtgcattatactatcaaaaaagtgccaaaaattagttcttttagcattaaacggtgatacattggtctcctaccttccagggaataatatcagttgtggtggattatcaaatatgctaattattggaaaatataacgagagttcttcgcatgtactaaaattatgcttactttccattggactagtatggaaatcgacattggactagatgtctatatctgagatcaatggcatgaaaagaatgaaagaaaaagaacaattgcttgtcttccatagcaaataagagctaagtgctcgagagacacacctattggtacaaacacggtctatttgccactcaggacaacagtttctaaagatgtttgatgtatgggggggttgtactgggtaaactccacctgatagttttcatagtaaagcacacgaaaatagagagggagagcaagagaggggatgcaaacatacccatgccaatttccaacagattcttcttctccaagaccaagtcctttccatagcagctgcaagtattataagactgagttccattgtgtttttcaccataaatacaatgtgttcacgaactcaaaatcacagaggacactaaggatcagaaatgcatgtcctttccttagcatcacaaagatgcaaaatgaacaataatatcaccataaagttggaaccaattccagatatctaaggaaaaagaacatgaaaatcatggtagaccatacaaacatctacattgtccacgcccagatgctgaaatggaacacaaacgggaaaactaaccagagcgactgcgtcagcagcatcctgtctaccccagtattcttcagtgcttcctacaacacacaagttaaagaaataaatttgttaaacgtatttggtgatcaatgtcacgtgggcatgcaaggaaaatatattgttaacaatagaaaaagtgataactcaaggttcatgatataatgagttaagtatcaatggttgaagtttatgtactattgctatatgtgcaatatcacctaaaattagttgtcatctgaattgtattttcacatatctttcgcaagtgcaccagatatatccttttatgtgcccaatcattcaaactgttatttacagatcaacattacttcttttgagagagaggacataataacttgtacttcaaacaatctgtgtgcttgaagaatcaatttgaagataattttctctttcgactattataaatatcatacttatttatattatttttattcaggaaactgctggatagcatttctaatatagtagattcaggaagagaaccattgacgtagttcatactttggggtgtcagaacaaagagcacctttcggccgtcagtataaaatccaagatctcgccctataattttaggattcaatacaacgttcatcaatgacggggtgcaggcattaactcccagcttatgcatcttacagataaactgtcctgtccagaaatgaatcaggggaacagaaaaaacaaagaataaacttaatgaccttannnnnnnnnnnnnnnnnnnnnnnnnnnnnnnnnnnagtagacnctaattggacacg

SEQ ID NO: 6588 - DNA, 6310 bp, Oryza sativa
  unsure (1)..(6310): unsure at all n locations
agcgtgcatgagatcggatgcctatggcnnnnnnnnnnnnnnnnnnnnnnnnnnnnnnnnnnnnnnnnnnnnnnnnnnnntaaaaatttaataattacatgacatccacatgccattagggcatataactttttgggttgactttttgccaaaaaaaaaaaaaactaaaagcctatgggagcaatgggatgaaccaatgtacctgcggggagagtaaggcgcagccgtagatggtctgccggcctgaccaacccctgcttcgacgtggtggatttgagatccagaggcgtttgtggcgggaagctgacaatggcactggcgacgccctgcagtagcaaagattcatgtgtgctgatgtattgggatatatattattgattagtgagaattagttaggatttctgagaatcataacgaagcaattatcatacaagtaattatcatagccatattatgatgagaatttatatagattgcataacaaaaacaaagtgtaagattcgtgtcgaagatctggcattaacaaataggggtcatcgctgacttaagtataaaataatttatctacaaccaattaaggaaatcaggatttcttatatttttatccaaactcatggtgttctccacaaatctaaagaggtaaaacttagatgtagcatattcagagaggctcaatgttttcatatgtgtttccgttggtgacctagtttagttttagactgtctaaaaatgaagatctaatcctggtcactgtcagggtatacacagatgtctgaaagcacaggttccatgatatgtaatctcctacaacaaagaaaatgatttactctgtaatataagaaaccaactttcagatactggttataatgggttgcatgcctgttcttccaagattacaagtttaaatttcagccaacaatgtgcggagatgatgtaaactcaatggcactacagcacttcattagcacctactgtttgttaattttgttaatactacaacaattcaaactcttagaaacggttatactgctttctgagcctatcttttttactgtctgaaatatggtgctggcctcatgagcaatgaaataggaaacatgcagtgcatatttatgttgaatccggaaatgttggcctcatgattaaagaagtaaaatagcagggctacgccacacacagacacactgtgaccatctaccttagaaacacaatcatgcatgatattccatccagacaatcttaattatatttgttgaatcttcaacccaattgagatcttatgaattatactgaatatatgttagaattgattggaaatttcaatataattaccacgcctcgacgaccgatctatattagccactatatgttcagaatttcacactttcaaactttcaaaccaaagtgagggatgtggtcatgggtgaaggtggcacaaacctgacagtactatgttgccctcgaagacctcactcatgttgctcccctcaaactcctcaacctcactgaatcctgcacataagaatgaacattgaacaaattatagagagggccatatagactgccagaacagtgatggaggacatcacttcaacatgtcagacgagtaacatgccagagcaggattaattatttcctttgatttctaattgatttctagcaggattaattgatctctaggtttggtaatgtgcaatcatatatatgagcacttgcataaattttcacatggactaaactcttattatcttttctgttaattagggaactctagtttgctctccacatgccatgtacgaggtaatactccatctaagtctacgtcaaaaggaagctatcgagggttcaggtcttggcaacttgctaaagattgacaacatacatattgaccgaaacttgtgcaatgagattgcaagaagctatgacaaggagaagaaagcattcaatattaatggtactttcgtaacgatgacactcgatgatgttgattgtttgcttggactgccatcaaaaagagatgacatatttgaggcaccaaaaatcaataaaccagaattgttcaacctgtaaaaaaggaaggccaaacaacaattactttacaagcattacgggaagcaataatcaactccttgagctacgatgaccacttcattcaaagatttattcttttctcaattggatccttcatatgtcctacaactcaaagatatgtgcgctcagaatatctcaatctcgtcgacgacgttgacaacatgagggaactaaactggtctagtctaacactaaatcagttactgaaaggcatattaaaatttagagagaagacaacaaacattgaggggaacgtatgcctcttacaggttcgtttcaaaattgagtttctttacaaaattgtcatgaacatattttcatagcaatactaattatcttatgtacaaatgctttgcagatttggtattgggaaaaagtgcgaatagataaattggctgcgacaatatatcattctggtcgtcaaaggccactaattcagtactgggacaaaaaaaaaaaagaatttcttacctttttggacaagggaaggtaactatctcatttttaatactatgtactaactatatcaactgtctgtaaaatctctaatacacctttttcactaaaaataggttgtcgacgacattacgggaactatacattgcaatgaaatccccgatgaaaaagcgcaggacaatgactcagaaacacgtagcaatgaagattttcaaggcacttctgaagaggtatatattatggggttttaatacgaactctatttaacaaaatatgtttgacatccttttctcacttgtgctattcaggtacactctataacatccactgaacaatcagccgacatcactttacaagaaaggttacaagaaagcatccaaactttacaagataatttcaacgatttcacaaaggatttttggccacgtatgcgatcattgatactagattgcatggaaaatgattcaaaatgcccagagcgaaaagatagtacgcatgtgtttgaggtaaagatcatatgctagactgttaatcattattacttacgtaacaccgctaaaaaaaaggttgacgctattgcaggatgttgaacaagaacaaattgatcccagggagcatgtatcaaatcataacgaagagtcctatataaatcaaaatgtaaacatgacttgtgaaacgaaggtaaactgaattttatttctctcactaacgttactacaacttatcataatactaacgtgcactttattacctaacaggacaatagtaactagagcaatcaaagcaggaagatgcttacaggtcctacaggaagaacatacaaaccaactaatcggactgacttcatctacgaaacaagaggtaaaaagaaggacataatcaaaacccaagcacagacaaagaaaacaataggtactatgctatttcatagttgcatatgctcatgtcaatggtactaactttactccttttcaagcgcaaacgaataaagaagcttacatgccagacacaggcgaattacggggtgaaaagaagaggaaacaagacaaccaaacactgaatgaaatatccgaatgtatgaactctctacatcatccataattttttacttatattctatgtttgtgtgttactgatttgacttacccttttctagtgtacatagagaaggaatatcttacgcaaaaaaacatagacaacggaccaccaaagaacgccttacgaggtcaaaagaagaaaaaaaaacgaatggccaaacaatgttaaaaaattcagaaggtaatgactaaccatttaacatttctatagatctattactaatttgtccaaccttcgtagagttgactaaaaaagaagacccgttcattacctacattaataacacggaggataacaaagtgatggtgcatattgaagaagtggaggttaaacggataagaatgaaagtactaacacaaccagaattcttgaatgatgatgtaagttcgcctatttaacaagcctactattcttttataactatatttgttatataactgaactaacctcaaattcaggtcatggatgcatacatcctatgcctccgctataaagagaaaggaatcaggggagatggcaaggccttcctagagatggccatgaaaacaggtctactaaatgtagagggagcgcatgtcgaagcaagcaaacctcgagataaacgatggattagagatatggcacgcgactatctagcatttgacatggtaatacttattcaagctatctatgtaatggctaattcaatttatgactctatctatgtaatggctaattcaatttatgactctatcttagtgttgaacaatgaacatatgcagattttcctcccaattaatattaaagatacacactggtacctagccgttcttaacgccaagcgatgtgaggtgcaaatactagattcgctcgcaaagccaatcagtaaagatcgacctgatctaaggcgtgtggtaagcaatacacttccacttgtataattcaaattggttttgctatgttttaaccgtaccaacgttgcacaaaactttccagctgctagctattgagaggggattacacgggacagagaatcagcacccacagttaaaacacgattggcctgatttcaatattaccgaatgggagtacaacaaagtccaaaacttgccaaagcaaggagacgggtgggtgactcaaactcttccacatgatattcacattattcaattacgcaaacatgttagcctaacgactaaattcttgtagcttctcgtgtggcctgtacacccttaagttcatggagcattggagcggatcttatctcccagaaattcaactacaggcaactacaacaacctctattcatattttgcaccagtgcttcccaatacaaaaaaccatttaaaatgcactccctttgcattatgcagaaggaagtgaaaacatttcgacaggacttagccggaattttgatcaactccgaactgaacaacattaaagatcgtccactgctaccaaccacgacataaatggattatctgtcaaacatttaccacaattaccttactatgctctcttacccttattaaataatttagatactacttgggtatttgatggatcccaaacattgatgcctttttgagataatattcataattcatatttcaatccatttgagaaggagcggtatatgaaaccttacgcttcgggatgactcagcgcagtcagctatcgacgtcaccgacgtgcgtatgctacaatgtcgcacctgaacaccgataaccccttcgccggcatacggatccccttcgcgcatgccaccgtcttgcaaactgaccctgctcccaaccattcaatcaaataatcaatatacaatacaatggattcaagaacaaacaacctttatctgcaaaatcataacagtagtggttggtatattaagatgctgcttaggtgagcactataatgaaggctgaagcaacagagtaaatgagtaatctcgcattagaagatgatactctttaccaacttctcttcgttgtctttctgataccgtataactgaatattggtaagaaaagtatggtaagattggaggattcagaatgtacctgaagctcggctgtctcctctcgattcctcgcatagtatctgaacactaaagatggaaaattgtaaattaaccaaaaaaaactgcaattcaagacaatagaattggtgaattgtgattaatatgacacagttagtagtactcctattaactaatagagtatcgcttacactgggttaaatcggttgccaagggcatgttcacacttcagagaagggggcggctaggtcgatggcgacagaggtggagtggagaagggtgcgtcggtccatggggaggagaacgtggcggtggtggcgcggggaggcgacgcggcgaagaggactcatcgcgcgccggcggaggcgggtggaggggcggctacgtcacgcgactcgctagacaagagggcgggggaggaggacagcgacggtgggggctcacaagccggcgcggagacgcgggcggaggcgaaagcggcgagggcgacaaggaagggcttcgacggagggaagccgtcaatatcgggggaggcggacgtcgacagaagggcgcttgnncgtgaaaaagcggccaagaaaggcaagtgcngccagggaacanaaaaggcaaccgcgcctggagggggaagagacgcccagaacaggcaagn

SEQ ID NO: 6589 - DNA, 3856 bp, Oryza sativa
  unsure (1)..(3856): unsure at all n locations
cgtgtncattggactgcacatcgnnnnnnnnnnnnnnnnnnnnnnnnnnnnnnnnnnnnnnnnncacgggcgccgacgtcacgttcgtcgtccgcggggagcggttccgcgcgcaccgttgcgtgctcgccgcgcgttcgcccgtgttgctggcggagctccacgggccggcggcgcgcgccatgggggagacacaggacaccgacgatgccaccaccaccatcaccatcgatgacatggagcccgacgcgttcgccgccatgctgcgcttcgcctacgacgataccctgccggagctgcccgggaacagcgagagggacgccaccggcgtgcacatggcgcagcacctgctcgccgcggcggacctgtacaggatggacgcgctgagccaggcgtgccaggacaggctggcccggtgcgtcacgccggccacggcggccgacacgtacgcgctggccgacaggctcggcctccggctgctcaaggcggccgtcgtccgggacgtcgccgccaccggcgcgcgcggcatcgaggccgtcaagaacagcgaggggttccggcggctcgcggcggccgacgcggcgaccgcagaggagatggtgaggaaggtgatggccgccgcgtcggcgcatgtcaagagggaggaggtgtccacggtgagctccatggagatgatcttggggtcccttggtgtggccgtgttcgctgggattgctttggctgcacttaattttgggccattcagaccaataaaatgaaggaaagattgtcgatttttcatatcccttctttttattaagctactaattaagcacctaaaacataacatgcaagcattgtatttattcgtactcctaaaacctacatgcaagcatgctacattaacccattaagcacacaaaactcaatatgcaagcatatagtaattatatctacaatctattttattataaaactaaacatacacatgctaattcattattgacaaatcattttcataatatttcaaactaaatcatttcatcatttctccaatatctaacatatatcccgcagaaaagcacgaggatcatctagtatatatgtatggagttaggatatatgatccgcgggcatcatatagtatatatgtatggagttgggatgatccaataaacaattgtttgtgttttcgaatgaacagtagaaatttttgtagaggtggagggatttgaatggcaaatttggagtgtgaatttgggaacacgattttcattcgagaaacgattgatctgacgttgcaattggattttaaggcctgatttttttattgcttatatttgaatagaggactactccctctgttccaaaaaaaaggcaaaccatgggtttctgtgtccaactttgactgtccgtcttatatgattttttttataattcgtattttcattgctgttagatgataaaacatgattaatattttatgcgtgacttgtctttttaattttttttataattttttcaaataagacggacagtcaaacgtttggcacggaaactagggtttgtcttttttttggatggagggagtagaagcttaggctgtgtatagatataggggtgaatgaaaagttttggcgtgtcacatcggatatacggacacatttgaagtattaaacgtagactaataacaaaacaaattatagattacgcctgtaaaccgcgagacgaatttattaagcctaattaatctgtcattagcaaatgtttactgtagcaccacattgtcaaatcatggagcaattaggcttaaaagattcatctcgcaatttacacgcaatctgtgtaattagttattttttcgtttatatttaatactccatgcatgtgtccaaacattcgatgtggcaggttgaaaacttttgctaggggatctaaagaggcccttagaatgaagattcaagatttggtttgaaaagtttaattccttctttttaatgattggttgatactgaaccataaaaatttgtgttacatagtctagtatgaatgtcttttcagaatcaccaaaaataggtttgctacaattctgctgaggcgagggataaatttctagacatcacaaaatttctaattaagcttccgtgtgcgccttcagttttttttttcaccataggtctttcctttagagaagtgcaagggacgtgctcatgttcactagcattaatccgttcgtttccactaaaaaggttaataaaattttggatatttgtggcacgctttttaaattgctaaacggtgcgttttgtacgaaaactttctatataaatgttgctctgaaatatcagattaatctattttttaagtttgtaatgattaaaactgaattaatcatacgttaataccacctcgttttgcgtcaaacacttaatcttcatttttatctttatgttcaggagaaaaagagcacctccagatattcttcatctttgttttagaaccaaaattgtgcataagcacacatttatgaatttgtacaaattcctattccaaccgcaaacatgaaaagcaatgtccaagatcaaaatgagggcaacaaaatcgtgacaaaccaagcgcatttcagcacaaaattgatcattcttgccagttgccagtgcaacagaaacaatagcagcattatattcgctagaattgatatggatccaagtttcttatcaagcacataacgacaggagaataatttaggtctaatcatcaattccatccgtttcaggttacaagacattttgactttggtcaaagttaaactgctttaagtttgaccaagtttgtaaaaaaaatagtaactttttcaacccaaaataaatttattatgaaaatgtattcaattattgatttgatgaaactaatttagtattataaatattactatatttatctataaacttagttaaacttaaaacagtttaactttgataaaagttaaaacgtcttgtattctcaaaccagaggagtaataagtatcttttggaggggttgggaacggaaccagatcgatctacgtcaaagggacgtccaacgcgcgcgcgccgttcattttctatcgaatggtgccgagagagcggagagaacctagcctcgctttcggtccactgtaatagaatcggtccactaacaggtaagcgagaaatagctgagaacgctgcagcagcagttggaaaaagtacacccaagatccatcaacttgttatcaagttacaaaatcgtccctcgaccgcaaaaacagatatatgacatcccttaacttacaaaaccatttacttttaagtctctcggtggttttgaatccggttttatccaccgtgacgattgaatcagtgtgggccccacatgtcagatgccacatcatcacccctctcttcctcctctctctcacttctctcctcagtcatggcgggcggcccgacgctgccgcggccggggctagtagcccagcggcgaggaggaggaagcggcgacggcgccgccactgcaagggatctcaccgtgagttcgtgtgggaggagaaggggcgcagcgaagaggcggaggaagagctccttcatggacagcggcagggagagctcaccgtcggcgaggcacgggaggtcgcggggaaggaagcgggacctgacggcgtcggagtcggcggcggcgcggaagtcacggcagaccacggcgaggtgagggagagcaccgccacgaggagctcctccggaaggcgcgcgatctcgcaagcggacgccttcttctcctccatggatcctgcgatggcggctggggaactgacgtcgtgcgggccattctgtccgcgggcttccctcggcgggcggcg

SEQ ID NO: 6590 - DNA, 21541 bp, Oryza sativa
  unsure (1)..(21541): unsure at all n locations
cgcggttanaaactgaatatccactatnnnnnnnnnnnnnnnnnnnnnnnnnnnnnnnnnnnnagcgacggcgagccgggaaaagtcagagagagagagaggggaggggagagaaaaggggggagagatgacgtggcatcctaacatgtggggcccacgttgactcagccgccacgtcggataaaaccataatcaaaaccacaaaaggacctattgtgaccgattttaattagttgagggatgtcggatatctggttttacgatttgaggatgttttttaactcgatgacaagttcggggaccttcggtgtacttttttccgcagcagtttcaccggccggtcgagggccgcagcggtggctctcctatatgacgctgacgccgaatcccgagcagtttcacaaggtgctcttgatatgccagcatggcccatggctgcaacctcaaccttgtcagtcgcctccggcaagtcgatcggcaaccaggtctacaacgtcgagtggaccaatagcacctcgtactacttcaactcgacctcctgccccgccacccatcagcatcctgccactcgagcacatgactgcctggccgatggtcgactgtcacgtctcgactcaaatcccacgagtcttgcatcattgcatcattatgtcaagtctgatattcttctcaagggaaattgaagtagtcaagtttctgcagtgattactatcctgacccaacaatgtgctttaatttcctattgaacaaatgcagtgatgcagtccaaaatttcttcactggttcagtaacttaatacagctctgccatgacttgtgtctttcgatctgtttcccagagatgcatgcagcagcatgcatgcgacgagcttatttgagttggatggtgttctaacttctaagtgtggcaggcgccggctcactgcttcactaatgagaatagtaaacatagcgtgaaactgctcgggccacgtagtcagcgccggacgtgggtgccgccgccgacgaaattaagccaccgccgcgtcctcggatggcggtgtgaggattttggcaggaaacaatcgtacgtttcagtgcgttgcttacgcgctaatatatggtgagaatagccctcactgtggcgattacagaagtccacgagatcggcaacaaccgcgccaactcgggagagaaaccagtatgcgataacaaatgtaaaggaagagataaaatctaatcatatcttattacaactaaaccgatcattatcgcatgcatggagatagaaatagactcaactaacaccctctctcaatcataaccttgctaggttaagattggctttaaacttctcggttaggttaagattggctttaaacttctccagaagattagttgacaatggtttagtaaatccattagcaacttgatcaccggaagaaacaaaatcaatttccaacaatttctgacttaccctttctctgacaaagtgatagtcaacctctatgtgctttgttcttgcatgaaacactggattaacagataaatattttgcaccaagattgtcacaccaaattttacctgcacggggacttttaatccctaactcagcaagcagtctgcacccacataatttctgctattgcattagctatcgccttatactcagactcagtactagaccttgacactgtggtttgtttcctagcattccatgacactagctagatttgagccaataaatatagcaaacccacctgttgaccttctgtcatctatactgccagcccaatctgcatcagaaaatccactgaccaatgtagaccctgacttatgtatattcaagcccatcttagtacattgttttatatatctcaggattcttttaacagctgcccaatgtactgttgtgggggtatgaaggaactgacaggttttgttaacagagaaggctatatcaggtctagtgagttaaatattgcaaagcaccaactatacttctatattgtgtagcattatttggacccaaaggagacccttcatgaacagacattttttcacttactgacaaaggagtagctgctggtttgcaatttatcatgcctactttctttagtaaatcagtagcatacttatcttgtgtcaaaataataccattatgtatcttgcttacctcaataccaagaaaagtagtgtagttctccaggatctttcaaggcaaaatatgtctttagatcctgaagtaaagctgcagttgccctctctgatgaactggctacaattatatcatcaatataaacaagaacaaagatagtgaactcccatttattcaggaagaacaaggaagtgtctgcctttggttcactgaacccaagttcaatcaatttctgactcagtctagcaaaccaggctcttggggcttgttttagtccatacaaagatttatcaagtttgcatatatagtgtggtttggtgacatcctcaaaccctggaggttgttgcatatacacctcctcttctaaatacccatgaagaaacgcattctgaacatccagttgtctaagactccatcctctagacacggcatattatcctaattgtggctgcttttatgtcacgcccagaaatttagcccaaatttccagactattttgtgtattaaatccctgtccaggaccagccagggtacacaaaacgacaagtaataaacagctccaaacgtaaataaagcataaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcggacgtgcaaggggatacaaggaggggtttgtggctatttgcataaaggcggttgtaaaacattttatttagcaaacagtaaaactgttgagtaattaaagtaacattaaaatctccactgatcaacgctacaccacgttgaacaggcccaaccaacccacctgtactacagtgcattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggtaagcactgtaagtcttccagggtttcccgtgaaccggtccttaattgccatgggtgcgactcacaaaaccatgcacccacagcccaccattcagtcgcattttagttggataattatgaccatgtaacatggccagatgtctcgagcacgcggctcaacaagatactagaatgtctaatactgcaattatcccatcgactgagctagtggtaattaagcatggctaagcatatagttctagctaggtcacataagtaacacgagctagtcaatttatcacccaagtttgacaaaggatagatatcaagtaaacatggcacaagcgagcagataggaaaaccctgatcccatgtaattagcaaaacatgcatatttatttgtaaacggtaaaacatttataaattgggatcaacatgctcaaggagaatgtgtgacttgccttgcttcttcactttgatcttccgaactcttttcctcgcgaccgcggacttccgaaacgacggaaactacacgctggcacgcaaaacgaggaaaaactctaataaaaaccaaggaaacagtacataaaaagtaaacaaacatgtagagcttaattttagatgaattttgcaatttgaatggctcaattcggagttcgaatgaattagatatgaattttagaagttttgagccatttaaatggatttctataattaaactcgatttattgcgcaattattaaatattttctcaaaggaaatgttattcgctgacgtcagcaaggggcgccggcgccgacaggcgggcccaacacgtcagcgggtcaaggaggtgcgggcttggaccgggtccaccaaaagagcgggccccacgcgtcagcgggcaaaaggatctagcccaccgtggaccgagtccacggtagaggtgcaaggcggaggggagggttggctcgccgaccaacccgaccagacggcggcgcgcggccggatgaccaccggcggcgacacaggcggcgacgcggcgcggcgcgacggcgacacgcatgcggcggccggcgggcaaagagagaaaaagaaagggaggggaggaggagggagatgctcaccgacgcgggaaggacgacgacgacaatggtgatggcggcgtcggcccgacgagcgagggggcgaccggggagcggcgaaaacgagcggagtaggcgaaaagggaggcggcggagctcaccgaggggcatgccggcgaaggagtcggctgatggggctcgagcaaagggaggcggcagcatcccacggggcgaagacggcggcggtgattcgccggtctccaacgaaggtggaagagcggccggggtaccacgcgatgcagcgaagccgacggtggcagggcgcggcttgacggcggctggagctcgtcggtgagtggtggagagagggagcacggtggggaggtggttccggcgatgaaatgggaaaacggagcgggggccgaggtgcggcaaggcacggcgaagccggtggtgcaagcggcgaggtgcggcgacggctaacgcggcggcagcggccggctgaaggcggtgtgtggcggtagtggctcggcctcgcgatgggaaggtggttccggcggtggaggagggagatggagtggatgccggggtgcggcgaggcactgtgatgctataggtggcggcggcgcagcgcggcagcgacgggagcggcggtggcgggcggctggagatcgccggcgagcggcggcgaaggggatcggcgtggagagctcggtagagggcgtggggtactcgggaaaacggggaaaaaggaagaggagtccacggggattgattttatagctcaagggggcgaggagagggccggggagcggcggatttcgaggggaagtggggcggcgtcgtgggggagagagagacgcgggaggcggcgacgtggccggattttgcggggagagtggggggaaacggcgcggacgtgggcggcgaggtcccacggacaagcgcgcgcgcggggggtggaggaggtgggcggaaacggcggcgacgttggacggctcgggcggccatggcggttgctggcccgagctggaggttgggggtgaccccgacaggtggggcccacctgtcggcggctcgggaagaggaggaggatgaaggaagccaaacggacttgcgcgaggagggggcaagccgggccgacggcccaaagagaagggaggaggggaaaaggagggccgctgggccccagaggattgagagggagaagatcttgggccgaaagcggcccaagacaaagaggggaaaattttatttgttttctttttattttaattgatgcaatgatctttgtgctattaaaactatttctcgagctccgaaaattcacggaaaattccggagagtacattagggcacaaagaatattgcaaaatattcccggccaatgatttttaagggaaaattttaattctcccattatttcacttgattaaattgatttaacttttatttaatttctagaaaatgcattatttaatgatttttaatcccgaacgaaaatcggggcgttacattttactaccggactaaaggtatcctcataatgtataccatacctttgtttgaatcccttagctactagacgagctttgtatctatctagtgaaccgtcagcctttcttttaattttatacacccatttgcaccccgatgacattgttcctctctgaggtggaactaggtgccaagtgttattcttaactaatgcttcatattctgcatccatggctaatctccagtttttatcctttagagcctctagatgatcactaggttcacctgaactagtaaagcaggaatatttaattgtgccatcggtatataccttttccttgcaaatgccgctttgtagccttgttctgggatggacctgttgtggttcctgaatctccaactgttgaaaatgaggcagtatagtgtcggcatcgggattaatacctgtgacatcaagatcgtcagtatcaatgtcattggtgtcaggtgtttcaatatctgttgcaggactgcccgacgtcccatcacccgtcgctgtgcctgactgctgcccccttgtctcccgatgcgacggtgacccctgcaaaacaatgcgatcagcagcaggcgaatgctggtgtggcgacatggcagtactggactggcggacaggagacgcgtcaggcgtgcgcgcaggggagcgatgcacagatctgtcagggcgggcgcagggatcatcatgggagtcagcgccagttggatcttctgtggccgtttgatctgttgcagcatcttgaggcaaattgtgagacatattaggcagattagcaagtggattagcccatgaatggaattcctgttcatccccactaataatattaggtgccaagagagataattcagactgaaaacgagctcctgcattagcatcgagttcggagaagggaaacaccgtttcgtcaaagacaacgtcacgggaaatatatacacggcctgaggatatatcaagacacttgaaacctttgtgcatgttgctaaaaccgagaaaggcgcatctagtagagcggaattgcaacttgtgtttattatagggacgaaggttttgccaacatgcacaaccaaaaatccgtagggccgaataatctggtttttgatgaaataatttttccaagggggtagtattaactctgctagggactcgattaattagataggtggctgcctgaaaggcttcatcccaaaatttcaatggcatagaggcatgagatagtaaggagagacctacctcaactatgtgtctatgttttctttcagcagacccattttgttggtgtgtgtgaggacatgacacatgatgaactatgccaattttcgaaaaaaaaagaatttagggtttggtactcccgtccccagtcagtttgcatggctagaattttcttgtcaaacagccgttctaccataacctgaaactcctgaaacttttcaaagacttgagacttatgctgtagcatatagatccaagtaaatttactaaaatcatcaatgaaactaacatagtacttctttctccctagagactctggagcaggaccccatacattagagaagacaagctctagggggtgttgggagacactagatgaaacaggaaatggtaactgatgactctttgcttgctgacaagcattacaaactgactcatttgacacatctaaacatgggagattatttttattgaccacctgtctaaccactgacgaggagggatgacctagacgactgtgccatcgatggaaggagatcttggtggcattgcaagcatacttcaaggatggcttgggaaggggatagagcctgcaatgtgatcttcctttaaggagcgttttcttggtggctagatccttaagacaaaaaataatcacgatgtagttcaagaaatgcagagttatcctcaactagacgatgaatagatataagatttttctgagcttgaggaacatatagcacatttttaagatgaatgttgtgactattaggggtatgaacaacagtattgccaacatggcttatatccatacctgctccgctggcggtgtgaatctgctcattcccattgtacttgtctttcaccgtgagtttttccaactcaccggtgatgtgatctgtagcgccggtgtcgatgtaccagttggtgtcgatgccatgggaggagctcgccgccgcagctgctgcaacatgtttgttatcaggaacatagtcttcatcatacctataccagcaatctgtggcagtgtggcctcgcttgaagcagacttggcatgttggtcggcgatctgcagctcctggtgctcgtccacgcccgcgacctccggcattgttgccgcgcccgcaaccgcctaggggagcacctccgctgctgccgcggctgaagttgccgccaccgcaacctcctccattgccgccacctccacggcttgcaaagttgacgacgttctcctgggttcctcggtagagtgccatgcgaccctcgaagttaacaatctgagagtataattctcccatggtcattggttcggggcgcgcactcattgctgagatgacctcgctgtagccctcgccaaggccggcaatgatgtgcatgatcatctcttcttcttcaacaggtcgcccggtgcttgccgccatctcgtcaccaagcgccatcatatttcccttcttggtgttggtgagcgcatagtacgtgttgatcgctcgcgctctggtgtgggtggagtacatctaatcaattgttgtccatgcttcagccgccgttgtgcaccttgcgacttgcatgagcacatctcttgaaagagatgtgaggaggaagcctaggacttgttgatccacggcttcccaatcttcaaatgccggattcgccttcttctccgtcttgccatcaactgtgacggcgatctcggcgtctagcttctttcctgcgccagtcaggttcccctgtagacgcgcgccgtgaattgcagcatagacctgcaccttccaaagtgcatggttggtttttccaagcttctcactcaccaagcttccctggagaggattggcgctactggtggtgtaggaggaggacgccatcgagtaacatcgctagattagattggatcaggctctgataccatgtgaggattttggcaggaaacaatcgcatgtttcgatcagtgcgttgcttacgcgttaatatatggtgagaatagccctcaccgtggcgattaaagaagtccacgagatcggcaacaaccgcgccaactcgggagagaaaccagcatgtgataacaaatataaaggaagagataatatctaatcctatcttatcacaactaaactgatcattatcacatgcatggagatagaaacagactcaactaatcaactaacaggcggtggggctgcggctgtgagatgcagaagcattagcggcgtcgccgattcctccggtttagcaggctgattttattggagtgggccgaaagtgaggctgtctcgcttcactctgtactctctgctcgcttggcacctttagatagcaaatgaacggcgggcgtgcgttgtatgtccctctggcgtagatcgctctatgtcagacgatctggttccgtcgggaacccctcccctccgcatgcaaaatggaccaatagattaacacatgattaattaagtattaactataaaaaataaaaattagattaatatgattttttaaagtaacttttctatataaaccttttgcaaaacatataccgtttagtaatttaaaaagcgtgcatgtggaaaatgaagaagatgagttgagaacttatggtcgcatcttctttggtcatctaatctacaatgaatctggacgaagggttgtctagattcgttgtattaggagtggtcacaggttgccttattttgggacggagggagtactcctaagttaagtatttatttttattatgtagtattagcacgttagattggttaatgtatgatttcgtgatactctaggctgtaagcctctaccacaatatctggtgtaacataacacgtgtgatttgtgcaacttcaaccgtaccagtcaagctttcctaaaatttacttcaaaaatgtcaggtataagtttccaaggcgctcatcagattacaataatcatccacatttttgtcctctgctacctcttccacttcatgttatcatcctcattttccccaaaagaaatacaaacacaatgtgttacagatatgattttcacaggtaaggtccatgcttcccttgaccctattccacgacctagtatctagtgacctttgtccttagtaaaacggctttagtttcccttgtacttttcctctccattttgtattctttaatgatataatggtatccagtttaattgatctccatatcatgaaaggccagtcaagccatcaacctccatgcctctatcatcagtggtgcattcactggggaagccagcatctaagcatgaggggagcaacttgacaagtgatcataacaattagaaaatatagtaaaaaatatcaaattttaaggcttcccaaaggtaatatatcgtatatcaacataaaaaaacattatcataagaatgataatttatcatccttcagaaggtagtaggaggtatcacattttctagtgtaaaacttattatctacaagtaagtactaggtaactcgaggtagcaaaattttactataaaaaaataggtaccttctcaaggacctatttttttagatttactgttcactttcagcaatacgggttctagggagacatatcacaagtgatgataatattatctgagttaaatgtctagataaatagataaacaatcagataaaaaaaactagatcaaggcaaatgagcaacatccaggcaaatgagcaacaatatatccatcttgcaagtattgactaataatttagaaagagtaaaatacaaggccggtccttaaagttggagcgaagtgtcacttaggtccacaattttgaaaaatcgacattatgctccatgatcttgtttaagtgactcgttgaggtccaaaggacctctgaccgggttgactgtcttacgtggcggtccagcgtggaaacatatttgtattttgcacccctccccctctttgctttcccgtgtccgatccaatcacttcttcgtgtggtgcacacaggaacgcgtgaccgggttgacaggcttacgtggcggtccagcacgcgcacctgcgggactcacctcatctccaccacgccgcgcctcgtacccctccggcagccactcgctggcgttgcgtagcgcctagaggaatcgagctcgcggacggtacccgatgtaatcggcgcctctgtcccgagcgcgacgtagacgaccgacctcgctagctgcttgtcgagccaccgcatcatgtccgagcggtcgcggtcgtcgccagtgtcgggcggcagcaagatgccagcgggcacgacgggcttgtggtagagctcgttaaggaggctgcagagctgggtgccctcgacatcggggcagctgcagtagacgatgaggtggcaccgctgaggcgttaagctggtaggcagcggcaaacggcgcagcgaggccgtcggcgaggaagacggcgaatggcgcagcgaggccatcgaacgccatcttgaggagctctaccttctccggtgggacatcggccgtcgactcggcgcactccggcaaggcagcaagccatcaacggccacactaaggccgtggacgtcaccgtgccaggcggcggcgcgcacaccggtggatgtcgtcccagctgcggctggatctagcgccagcgactaggcggagctcggcatccatcactccggcggcgaggcatcgccccgcgaatctgccgccgacgacccgcaggaagggagaccggcaaatctggccatcggtgaggcgcggcgccaccggcacactagctgcaaagacgctgtccgtggcggcggcggcaaattggagagacggtggatggagttgtagcaggagtaggatgcctacaagactaccaccaccacccgctgcctgatgctcgctcgcccacaatggtcatggcgacggtgcttcgcaagctcttctctgactccctccgttgcccgccaactgctgtcgtgttcgcccatcgccgccctcgcccaccattgttccatccgtcgcccgcctaccgatgctgcgctcacccgccgccggcgtcccaggcccgctactgcgctctcccgccgtccgctccccccgcagcccaccgccatgcttgcccaccgccgctccacccactgcccgccgacggtaccgtgctcgtctgccgccggcctcccaggcccgccggtgctcccgttggattggatgcggggaggagggaccgaaatgcaaatatgttaccactctggtccgccatgtaagccagtcaacccggtcagatgacctttggacctcaatgagtcacttaaacaagatcacagatcctaattttgatttttcaagatcatggacctaagtgacacctcgctccaactttaaggattggccgtgtattttactcatttagaaattatgtagaggtacattacagcatggaaggtttagttcatggttgaacagtataccatagccatatcaaattttacacttgacattctgggcctgtttagcaagcctgctacggcaactgcgccgcgtgcgtgcggcactgttggtgccggctgcgccacagccgcgaaccagcagctgaacatggccactaggtgataaaaagatgattattatgtgaaaaagagaagagggggtgggggtggggaagggttgttattggcctggggaggcctgggttcctccagatcccctggcttcgcctctgctgcattgggtacgaagagaacatcctgagacttttttttgacgggaaacagcaggagaggctcctactgcgctatattaaatatatataaaaagaaggttacaatatttacaaataacatcctgagacttcttggttcgtccaaatcatgaggggtttctaatagccgcacgtgagtcatatgacccataagcataaagaatgaatgcatgatgaccgcatataatatcatgactgattagattagagagagaaattctcagggccatctccagaaatctggggcccctaaataaaatgataattggggccgtaaattttggaaatttcatatatctaatatcatataaacatggcatacttttagtcaactatataactttaatattagcatccatcatgaaaagaacaattgatggcatcggcaatattagcatcattaccttcatcggcaatattaccatcatgagtttcatgaccttcttcggcaatgttagcagcatgaccttcatcggcaatattatcgacatcaccttcatcaatatttgcctatactgcatcaccttgggcaacattaacctcgacctcttctacatcaccaccatgaccgtcagcaacagtagcatcctgagtttctcttacaacaaagctatcaaaagcacccttttgagattctgcttcatctagtcagtgaatcatattttctattgctggaagacatgatgaggaattgaagcaattgaggaaacaaaaacttccttttataaacaaaagaaaagacatatcacatatgtatttgattcaataatcaatccaaccaatcaatcattcaagaatcaaaatacttttacagactaataacagagatgagatgacagtctagttcgtcaaattacttgatgatgcagagatgaatagatgatccaggcaggccccagccggcagctgctagctcggcagcggcacttgcctcggcgtggtcactgcctcaccgctggtcacgcccttgcggcctcagcctcgccctcgtcctcgctgaatttttggaaatttccaaaagttcctttctgaatttccaaaattgatatgaccaacaaatttgctctctggtgatttcggaatttttagaaaatcacagtagaaatttccgaaagtttatttatctggtgatttttggatttcttttcgaaaatattttcagaatttccaacatgctaatttgcccagttttctactatgctcatgctgaattttttacactttttggaaacttgcgaaaacactatagcaacttctgaaaatcacggtagaaatttctgaaagttaattttgctctctggtgattttcgggcagatatgagggtgtggccaaaaataggccccatccctagggatggcaacgagtcaggtcaggcacgggcagagcaaatccatacccagcccgagacccatgtgcccatgcacgacccacacccgtaaagtctatcgggcaaaaccccgtgaccgtgcccatgcctgtcaaccacaggcatgcccaacgagtacccactgtgcccgtgagccgttgcctcatgcccaccgctgcgactcacgagcgtactctcctccaaccttcatcccacttcctcctcgcctcgccatctccgcgtcgcggtccagatccctccggcgagcaccgcatccatgcactgcctccacgcggggagcctcgtatacgggcggcagcaacacgggctcctcctcaatggtagcttgttcccgtccctccaccgctcctcctccacctccgtcgctggtcatggcatcgcagagcaccacagcggctgcatgtgacgaggacgaggatgatgactatgccaattccgccttcccgcatcagtgccactgccggcctccgctgtgggtatgggggtaggagaggggaatggggaattaggttagggtttattagttgagtatatatgtgtccctagttaacgagccaaatgagccaagagaaagggtgtgagaattaagagatggctaggtaggcaaaaattagctaatacataggtaccgggtcgggcatgagttacctacgggtaaaaaataatactcgacaactgtctgctacgttctcaggtctcgagtgggcgtggccacgggcaaaatattacacccatgcccgtgcccatcgggccatgtatccacagatacccgtggatacccagacccgtgggtaaaattgccgtccctaccctccaacctcaagctagttggctccattgcttatcttgtgttgatttgagattcactttgagtcttgctttctcacttcttcctctccaccgatctataagcttggatttcatgtgtttgtgagagtggttgatttgagtttattttagtgcttggtgttgacttcgtgaagatcttttgagcactcaattcatctccaagaaatctttgttgcatttgttactcttggtagttgaggacacctagacgactaggggtcaacctcgagacaccaatttgtttgtggtgtgccaaggaagtttgtgaaaggtacgatctcacctccgaatgggaagagatacctttagtggaaggaggagtacatttgtgcaacctcacaaggatagggttggaaaagacctggctcattatgagctcctcaacggagagtagaatcccctcaagtatttgaacttcgggagcatatcgtcttacaagaatcctggtgatatatctcgcgcactcatctatcttagctaattgatgatgctgctagtagtttacttgttgtttgtgcaatcatttccttacttgtaccactacacttttttgcttgctttactagcttgctcgtaaatctgagattttcagaatatccaaaaataatatggaaatatccgaaaatagtttggaatatccaaaaagtctagcttcctcatttacgtaaaagctttaaacgcctattcaccactcttaggtgacatcaaggttctttcaacctacaatgctatatcgatattacatatggttatggactttgggtgatcatttctccatgaatcatcgttgagatctaagtatttgtagcacataacgagcatgatcaattccaaactttcccaactagtgaattgccataaaagaactaactagaggctagattgttacgaacaacaattcatggctccagcaatgactaccaaatgagaataaaaagttaatatggttcactaaaagaacatatggccatatacaacacatatactaaatgtaatatccataggcggaacaattatcccttacaacttgatatggattagagttagaggtctatgataaccatgtatcaaaatgacaaaagaggttgtaaacaactatcatgatgatagttttcacccatctcatatcctttaaaatttgaagcatgctactaaatattccaactatgttggaagtgctagttctgggctatgactctgattgcttatctatccatacccctttgggacatattgcgattgtgtagattacgggttatagaaaactttgtgtagttgtttaaaaaatatgttggttggcaaatcttggttgtttggctaccccggtttttggtaatgccatttatctaagctaagtgtgtaaagactagaaaacccctcaaaatcttcaatttcctatgtcagcacacatcctaccaatggatatatacattccttcccttgcccaaccttaacaaataaagggtgagctagtctagtaggtcttcattgagtattaccatcattggagagagagaccatatcaaagggcaggcacaaccatggggttcaaacggtgagtagtcagaccgatcaatccctacgatcccttgttatcctcttcttgttttactctttgttcgtcttagttgtgaaattgagtgaagaattgctgatttagtgtttgaaaatcttttgggttttaatttgcatgatgtaaatccttcttcttagaatggtcatcttgttctctagtctccaccatggtcaccattactttctagccttcatttgctctacgactatctcttgtacgcctttgttgtttgagatacattttgaatttgaggggaatgggagcacattatggtgaagttgaggtttgggaggaaagcggatggcatgagggggaggatggaggagatgaggttggggaggaatggaggcggcgtgagggggaagcggcccggtgtgggatgggggagtaggctgactgtgagagacaaattagggcagaggagagttggtagtagttggactttatgggctaaaggctattgggttggaatagtgtgggctggctagtaccttttcactctttcacgtgtcatatggttataatataaaatttacattacaaattgttattaattgggtatcaatccaagtcgtcgactagatttgttgaggttcatgtcccaggtctagtggcgaatctagtttttgggcttggtttgggctcctgctccacctgtgttaagggcagaccaagcctcaagacacacatgccattgcccgaagcctaggaaacaaagcccattaggtccagcaaactttcaccatataatgggtgagttcggaagcgctgtagctacaggactcaggaagcaagattatgctaggagagctgcagcgctgtggctgtgcagccacagcccagctgaaccgaacagacccaatggtggtcttggcccaaacatgccatgtgccggcccagatctccgcaaaacctaggtccgtccctacctgtaaccatctcgtccctcccaaatcaaagagagaagaaataatcgctggtaggattgaactgagaaaatcataactaaatatgcatggtgttgtgttggcactataccttttaaatttctttcaaatgcatgttatgtaggatttattttgtactaaatatattgaccggtaggttccacatccattaacatcattcttcaactcagcttcccggtgacctttgttcttagtaaaaggctctagttatttttcctgtttttttctttatcaatttgtattctcgagtattaatggtactatatttgatttatcttcttatcattgaaggtccattaagccacaaacttccatgcgtacatcggtgaaggtgcataagttgacgacagaagatgcaatgaattacattcttaccatcaagaataaatttttgcgtcaccctgagaagttccatgcattcatacacaccatgattgatttctccaggggcaggtgagtaataggcattaacatagggtggttgcttacaaaatcatgactggatagattggagcaagaaattctcatgtgttactagttgtatgtggataacaagttttattgaaactttggttatgcaggattaacactcatactgttattgaacgtgtgaagatcctttttgatgggtatcctgatctactccttgcattcaacaagttcttgccaagaggcataaatgcaatatgatgaagaattttgtctaaatatgtttcctcgtttaaggctcaagctcactagctataataaatctttgataactttatgagttggtttactcatctattttaattgaataatttagcaatgctacatttgttcttatcgtacttgtctaagtacctaagtgccgactatattttggagtgctgttattcttattttatctatgccatctatttggtggagatagagattctaagtagctagtgagtatccatttggtgaaaaatctagagaagctaaggcatcatttgatgagattctctaattggctacttcctcggttatcgtgaacacactaactaaactactacgatgatttttttccaaacattttctgtatagaagtttattttaaaaaaataaaacaatttgtcatgtttacaatagttggtacttaattaatcatgttctagttatctatcgtgttttccatgccgtagagtagctcagatagacaacctatttgagtgctgcctatgttatccagcctctgctactattttattttctcgattctataaacactaagtctgaactatttagggagctcgagatttcgggagtagctatagctacaggaagctcccaaacttgtccttgctctcttactaatatttgtctcacgttgcatttaacgctcgcatggtttgtttgttcaatgtaggagctatcaccattgatcatgtttgtaccacactagtcgtacttaattacttgatttttttctctcctaactgtttttttgactttctaatggtcttgaatcgattcttgttgctttggcaccctaatgtgttgtccatagcaatactactattccggatgaactatgttgtaatgaaatagaaccatggaaaattggcagaccatgttgttctgttaaatgctgtagacagattgccatcacttgaccaatgttgcatcgaaagtgttgaagatgctaggttgtgtaaaaaatagtacatatattttaactatttgccactcttacaagtggcaattaaggattcgccattagactgacatcatagatacatgaggtgtgcaaatgtgatgacatgagcttttttttttttgctgctaccattgcaccttatctaataaggtaaatttgaaatatgatggtgtttcgaagtaaaaaaggaaaagctaaagattctcaatcaacactctcattgggctgcaataatcgagtgtcaaagcaaatataccaaacaaagaacaatagcgtgtttctaaactatatatatggaatttggtgcttgttttgatcgatttgcatctatgacatagtccccatggttcacgcactattacctgctctccatggtcttcaactatcttccagatctccacttaccccaattatcttgtcgaagcataatgcttcaaaactgcaaaaggttcaaacatttgttatcacttaagcaggagcagaacaggtcaacaacaattatcaaataagataataactaactaaactagactttaaaaaataaaatatactaaaaactacaatgatttgtcctactaggtcctcatcctatcccaccaagttctacaaacctaagagtccacatgaaacgatacaacatactacattaatactactaacaacactacaattatggctgtcaaaaaagctcgaggcttgtgcgctactcgagcttggctcgtttcggactggattcgagctcaaatcgagctcttaatgagccgagcccaagcccatgcgcaagttcacgagctttgtcggcccgagctcaagcttcttatgagcctagatgtatgtgtaatttttatcttttatatgacaaactagtatgctaaggataacttagtatacattcatttgaaaatttagtatgtgatggtatcatatattaatcttaaattctcgtaaacttcttttttcatattattaatttagaattattgtttttataaaatattatcatcaaaatatggaacatattttaggtttacttaatttcattcatcttacacctcacagccgattcggtcagatcgcatcggctaggttcacacgatatgtcatcgacttactggctgatcggctatcgtattctaatttgattgattttcttgtttattcttgttggtgatcggatcaaactaactggcacgccctaaacctaaaagcgttttggacctgtactggaactaagccgaactcccaggccgccgcgtttctcgtcatcagactcctaatgggctttgaaggcccaattaaacgtcttacatattcaggagcaaggggcatgggaccgtctgacacaacatgtgagaaacctagtcgttaccaagatgaagagcatcaaggacacgagatctccttgctgaagcccatgccggtgagaaattgacacgttgtgagtacatttaagagtacctgagtagaaaacctagccaacaacctacttaaaacatcccgctaaacttggctaaatcctatgcaagacttcaagtaaaaatggccgaaaagcagagtgaaaggctttacacgtgtaaaatttgagagcaattcttggctccttttgagattgcaagaactttgccgtttgttgcacaagcatgacgttatcttggataaatcaaccttttataaaagtactttggttaggagataccaaatgttgtagatggctagcagcaaagggcgatgatcctaatcctctgttgcagcaatatgtaggacatgattaggaaaatgtgactcccattctactgagcaaaagatcattctatccaatttgacaagagtaagtattagtctacgtttaatacttcaaatgtgtccgtatatccgatgtgacacgccaaaacttttcattcacccctatatctatacacagcctaagcttctactccctccatccaaaaaaaagacaaaccctagtttccgtgccaaacgttnnnnnnnnnnnnnnnnnnnnnnnnnnnnnnnnnnnnnnnnnnnnntataaatnngttnttcaanntaccacc

SEQ ID NO: 6591 - DNA, 17979 bp, Oryza sativa
attgttggcaactttttgacagtttacaagcacgatcgcagcaccttaagccttgcggtgatcctagagtcgccaaccacctcgatctagcaaagagctaaacctagatgggttttgataacaaaatcggctagcggagccgatttctagataactacccatctcgtgggcaaaacgaaaggttttcaggacaaacctacaaagagatgtcgcactctcgcagcgtcggcagacggtttacggcgcaaaccgacaaagatggacaaactaagagaaaactaaaagcaatacgaaaaaacgattcgattgattgattgtagattggttttttacaatgaaccggtcatgtcccttatataggggttggtcttgccctctacaggccctcctccacgtccaacttgaggtagaaaccaaacgaaacccgaaacatgccttcccgagcaaggaaacctcgagacccgacaaaacacaatcggactcggacctgccggtcagactggccacacaccgccggtctgaccggccctcaaccggcggtctgaccgcccaacacacggcggtcagaccggcccactcggaggaaaccggtagacttccaaattttggcaatctttcctattttaatcctaggtgccaaatttgggtttaaacacatgcccccctgcctttttgatgaacaacgtgaatctaaaagcatagaacatgttttggtcttaggacgataatccaattaccggccatagtacctcctaagcgtcttgccaaacgctcgggaagtatttcttcaaatatttcccgttgattgctcgctgaaaatgctccccttgaagtgtctccaaaaaatatgcgttccctcgaacaatgccgcacactcgataaggaccctcccaactaggagaccacttaccgaactccttggaccgagtacccaaaggcaaaattgtcttccaaaccaagtctccaacttgaaacaactttgctttcaccctcttgttgtacgccttggccaccctcttcttctctttctctatctcttccaatgccttcaagcgcttgtcgatgacttcatcaagattatctcccatcaacgtcttgtaatcttcacttgacaaatcattttgcttgatataacgaagagaaccaagatttacctccaccggtaaaatggcttcttgaccataaaccaactcaaaaggagtgactttagtagcaccatgtttagatatcctatgcgcccacaatgcttcagaaagcacctcatgccacctctttgggtgttcctcaatcttctttttcactaacttcaacaatgtcttattactcgactcggcttgtccattagcctgagcgtagtaagtagaagaactcaacaatttaataccataagattcggtaaaactcttcacttccttagacataaaagaagcaccttggtccgtagttattgtttgcggaataccgaatctatgaataatatacttcaaaataaagtcaattacctccgtatgagtcatattcttcaaaggcacggcttcggcccacttggtgaagtggcttcggctcacttggtgaagtaatccgtagcaactagcacgaacctatgcccctttgatgacgaaggataaatttgaccaatgaaatccaaagctcatcatcggaatggccatggtttgattatggggttcaacacggcggcaggcgccaattgaacattgccgaaccgttgacaagcttcacatcctctataatatttgaagcaatcatcaatcatcttcggccaatagaactccgctctcctaagcaatcaattcatcttgtgggccgattgatgagttccacaaattccttcatgtacctctcccatagccactttagattgatcttcatctaagcacttcaacaagacaccatctatatttcggcggtataaatcctcatcaagcaatgtgtatttgaacgcttgccgcagaattttccgatcaaccttaagtgtgggatttttcaaatatcgaatcaaaagaattctccaatctccttctgcttcctgggcacaaatgtccgaattcacagttaattcggccactatattgattgaaacgtgccccccagcgctctgcccagaaccggtcagactggccacacagggccgttcagaccgctcagagtcgccggtcagaccggcggcatgcggccggtcagactgcccctggtcaccggtcagactggccgagcaatgccggtcagaccgcccctggtctccagttttgccaatttcgcacaaagatttaaaatcaagcaccggctcttctaatatcagaaataatcccttcttcacattatagccagatgcttgttgtgccaaattatttgctctagaattatcatgcctagcaatatgtctaatagcaaaattatcaaaattggcaataatatctaaacatgaatcaaggtacctatttagtgatctgtccaagcatttgtagactccggcgacttgttgcaccatcaattccgaatcaccaaaagcctccacgtatttagctccaaccatctccataacttgtaagccgaacaataaagcattgtattcggcttgattatttgtacaataatactccaaacgaaccgatgcttcataacacatgctattaggtgaaaacaaaactacccctatgccttgaccttctttgcaagaagaaccatcaaaataaatcttccaaggtataacttcaactaagccaacttctccctcataagcaatatctatatgatggtccactataaaatcacatacaatttggcctttcatagatttcaatggttcataagccaaatcatatcctctcaaaagctaacctcaaatcggctatgtatccctccataccatccgatttgacaacaatatcatcaatgtagatctctaagataatgcctagcaaatcatggaagatcaaattcattgccctttgatacgttgcaccggcgttcttcaacccaaaagtcatgacaacccactcaaacaaaccaacaaatcccggacacctaaaagccgtcttgtacatatcctcttccgccataaagattttattgtagccggcattaccatctagaaagctaatcaccttatgacccgaggcatcattaatcatcatgtcggctataggcataggatactcatctttgggagtggctttatttaaatctcaaaaatctatgcaaactctaatcttaccactccccttcttctccaccgggactatgctagaaacccactccgcataacgacatggcctaataaaccccaccttcaacaaccgatcaatctcctctttgactcggtcatatagcaaaggattaaaacgacgaggtggttgcttataaggcctaaaacccggtttaattggaagccgatgctcaacaagctcacggctaagacccggcatctcatggtactcccatgcaaagcaatcaacatactctttaagtagctcgataccttaaccttataataggctctcatgtttttgtttacaaaagtcggccttggtttagttccatcacctatatctacttcttcccaaggatcggccgatgtaaacccttttccaaacttctctacttcatcaaaatcttcaatggtttcaccaatatcgttctttgtagaccgatattcttgcaccctcttttgtaaccactctaaattagcctctttactcattatacaaatttatatggcttagccgtgctacactagccggctttacagagataggtacaaatttgccatcggagatactaataaaatcatagctagaaagatccctccccgacaagcattggatattcccatgacgccactcaaaagtagcatcggccattgcaacctcggtcgatgtatccgcttgcacaatttcaacatcattgccgtcccattgaattaaacattgatgcaaggtagaaggcacacaacaattggcatgaatccaacaacgactcaaaataacattgtagttaccttgcacatcgacgatgaagaaagcggttggtagcgtcttgtttcccacggtgagctccgccgaaaagataccctttgcctccgttggttcaccattgaagccattgagaatcatgttggtcttcttcaactcatcatcctcacgccccaatttcttgaataatgagtacggcatcaaattcacggtggcacctccatccactagcatcctagagaccggcttcccatcaacatggcctttgagatagagaggcttcatatgacggtttgattcatcgggcttctcaaaaaccgcatctttaggacctaatgaaagttgagcaacctcggcttcatccatagcacaaaactccataggcaacatacaaaccatgttgatatccatgtcttcttttggagatgattcacttttatcaaccgattgtttctccttctcttctacatcaaccggcttttccttctctatggatttatgcctccataccggtggtggtcgcaactcattgaatcttttatctctttgttcttcagcctttttctctcttatttcttgagcccgaagacgttgcaaccttctcttttgagtagccgtcaaatccttaggcatccatctaggattcggctctgttccaggaggtaaataatgtcccctaataattttgtttgaaaacgatgaagccctcacatcgccctttgcaattctcctgttaaaccggcgctggagcccggttagaccggccgtagaccaccggtcagaccgaccagatgcgccggtcagatcgacacttggcgaacggtcagactggcctgaggcgtcggtcggaccgctgtcgggtcggcggtcagaccggcctgatggcccggtcagaccggccgcatggctgcggtcggaccggccagaaggcttggtcagaccggccgactgcgaggagctggtttcggcttcggattttttgtttgaagatactccaattccatctccagaaggtattggcacatcatgagaccccactttgatggtaattacttctgaagtccttgcctccaccttgatgcgctttccttccctcctttcttcattggcccggttcctgccataaaaccggccattatttggtgaagacaaacgctcatgaattggccttcttgatcctccccacccttggttgaattgcattggaggcatatgattgaacattggcggcgttgccccccatggcatgtaataaggataaggataacccggcggctgcattggataagaaccccatgacatgtcttgtggatgatgatatggaggtgaatgcgaccgtcttggtgaatgaccaaattgttccctaggaggtgatcttggtctttttcctttgttgtgaaccctctcaccaccttgcttctcatacttctccaaaagcatatcaaaagtcattttggtcttcctaggggctttagaagttgaagctccactcttattctccttccaaatgccaacctccggcttctttggcactatcgtcttaggccttggttcgccaatgaccactccttttcccttagtagattcggcttactccggccgaatcaacaccttcttatcattgaaattaattgtgttcaccagaaaaggatcatgatcaagcttcatcttggagccatcggtgaacttcaatcgtccttcatctatggccgattgaacctgtcgtcgaaacacattgcaatcattagtagaatgagaatgagaatcatgccatttacaatatgctcgacgtttcaactcttcttgagatggtatgacatggcctttaggtaatataatttgtttttcttgtaaaagataatcaaagattttgtcacacttggccacatcaaaactatatttaacctcactttgccgatctttgcgaggagtcggcattaggttagagcaaacaaaaggcttgtttttattagtccatgaccattcggcaacatatatatcatgatcaccttcctcctcactatcactagcctcagggtaatcaatcacattaacattaggctttttgtcatatgatctaacaagttttttattatccttaacccggctttcttgagccagagccctttgcataagttgactaacatcaagaaattgttggtgtcacgcccggaatttctatccaaaattccaaacgcttacatgtgtgtgaaccctcgtccaggaatcagccgaggcacataataacaaattgataatagagtacaattattactctaattaataagcgtataaaatgtcattacagaggtagatagttcctctcaaacaataaagatctaagcagcggaaaataagataaacggcgcagacggctccactccacaggcagcttgaccaaagctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttagtaaaacagttaagtaattaaaccatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaagtaatagtgaatcttaagttatcccaatagtgagctaatgtttctaagcagggctaagcaattatatctaatatctagttgaaccaatataaataaagctcaactagtcaaattataataacccaaggtatcaaggaataaagtaatcaagaacaaaaagggctataacaaagaataggttaaacccacccaatgacatttgaaaataaatgcaatatttgaatagaaacagtagctttaaacgggatcaacatgctcaaagggttgtttgggatctgtgtgacttgccttgctggccttggaactcttcaaactcttctccggcgaaaacggactctccggaaacgacggaatctaaacagaaaagagcaaaaacaccaaaacaacacataaacaagcttgaacagtacatgtggatatttttaacatgtagatctcaattttagaaaaatttagagacttgaaccaactaaatcggagctaagatgaattagttatgaatttttgaagattaaatcggattaaaacacttatatagattttaattgaattatgacgcaataatgaattatttttgaaaaggaaaaggaggattattgcgtcagcgggctagggttttggtggaccgggcgcacggcggcggttcacgcgaacggacggccgagatcgacttgatccaaaacggacggccgagatcgaacggtccacgaccggctcacgggagagggcgacgatgacgtcgacgatgacgtcaccaccggcggcggcggctcggcggctcagacggctcggacggcgcacgctcgctggcgaacggcggcgcttcggcacgaacggagggcaccaacgggtagagcgcgacgcggcgaactcaccggtgaccaaaagagcagcggaagaccaacggacggcgacggcgacgaggttgaaacggcggcggtcttcggtttgacgacggcgacgatgctccggcggtctccgactgtggcgaagcagcggacgaggacggcgacgacttggcgaccacgacggcggttttcccgagcgacggcgacgtctggaacggcggcggcgcacggctggagcgacggcggcgacggcggctcgaagctacacggcgctagggcgcaacggacgaggggaggcgaaggcgagggtggcggcgggtaaaggagacaccggggaagcttataaaggggctaggaggcggcggcgaaggcccacggcggccggcgacgagatggaaagctcgagctcggagagagaaaagccgatccgattcgaactcgaatccaacgatttccaaaccgatttagccgatgtttccaaaggagaaaaggtagaggagatctcggggatcatttcccctcttttgattcggccggagaaggaaaggagcggccggatttggaagggaacggcggcggcggcgcgctagggttcggccgggcgacggcggctcggggaagacgaacccccacctgtcagcgagcgagggcgcgcgcgcgcggcggcggactgggccggactgggccgaggagagagagaagggttttgggcccaaaagaagactttttaaaacctttttcaatttaaattatttcttaaatgtaattccatttattaaaaatacttccttagctcaaataaatcccagaaaaatctaggaattatagaattaagcaaagtatttaatgaaattttatctgggcccattttatattggaatttattaattaaaattagatcttctcttcaagacttttaaaaaataaattctaaaaattccatttaaacaacaatttatatattttgaattttcagggtgtgacagttggccatctagtctttctctaagaggagcaattaaaccattaaaagcaagaccagccaaatctctatcagttatattcaagctataacatcggtttctaacatccctaaatctcttaatataatcaatgacaggctcattatacttttgcttaaccgatgttaaatcacataacctaagctcagtttctccagtatagaaataatcatgaaatttttcttctaattgagcccaagtatgaatagaatttgccggtaaagaagtaaaccatgtaaaagcattaccggacaaagataaagtaaacaagcgcaatttaaaaggatcactattagcctcaccacattgcgccaaaaattaacctacatgctcccatgtggtcttactatcctcaccactaaacttggtgaattcgggaactctataattacggggaaacggcacattatcataataatcaggatacggctttttgtaaaccctagcacgattcctagtttcaattcctaataatctcactaattatatcctccatattattaggcccttgttgatttggcggtggatttggtggcctaataggttgtgtttgtggcgcaatatgattatattggctttgtctagtatcaggaggataccccctagtaacgtcattataagcattaggaacatgtgggggaacttggggattatttgcagtagtagatataggaggatcaaatgttctaagatgatacaaataactagcattagtcattggatctattccctgtatcggaataattgcgtcggtctgaccggcccagggcccggtctgaccggcatccagaggcgtggtcggaccagcctgagtcccggtctgaccgccggggtagtacccgttctgaccggctgtctggccggtcggaccgacggctatgttgcggtctgaccggccgtgtgcgtcgctccattggttctactacccgtttgatctataggaggttggttagcagtggtagaggccttatcctttgacatgtaatcggccataagagggccgaatttaacccttaaaaactcatcaaatttaccctcaaaagttgcatctaacttatctttaaaagcaatcatagatgaatctattgtagatgctacttgttgttggatagattgtgatacctcatcattgcttaccaaatcaagagcgagcttaggacgtggcccgggcttgatgatcacgccttgacgagtcctagtgcttgccctcatcaacgcctcccgtgtgagctcgttgatgtactcctccatagctttgcggtcttctccttcgaagtcatccaatgtgaccggtatcatattgatggctccacctccgtcttggatggcggcttcgtcatgacgaagtcgaaattgagttgacgatgaacggatctcctccccagcggagttgccaaaaatcgtgttggcaacttttttgacaagttgacaagcacgatcgcagcaccttaagccttgcggtgatcctagagtcgccaaccacctcgatctagcaaagagctaaacctagatgggttttgataactaaaccggctagcggagccgatttctaaataactacctgtctcgtgggcaaaacggaaggttttcaggacaaacctacaaagagatgtcgcactctcgcagcagcggcggacggtttatggcgcaaaccgacaaagatggacaaactaagagaaaactaaaagcaatatgaaaaaatgattcgattgattgattgtagattggttttttacaatgaaccggccatgtcccttatataggggttggtcttgccctctacaggccctcctccacgtccaactcggggtagaaaccaaaggaaacccgaaacattccttcccgagcaaggaaacctcgagacccgacgaaacacaatcggattcggacctgccggtcaaaccggccacacaccgccggtctgactggccctcaaccggcggtctgaccgctcaacacacggcggtcagaccggcccactcggaggaaaccggtagacttacaaattttggcaatctttcctattttaatcctaggtgccaaatttgggtgtaaacaatcattattcttctgtgcatccttataaacaagattaaatctcctgcgatttagcctaggacccaaagaatgcaacagaataccccaaagatcatgaaggaaaagaatcgtctcatctcatcttgtggcctgtaaacacaattcaatcaccatgacccctatcttgggacagaactggactgaggcactatgtgaatcaaccctaccggaactaatggatccaagcttgcttctccatgcaatcaagataccaccagttgcccccaccgaaggaactttaacaaaattgttatcaaaatcagacccaagcatagccaagatagtgaaatgaaggaagattgtcatgtttatagagttgggatgatctaggtgacaattaattgtttgttttttaaaaaacaatagaaattttgatagagatggaaatatttgagttgcaaatatgcgtgtcatatcaggtattatatagggtgtcgcatggagtgttcagacactaataaaaaaaactaattacaaaatccgtcagtaaaccgcgaaacgaatttattaagcctaattaatccgtcattagtaaatgtttactgtagcaccacattgtcaaattatggagcaattaggcttaaaagattcgtctcgcaaattagtcgcaatctgtgcaattaattatttttggcctatatttaatacttcatacaggtgttcaaacattcgatgtgacatgatgtaaaatttttatgtgggaactacacagggccttaatcatctaacatgtactatattggtcatatctcaaatttgctagttctttggtcacctgatcagagtgatagccatctaagttaagcattttttgcattataatgtagtagcacgtcagattagttaatgtgtgattttgtgacattctaggccactaatatagaaccgggtgacagagcccagtggcccatcactgaggcactcacttgtaacaagccgaaatacaccccatagcaaaggtatggcctcctagccacagggcatgctaactggcgcgagtgcgctagttacggaactggcgcgcacgccagctggcggtcccacgcagtttttttcgctatttttttcgtgttttccttttatttttccatctttttcgctattttttcgtgtttttccttatttttttaattgttaggacacgtgttttcaaaaatattagagttgaaagttttcaagtcttaacttgaaagtttttcaatctgaagaaagtttcaaatctagagttgaaagttttcaaatctgaacttgaaaattttcaatatcaagttgaaagttttcaaatctcaacttgaaaattttcaaatatggacttgaaaattttcaatctcaagttgaaagtttttaaatctcgagtgaaagttttaaaatctaagttgaaagttttcaaattttgtcttacaaatttaaatttagagttgaaaattttcaaaatttgaattcaaagtttaaatcttaagtcaaaagttttcaatctgttagtaaaaaaatcttccaaaaaaagaaaaattttatcttaattaccgtcattatctaaaactaatttagttagttagagtctaaaatagttagttaggcactcccggaacgcgcgcgcccaatagcttttccgcctagccacacccatcatcgatgactacttatctttgatgggctgtatttgtggtctggcataggacatctgtgacgagccacaaccaaactcgtcaccaatgaggggtcatcagtgacatgtgcgagctttacacctgtgaaagatgactatagttatctttgataggctcctgttcattgcccgtcataggtagcagtgactatgtacaccctaaacctttgtaaaatggttatcccaacctagtgtactgtcaaattttgctctagcaccacaatatctagcgtaacataacacgtgtgattttgtgcaacttgaacagtatcagccaagctttcgtgaaatttacttaagaaaatgtgaaggtataaagttccaaggtgctctccagattacaataatcatccgtattttcttgtcctcctctatctcttcctcttcatgtcatcatcctcattatccctgaaagaaatataaacacgccgtgctacagatatgatgttcacaggtggcgtcctgcttccctttgaccctattcctcgagccattatttagtgacctttgtcctaactcttaactaaaaagtctttagttttccctgtatttttcctctccagtttgtattctcgaaagatataatggtatccagtttaattgatctccatatcatgaaaggccagtcgagcgaccaacttccatgcctctatcagcataggtgcattaggtaacaagagaacaagcacgtaccttctcaccattaagaacatttttttacaacatcctaagaaatattatcagtttgtcggaatatgtagggtttctaccagcgcaggtgtcgagggggtagtccctcagacagcggggagtggagacccctccccgagagtaaagatccaaccagggggtttgcggtgagaggcacggactatctgcaatcaggaagggttcacggggcccgactaccctgcacagagagggagacaggagtttatacaggttcaggccacccagaggtgtaataccctactctatgttggtgttcgttgtcttctctagatcagctaagtacaatggagaccttttcaggctacaaagcaagagtactgatctaaaagaatccaaccctttcatctgtatatggtccccttccttttatagtccaaggaggggctcacattattaccaatctactattagtcttgtcttatcagctgtcttattgtcgccggctggttccctaacacagtcttcaagaaaccctttgagtcttgcgattcatattaccccgggctccatctgagacagttaggatctcaccagtgtgctcgccacgtggtgcgtggtgggcctgacgagacccgacttgcccgaaacagtgccaccgttgcttctccacttgcttggataaatcaagtggtgcgaggcatgtgtgacgcgtgtccaaggcgtcactagtcctaggtgactcagcgctggtgtcttgtccacgtcctttcaacttcagactagttggggatcccccatgatcctgtttcaattatggcggggcatactgcctcacagctggctatggagcacgcccaacttcccggcaagtttggcaatcctcggatgagtttctcgaagatgtcgttggtgaaggaatattccaagatttgtacgtctcgatgctcctctaggcagagggagtgagccctataaggaccaaggtgagctcggggcccgaaacaaggccgggcctgaggcaaacctcagtttacacctttatgctttgtatgtcttggcactcatcatcctcgagtagtgcgtgactcatgcgaactaaggtgagcccggggcccaagagtaggccgggcccgaagcataccttagcttgttctcttaagatataaatcttgcagatttctacgccccttttgccgaggaccgtagaacctacaaggactaaggtgagactgggacctaggacagggccaggtccgaggcagaccataggctatattcttaagacgcatttggggtatgcttgggacccaagccaggtcccaagctacttttatgctcagagatttgagtcatacacgcagtattcctcctcagctagggagaatcccatatatgaaaacttaggtgggcccgggacccaccagagtgggcccctagctacgtcactctagggttacctttttatttttaaagatattctgagcatgctatttatttgataatgatccttttgccagataaatgggtaccctggtttccatttcaccgacagcaggtgagtcacaagcatgaagaatgaaaacataaggaatgtatgtaaaatcatggccgattagactatagagagaaattctcatctatgttgtaggagttgtttatggatcaactagtaaataaatatcgtcaattgctcggttatacaggattttcatttaatttacagtgtggttcactatgcgagcatcttttttatgggttaccagagtatctcattgctttcaatacattcttgccaagttgcattatcaaaatttggtgaatgataagaatttggtcagaacatctttgttcgctcaagggtctggcttgctagcgacaaatttatatgcaataggcttttgcactgatttgtgtatcaaccactgtgttgatttgtgtatcaaccattgttatcaaactgcctgaaaaacactggatatttagtcattcagtaatgctggatttgtgtttgcagtattcatttggagtaccaaagtcctaacaatatatgatagtgatattatttttattcaatctacatgttccatggttgcatctgatcatagttgcctaatatgtgttagatttaattgggtaattgatccaattaaatcaaataaattccaaggctcactatgctagaaatttatgtgtattcattctcttatgggatatcaatgggatgaaaagttttgagaattaatccatttgattaatgaattggtaaccaatatcaattactcctaattgatggttggttgatggttgtgtagtggaggatagttgatgacaattagttactctattcatcttcctattccatgactcttttactcttcatctttcatttctcctataaaatgagaatgggagaagagacacacacgtttcatccacttccaatgttgttgctgctacggtaatcccatcctgacgagtgtgtgcacacgtattaggagagtaagccttcgaaaccacacactgctatgacgtttgcacggacaggtacgacgtttgcacggacaggtgggcgatcaggtttttggggagtgcaaggcgcgactactcactattcatcaatgtctacttcatcttcatcaacatgttgactgggggaggcgtcaacggtggacatgtcggcagcggtactggaggaggcgagaacaacaacaccaacgtaggcaacagcaacaacaatgtctcatcctcaggagcgttctctgggtatattactctaatcaccttagtgttaaacatgttactagatgatgctactattgttactagtattttcatgtttagcactatcactggatcatttcggtttccacatgtcatgtttattatcttttttctggattaaaatatgctgaattatgaccatatttctaacagtatgtttgttcaaacataggagacatcattgttggctatgtttctaccacaccatagacctaagttactttatagttctctcctcctgactgtgttatctggtttataaattgtaatagtcttcaattgattatagttgcacaccctaatttgttgtccttcacggtacaacttattaaaagcttgagattcagtagatccatggaaaataaatagaaccattttgttgagttgtatgctgcacatagactacgcactctattgaacaatgttgcatcaatataatgaaaagtcgccatttaacattataactccaataaacgcctctattgatagtagaggatcatcactttagcaaatagcgtgcgcgcgcgtgtgtgtaacttccagctgcttcaaaccagttaatgtcaaacaacatatatagtaactagagaactacatcatgtgtccaagttttccctatatggctgataaacacatgcatcacccatttggtgttggtttgactggattttcacaagggtggagttaatattgagctgattgaacattttctgtatatgacgcaatacacatggagcatggaaattttatcctaggcagcctgccctgtatgcactggaattttgctcgttacttaagtaatgtttcgggttgataatgggacctacaaggctatatcgttgttaatggaacctacaatgctatatcgttgttacagacggttatagactatgggtgatgatttccacgtgaatcaccattgagatctaactctttgtaatgcataatgtgcatgattagtaccaaactcccaactagcatattgtcataaaaactaacttggggctagattgttacaaataacaatccatggctccggcaatgattaccaaatgaaaataataagttattgtggttcactaatagaacatagagccatatataacacatgtactaaatgcaatatccataggaggaaggattcactacttgatatagattagaggtctataataaaccatatatcgaaacgacaaaaaaggttgtaaacaattacatatatgattttttttacccagctcatatccttcaaaatttgaagcatgctgctaaatatgaagtacttgttgtgggctatgactctaattgattatctatccatacccctttgggagaaattgcgattatgtagattacggggtatagactattcgagattttgtagttgtctaaagaatatgttggttggaaatcttggttgtttgggaaccccatttttttaatgccagggatcctctaaagtaagtgtgtaaagactagaatacctctaaaaaactttatttttctatgaaagctcagatcctactattcaaagcaacacattgagtcatagtggacaaagctgaattcggctatagtcatgtgatctcaatgcatcatc

SEQ ID NO: 6592 - DNA, 5666 bp, Oryza sativa
  unsure (1)..(5666): unsure at all n locations
cgcgattganaattaatnnnnnnnnnnnnnnnnnnnnnnnnnnnnnnnnnnnnnnnnnnnnctctctctcaatgatggtaatattcaatgaagacctactagccttgcccaccctttatttgttaaggttggggaagggaagaaatgtatcctacattttctttgtttatgcattaaatgtgttgctttcattggtaggatgtgagctaacaaaggaaaatcaaccttttgacagattttctagtctttacacacttagcttagataaatggcattaccaaaaatcggagtcgccaaacgaacaagatttgccaaccaaccaagatttgccaaccaacatattctttagacaactacacaaagttgtctataacacgtaatctacacaatcacaatatgccccaaaggggtatggacagataagcaatcagagtcatagcccagaactagcaattccaacatagttggatgttggaatatttagcagcatatgctgcaaattttgaaggatatgtgatgggtgaaaacaatcaccatgataattgtttacaatctttctcatcattttggtacatggttatcatagacctctaatccatatcaagttgtaagggataattgttccacctatggatattgcatttagtataagtgttgtatatggctctatgttctattagtgaaccatattaactttttattctcgttagtgtccatgtgacgaggactgacaaggtcagctcaaggccgaggatgttactccgtaggtcgagacatcaagtggccaagacaaatcatgatccgtgtgttctcattctttgttcctttagctgattgcagtgacacgatctatagtagatgtgattgctacctccaaatttatctatgttattcactcataaattaagaggtaatatatacaatgtcacccctaatacacaaataccaatacctataatactcccatatccttcttggagtttgtgtggaggctacctcttgatttaggagtgactcatcatctctcttctccacctcatcacccaattctatgtgtcacttttaagggtaacatatgaagcattatagcacttaccctaaccacatgtacacaccactgtttgtggagccaatgattgacttcccccataccaaaaaacaattgtttatgatagaggctgaatgagcaggacctacaattttatgggcaatagtagaaatctaattattgaccatccttgaaaataaattaaagctatagttcgagagacaaatttatctgtttgatagaagtggcattcttaatcttggaaatccaactaatgataccttaattgattattttaatgtcaagagtccatttatataaattatgaatctggaaatggttcctaataccccataggttgagtagtagaagtaaaaatatgcccaaggagagggtctcctctgattagctaagcttgttgcagcttaccaaaacgatgatcaatagcgggtccaataggatgaccaacaacgctagggctgagttctttctccaactttccaactcacctccctcacattccgcgcacatgcttttcaaactgctaaacggtgtgtgttttgtaaaaagtttctatatgaaagttgcttaaaaaatcatattgatccatttttgaaaataaaattacctaatactgaattaatcacatgctaatggaccgctcaatttttcgtgcgctagaaatgtattcccaacacacaacaacgaacccagcctaggactatgatacaatagaatcctgcatactctctctatcaaaaaaaataaatttagaattggatgtgacatattctactctgtccagatggaataaaaacaaatctaggtttttttacagtgacagattaattccatgtgcaggtgaaaggtctacacaggtagtcaacttcttttgtctttatcgttgaaaaatcaattatgagagaagcctgaaccattaaaatggggttgcgggagagcacaaggcattacaatttacaagccttgtgctgctaggtaaaacagcagagtaccccatttttcgtatggctaaggctgagtttaatgagaaggtgaaagagatgatcgggaagatacgcaaaacgaacgatatgagctattagtatatgattaattaagtattaattattttaaatttcaaaaatagattaatatgatttttttaaagcaacttttctatagaaatttttttacaaaaaacataccgtttagtagttcgggaagcgtgcacgtcagaaaacgagagaaatcttctataaaatcagtcttcatcacactctcagtgagaagcctgtttttgacaatttatgactcctgtattgtgtgcagtatatatgtatctttattatgcctatgtatgttggttgattttgtcgacttgtgtcgataagggttaggagaggatctaaaccaccggtttccttatcctaacaagaaacaaactaagagataaattcgttttttgtgtgatcggtacagaaaacagaatcctaaactaattgagataacccccgagcctcaccaatgtcgcctatataaagaaagagaaggaaggagacagacgaccaaactctctctctctctaatctcaaaccctaattaatcgcccgatcgatctaggcactggaaggggttcgtgaggcatctctgcaagaagaagaaagaagaacggcaatggcttctaactcaggtaagtagatcaattatttttccgcataagcaagaggtgattgtttatagactaaagcttaagatcatgtaattagaactccaacattgtggtatcagagcctaatttttagtccactcaatccctcataatcacatcatccctgtgattagaagccatccttataaaaatacaagattgattcggcatgagcaattttgaattagattggattaatttctttaagtattaagcccttttatactggtggtttcggccatcagtaggagaagcaaattattgaagaagctgtttaattcaagttttcgattttgattatccatcagtggagattaagagaagaaaagggattgggataaacatattgaaactcccaatttcctcgcactcagaaccctaagccgaagctaagaaggggataaactagattgaaattcccctaaatttagcaaagggaaattcccaattcccgcactcaaaattcctagaccgaaactaaggtttcggctagtactcagcaaacaagaattaggggataaacaagattgaaactccccacggttaatcatatgggaataaacaagattgaaatttcccgaaatccccataagccggatccaatcggcctaaaatccccaaatgaagaaccctaattctttggggaagaaccctaagtcacaaagtccgaattaaatccaaatggaagaaaattaggctcgggtttggtgacataccggattttgaagccccctaaaccggaagcagcatcgccgccacttcacctccttgcggccgcgtcggtcttcccgtgcgcgcgccgtcttggagtgtccctccaccgtccctcgccagggacgggaagcgccggcttggcggctgccttcggacttcgccccctcccctccccgccgacgagctccggccgcgtcgacgttcaccgtcgcctccgcgccgcctcgccggatgtaacatcccggcctagggcttaataggattaatagaatactcatatcaacaagttgcaacttcttttccggaagctttttccggaagccaatctccgaagaactccagggttaagcgtgcttggcctggagcaatttgggatgggtgaccgaccgggaaattctttccgggtgcacacgagtgaggacaaagtgtgcagaaaagatatgtgttggtctgtgagggcagtctatgacctatgaaagctatcagatgtaagcgggcccggcctgggggaaggcgggacgttacaaaatggtatcagagccgactctcgcggtttcacggatatgtgttggtctgtgagggcagtctatgacctatgaaagctatcagatgtaagcgggtccggcctggggggaggcgggacgttacaaaatggtatcagagccgactctcgcggtttcacgggcgcgtgtcgcaattgcgcaggcatggtgcgcatggctggtgtagaccgggagtggttacatagcatggcacatgcgttggcactggacacatggacgtgaccaagagaggacgttcctggcctggggttgatcgacgggggcgtcgatctctcttaagggggtgagggtgtaacatcccggcctagggcttaataggattaatagaatactcatatcaacaagttgcaacttcttttccggaagccaatctccaaagaactccagggttaagcgtgcttggcctggagcaatttgggatgggtgaccgaccgggaaattcttcccgggtgcacacgagtgaggacaaagtgtgcagaaaagatatgtgttgccctgtgagggcagtctatgacctatgaaagctatcagatgtaagcggtcccggcctgggggaaggcgggacaccttgtcacgcccagaaattcccgaatagaattccaagtcttacaaacatcataaaagtctttacataaatgcagcggaaagaaagaaagacaacaggagctaagccttgactagaactgcagcgggaaagaaagaaagacaacaggagctaagccttgactagaactgcagcgggaacaccactccacaggcatcctcgacggcacggacgaagcctactcctcggagaaaccttcatccgacatatactcgcactctgggggttgggaaaagtagagcaagactgagtactacccactgtactcagcaagtcatgccggaatagaggcatgatgcagggaatcatcaaagaagagctaaagtggttcatttgcataaagcgagcatttaagaacagagcatgatgcagggaatcatcaaagaagagctaaagtggttcatttgcataaagcgagcatttaagaacagaagttgaaagatttaaacagttgtaataattaattacaactgtacccacaagacacagccccacaacacgtttccgtgcgccgacatgccaccacgacataccggaaagaggctgtgacaggaccattcgcataaccccctctaaccaagcacaccacacctcaggtttcacccccactcctcgcaaggcaacgggcagtcccctctcgtgcctaggtgaatccggaagccgcataggccgtcgcagggcccatccaaactccatcacgcccacccttgcctggatgcgtcggctagaggaaagctacgttacaagcccagccgttgcccacgctggcttgtggtaagtacgataagttcttccagggcatcccgcgaaccggtccttaactgccatgggtgcgaccagcaaaaccatgcacccacggcccaccatgtgatttattttaattaaccaacaccaaagcggtgttactaaaccaacaaaaccattagaaccaacagtctaaacattaatatgattttccccattgtgaactagtnnnnnnnnnnnnnnnnnnnnnnnnnnnnnnnnnnncatcgtcaaatcaaacccgct

SEQ ID NO: 6593 - DNA, 744 bp, Oryza sativa
  unsure (1)..(744): unsure at all n locations
ncgcacgtggacctgagtagcttgaagtaacattcttgcacgtccactctagaggatccccacgcactgatcgaaacatgcgattgtttcctgccaaaatcctcacatggtatcagagcctgatccaatctaatctagcgatgttactcgatggcgtcctcctcctacaccaccagtagcgccaatcctctccagggaagcttggtgagtgagaagcttggaaaaaccaaccatgcactttggaaggtgcaggtctatgctgcaattcacggcgcgcgtctacaggggaacctgactggcgcaggaaagaagctagacgccgagatcgccgtcacagttgatggcaagacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6594 - DNA, 746 bp, Oryza sativa
  unsure (1)..(746): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgacttttgggttgaagaacgccggtgcaacgtatcaaagggcaatgaatttgatcttccatgatttgctaggcattatcttagagatctacattgatgatattgttgtcaaatcggatggtatggagggatacatagccgatttgaggttagcttttgagaggatatgatttggcttatgaaccattgaaatctatgaaaggccaaattgtatgtgattttatagtggaccatcatatagatattgcttatgagggagaagttggcttagttgaagttataccttgaaagatttattttgatggttcttcttgcaaagaaggtcaaggcataggggtagttttgttttcacctaatagcatgtgttatgaagcatcggttcgtttggagtattattgtacaaataatcaagccgaatacaatgctnnnnnnnnnnnnnnnnnnnnnnnnnnnnnnnnnnnnataggttatacaaatttcaaatnggttctcaaattcagcttct

SEQ ID NO: 6595 - DNA, 864 bp, Oryza sativa
  unsure (1)..(864): unsure at all n locations
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgaaagcattttcgtcaatgttatatcttgaaaatgtttcaggaaagatggtgtatgggtgggccacttgctctctgggtattctttgccaatggaggaaccgaagcagatgaatggtaaaaatgtggctgacgttggcggtatgtggaagcattccattaaagtttcatatgaagcaacaaaagcggctttcccaggaggagagattattgcacatattgatcaaaagtaagatggcttaatctatagctaacttgtgttccattagaatacactatcttttaatgaacattattctatttcatgttttgggtacacattatttaaaaattggccatcctgattcatcagtaaagattacaaaacaaccatttcaaattttgccttgacggtacacatatataattgtatccagcaatctagaaaatcatcaaatgcatcagttgagggcattcttatcactggaattttataaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgg

SEQ ID NO: 6596 - DNA, 886 bp, Oryza sativa
  unsure (1)..(886): unsure at all n locations
cgcgtgacatgtagatcctcnttgatacaacnnnnnnnnnnnnnnnnnnnnnnnnnnnnnnnnnnnnnnnnncgtgcggctattagaaacccctcatgatttggacgaaccaagaagtctcaggatgttatttgtaaatatggtaaccttctgtttatatatatttaatatagcgcagtaggagcctctcctgctgtttcccgtcaaaaaaaagtctcaggatgttctcttcgtacccaatgcagcagaggcgaagccaggggatctggaggaacccaggcctccccaggccaataacaaccctaccccacccccaccccctcttctctttttcacataataatcatctttttatcacctagtggccatgttcagctgctggttcgcggctgtggcgcagccggcaccaacagtgccgcacgcacgcggcgcagttgccgtagcaggcttgctaaacaggcccagaatgtcaagtgtaaaatttgatatggctatggtatactgttcaaccatgaactaaaccttccatgctgtaatgtacctctacataatttctaaatgagtaaaatacacggccaatccttaaagttggagcgaggctgccctcaaagtcatcaatgttaataactcaaaaattgagaggtgatctttccaagggacccctaagacgccaaaggcaataccgatcagacttccagattcccttggagatcgagcggaggacaccttttgattaggagcgactcaccatcttcttttccaccgtaacacccaaagttctgtgtggcttttaaggggaacaaacggaagcattatagcgcttaccctaaccacatgtacccaccactatttgtgggaggctatgattggcttccaccataccaat

SEQ ID NO: 6597 - DNA, 1072 bp, Oryza sativa
  unsure (1)..(1072): unsure at all n locations
ccgcgaaggagcacggcgcactcgaccacgaggcggtcgccgcggagcaacacccccgacgcggcgaggtcgtgctgcaggatgaactccgggaagccgaagcagccccggcctacggtggctggacccgggccgaacacatggtacccgcagcgcgtgtacgagccgtcgtcctcgccgccgccggtcatcccgccgcggcggtagacgagggtgaagtcgacgagcacgcggacctgctccctgtggtcgctggagacgaggcggaggaagacggcggcgtaggggctgccactgtagtagccgccggggaagaagaggatgtcccagaggtggccgccgaggctgaagagaccggagatgacgggcttgccggagctgaggccggagaaggaggagtacggcgtgatggtgaggcgctgcgtcgacgccgtctcccgggtgggcgcccgatcgccggacgacggcgaaggtgcggccatgtcgagttagattggaattcgattttgcttaggtttgtcgtaataattagtaggaaaattttttgaagaggaagccgtgcttcattgatctttttgatcatggcgaattattacagtgtcctctagatatactccaagattatatcaggaaacataatatcactgtattttttttcattactactccaaattatacccgtacgttgcaacgggtaaactaaaatacccgtgcgttacaacgggtaaactaaaattataccaaatataaaaatattagatgattgagtcccactccggtgctttctactcggagtagaaagtaatttgggccattggtcgtatttaattgtagggctgagatctagttctactcccaccagtattagtattagtggaagtagaaatatggaagggtgttttcgtcaagggaaaaaaatcgcgtaggggtattatcgtatttttcagtctcttacccaccctatccctatccgattcctctcgcatcgtcgccatttcannnnnnnnnnnnnnnnnnnnnnnnnnnnnnnnnnnnnnnnnnnnnnnnncaaanngggnnntcaactttacct

SEQ ID NO: 6598 - DNA, 953 bp, Oryza sativa
  unsure (1)..(953): unsure at all n locations
agctgtcgtacatagtatcctcaatgatacatcgtctnnnnnnnnnnnnnnnnnnnnnnnnnnnnnnnnnnnnnnnaggataatatttacatcaatccacaaactctcatacgttcatcttaaattgcgcttgtttacttggggtttgtccggtgatgctttcacatgtctcacttctttaccatcaaattctatccatacatggtccctactattatacacaccataggttgatttttctactgcagagaatggcttaggattatgtgatttaacatcggcttaaccaaaagtataatgagcctgtcattgattatattaagagatttacggatgttagaaaccgatgttatagcttgaatataactgatagagatttggctggtcttgcttttaatggtttaattgctcctcttagagaaagactagatggccaactgtcacaccctgaaaattcaaaatatataaattgttgtttaaatggaatttttagaatttattttttaaaagtcttgaagagaagatctaattttaattaataaattccaatataaaatgggcccagataaaatttcattaaatactttgcttaattctataattcctagatttttctgggatttatttgagctaaggaagtatttttaataaatggaattacatttaagaaataatttaaattgaaaaaggttttaaaaagtcttcttttgggcccaaaacccttctctctctcctcggcccagtccggggagaaacaatcggttgataaaagtgaatcatctccaaaagaagacatggatatcaacatggtttgtatgttgcctatggagttttgtgctatggatgaagccgaggttgctcaactttcattaggtcctaaagatgcggtttttgagaagcccgatgaatcaaaccgtcatatgggtaccgagtggacatttcaaangcacact

SEQ ID NO: 6599 - DNA, 1384 bp, Oryza sativa
  unsure (1)..(1384): unsure at all n locations
agagatgnntttgtanaacctcatttgnnnnnnnnnnnnnnnnnnnnnnnnnnnnnnnnnnttttctaaaatttactctttcataaatgataaatctaaagaatgatttccgttttgcttcttctgtcatgaacttctgcattgcctgtgcgggcgcaacaatctatcgtcatgtctgttggcagcaataatttctaaatgaccacttgttattgctacgtgttattcatcaacccatacaactggcaagcagtgattaatatgcgatgtaatgcgctttatttgtcatgaccctgttgcccccatttttattcgcacactgcttttcacgttaactgctggaaaagaaatttatacaaattcatattcatgaatatgcaccattttggattctaaaacaaattaaggacatgagtacattgttggagttctaattacatgatcttaagctttagtctataaacaatcaccttttgcttatgcggaaaaataattgatctactgacctgagttagaagccattaccgttcttctttcttcttcttccagagatgcctcacgaaccccttccagtgcctagatcgattgggcgattaattagggtttgagattagagagagagagagagtttggtcgtctgcctctttccttctctttctttatataggcgacactggtggggctcgggggttatctcaattagtttaggattctgttttctgtaccgatcacataaaaaacaaatttatctcttagtttgtttcttgtcaggataaggaaaccgatggtttagatcctctcctaacccttatcgacacaagtcgacaaaatcaaccaacattctccccttgattttgagacttacttacgagtttattaaataaaatagctccccaaggcaatgtgtcttcaacaacattatgcgtcactgagacaacaagacctatagctcactatagtactcaaataaactcaagcttaacttagtgggtgttgattgaaaaatttagtccccctcatccaggatctcagtaaggctctaatttacatatatactggccagaacataatgttaattaatcttaattttatgagcctttagagtatggatccattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6600 - DNA, 763 bp, Oryza sativa
  unsure (1)..(763): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcattcctcccgccgccccaagtccggccagtccgaggtcgaagatccagcgcccgcaaaggagcgaaggcgggagtctgaccggcgtgaagccgcagcccgccttcgggaagctgaagaggccgcccgggaggccgcccgggttcgccaagcggagaaggctgctcggaaggaggccgcccgggctcgccaagccgaagaagctgcccaggaggaggccgcccgggctcgccaggctaaagcggcagctgctgctggcgcgtcactcgggcccactccctcgggcggccctcaggcgacatcctccgaggcggctcgcgacgaggccgcgggcgcgtcgcctgggcctacctcaccgggcgacgcccaggaccaaacgggcccgggggggtaccgagctcgnattgcgcatgtgtcnctaagttatcagtcaccttgcccct

SEQ ID NO: 6601 - DNA, 723 bp, Oryza sativa
  unsure (1)..(723): unsure at all n locations
acggccgtgagaatcgattcctatgggcgaattcgagctcggtacccgtactcagtcttgctctacttttcccaacccccagagtgcgagtatatgtcggatgaaggtttttccccagagtaggcttcgtccgtgccgtccaggatgcctgcggagtggtgttcccgctgcagttctagtcaaggcttagctcctgttgtctttctttctttcccgctgcagttctagtcaaggcttagctcatgttgtctttctttctttccgccgcatttatgtaaagacttctatgatgtttgtcagacttggaattctattcgggaatttatgggcgtgacaaggtgccccgccttcccccaggccgggaccgcttacatctgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggtttaacgctcctgggtcactgattggttgcctcggccttaagtttgggg

SEQ ID NO: 6602 - DNA, 776 bp, Oryza sativa
  unsure (1)..(776): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagaggggggttgattctttcccagattatgagcttagaacgggggagaagtcagctgaaacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcaactttacacatagatggttctttctccataatacttctttgaacactaagatattgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgtttgagaacatt

SEQ ID NO: 6603 - DNA, 720 bp, Oryza sativa
  unsure (1)..(720): unsure at all n locations
cgagagcatttgagtntacgtttgactatagggcgaattcgagctcggtacccatgtcggtgggttgcgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgtttgctaaataaaatgttttacaaccgcctttatgcaaatagccacaaacccctccttgtatccccttgcacgtccgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6604 - DNA, 729 bp, Oryza sativa
  unsure (1)..(729): unsure at all n locations
ncgtgattagataggcangtanantgcannnncncannnnanagganncccctannggnggcctgataccagccatcttcagcttatcagggtcaattggtcttgtaaatagcattactggctcctcaggatcccgcatttcaggaacctgttaaatcatgatccaaatataaacatgacaaataaaaaattagatgagttgccatgtgaacctaaattttagtttcactatccaacaactatctagagcaacagaaattgtgcctagcaagcccatcaatttctggctgttctttcagacaaatttgggaattaggggtgaaagaagtcaaaatagataggaaaatgctcaaaaggttttctgaaccatatttttatgagaattgaaaatggtaacaaatgaatatgatgaggaaaaaactgcgttcattacccccgtaggaacctattgttatacatcaatgcccttcgggttaaagaatgcaggtcctacttttcagcgtactactcgaatttctttgggtagtcaaataggacgtaatgttgaggcgtatgtcgatgacttggttgtaaaaacgcgcaaccaagagaccttactttcagatctagcggaaacttttgagaatctccgctccgcccgcataaaactgaaccccgataagtgtgtgtttggtgtacctgcgggtaagcttctcgggttcttggtctctgcccgaggcaatgangcct

SEQ ID NO: 6605 - DNA, 723 bp, Oryza sativa
  unsure (1)..(723): unsure at all n locations
gtggccntttgattgacatttganattcgagctcggtacccttagaaagtcaaaaaaacagttaggagagaaaaaaatcaagtaattaaagagaatcattggttcactgtcctcctcgcgtatggtgtgatcggtggcctctttccgtgcgttgcgagtccctgatcccctcctgcacatgtctaacacccttagatcgacggattgggagtgagaaaccacatccagcttgtgaagagcgagaaatatggagttgcaaattaaatttttgcatatctgtagaggggaactgttggagccgatttttcaaaaaaaaaaaggaaatccaaaatgttgggattggtttcattttgggggtatgctcatataaaactctagggtgtaagctcatggggttatttggatttcttcctgtcaatatccaagtttcagcttgtatggcaacgatcaggaagggcatgaaaaataactatggaagttgacaaagagaattaatatcagaatttaatttttagtcccatggtttgtttgccaagagaatgaaaggggattggaagttttagaggagtgagttatgggagtttcatttttttattcccagtcttttatttggtagtagagatgagaatcatgggtagtatggatgataattgaattttaagtgatgatgtaaagctcagatttatctcgtcatacttagaaaagaaattccctagaaattac

SEQ ID NO: 6606 - DNA, 816 bp, Oryza sativa
  unsure (1)..(816): unsure at all n locations
atcgaaccactttggtctattgtgacaacatcattgcagttcagcaccagcacatcaagcacgtcgagattgatctccattttgtccatggttgtgtgactactcgcactattcaagttctacatgtgtgaactacatcccagtatgctgatatattcacaaaagggttgccgactgatgtcttctttgagtttcggtctagtctcaatgtccagcctgttgacgttgcgattgccgggggtgttagcatatctcatgtatatcgcatgttttctttcttttggccagtcctcccaatatccctcccaggcatgtttctataaactggttgagtaggatactaggataaggatgattatgtgcctatatgtactcggcgttgtgatcaatcgatattgtgttgagtccatcaatctaagagtctgttgggccactcctctcaggctctcacgatgcctgcgcctgcacacgctcttgcacttgacgtggccgatctcacatcagtcatggaacaccaatctatggagcttgcatgattgtgacgacacctgatctctatctgcaactctgtgtctccattttctcatcctggatccaatgggtggcggtgagaacattggggatattatggaataagttcaccggaggtccctcaatttaacaccaagattttttgagatcccttaaccacaaaacaagaaatgtgcacccctaaacttatataannnnnnnnnnnnnnnnnnnnnnnnnnnnnnnnnnnnnnnnnnnnnnnnnnnnnnnnnnngcggaaataacagggcgtgcatttcatcggcg

SEQ ID NO: 6607 - DNA, 21860 bp, Oryza sativa
  unsure (1)..(21860): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccagaagtgaccgagttcaatgaggatgcggcatggcaaattatcatggcaaattatccctataagaactttatgttttccttttatctttaggaaagtttcttttttgtcctaaaagaactagtatctccccatgggtataaatatgtacacccggggtcattataatttagctctcgatcaataatactctcggcgcatcgccaccctcttttctgaggtttttacttatcaaccgacgaaatttggcacctgacgcggggctgcatctgttcagttcgatctccggcgaatgggtaactcctacgttccgccggtgcaggcaattgtcttgtttacgttggtgtcgtttaaggctgcatcagtacattcgacctcttggattgctccggtttggatgatatatttgtctgcctatttatcatatgtcttagttagtctaggcttagtatctcaatttagctctatcgattgtctctcgctttagggtttctgtcggtatcggctaaattgttttacaagattagattagctaaggcatctaccaccctaaaaatcagtcaagggcttaattttctagatatgatgtttcttttcatacttagtgttgcatcagttaagtttgatctactaagtcgtgtttagaaccataatccctagcctgctttttgactgccaataagggtttcatcgggatttcagccgatgagttatctggatgttgcatcggcttacaaggattacatacaagttggatttagctgatggcaacaaaaatttcactgtttaatctaatattgtggatttatgacattggacctccagccgatgtatgctttaaccttcggatcagtgcttattctatcatgtcattgttagccgattggtttctactagattatattattgatatattatattatcatcagtcgattgtctttatatcattatccacattgggtatatagcagattgctcaaaaccatatcgctagcggctggtatcggcatcggctggaattattcctttggtttgacaaccgatcggctcattggtctactatttgtatatcttgtcagttgcagcaacaaactgactggcacgcccgcatctcatcaacctttggacctgcactggagctaagcacatctcccaggccagtgtgtgtttttcgcatcaacacctcccctccctaggaggtcttctatttatacccatagatgtccccttgtccaagtagaagtagagagacaagtatggatataatccgagtagtccatatagtttccatgtagaactctgcttgtccttccttatccggaactccttctatatacgaggtatgattccgtataaggcttcgtacaaggtgggccccgctgaccttaatcgactaatattgggtatgtgttatccataaccatgacaatattgatccttcgtttcacaattggtggtgtgctttcagaaatgatattcttctacatatgtgtaggacaaataaaattcttaaacaactagtttttgattggttgcacagcatttaatttcttttctggaggtgtttacctcttgtaacattcgctgtaaatatagttttttctcttttacaaaattacactactggggaaatgtctggtagcattcaatttcaaaaaaaaaagaaatacataacatctgatccatttgatatagacccaaccaacatgattctatgtaagccacataatcatctatccaccaatttcactcgtttaatgggcgccaaattctggtacttttggggtcatgatgctaagaagtatactcattggtctacttctattttgttgtgaaggtagatagcaaagttattaaatttgtcaattcccctttgaacattatgtatagtacatagctagttatcaaatgtagatcacttcaaaattgtttgtggagaacaaaagcaaattcggccacactacatacagtcaaatacctcgatacaaattcagccattgggaagttaattcagccaccggaatctaagtctccatagactacatagaacagaacttaacacaacagaaatcaaatgaagggtgttgtgtccctgatgttgcagagcaagatgcagggtgccgagagcccgagacgcgatgggggaggagactgcggcagcagcgacacagtcacgcgcatcatgggaaatggcgtggggcttggggggtggacaggttcggtagtgttggtcgcaacaccgtagccacagagcaagtacgcacagcagggaggataggctgcggtggtggctataggtgcaggcggcgacaatgacacatgcgaggtgaggaaaccacattgccgcaagggaaggagggtgcccctatcatacccccgatgattgaacggtcagatttcatttgatacatgcttgtacaaagtacctggaggtactaactgctggaccggaacaaaacacattttagatggaggtagtaaatttcaagcacccaagtttaatcccaaaattagtgcacttttaaattactactctctccatcctaaaattagcaacatagtatgcaatgagacatcctagtattatagatgtggacatagcagtatctcatcttatctcatctcatacaaagttgctatattttgagatggaaggagtatatgccccatcagttgaagcatgggtactggtcggcgttgctctcagtccgcacgggtggcaatgccactcaccatgccgtgcctcccttcctcccctccgtcgctgtccaagctagcaatcggatatctgtgcagcggcaaggtcaaaggcggtgggggctgcttaccagctccgcaatggttgaaggcaagcagtagctatcagatctgggtctccgctcctaggtctagatgtgtggtggagtggtgacagggatcctctccggttcatcaacaatgatgcccctggcttgcggatggtgccgatatgggggctttccccagttcgtggatggcggtgcaattagggcttctccccggtttgctgatggtgatggtggggctccattcctgagggtggtgacagggtgcttgaccatgggactaggcgaggaggtgatagggtggtatggcaacggtcacgattgtgggaggcgacgatagtagttgaggccagtcagccaggcggttcacctggatctggcgggggtggcacgcaagtggtggtggactagcggctctaattgctggttagcttggtgttctccggtgaagcggtcttggacatggccaactaatgttggttgctaagaagactgggctaagcaggggagcatcgaggtagcgagcggccgggtgagcgagccgggtgagcgcctagatccggtcgcgtggtgccaagggcagcggtcatggtggttgtgcttttggtgtggatggcaaagatggccctagggcagtggctaccagaattgttctttcttgtccagattggtcgagtggattgaaggcaagtgttgacagtccttaaatcataatatctaaccgtcaatgcctacatataatgaaataaaatatggtatccaaactagtgttagggatattactaatcatttccgctagtgttggtgaaatatatgtatgcatgtattttaaggagaaaacacatctgtcctgtgacaaaatacacctccggataatcaggacacgtttacatggattggacggcggaaatgctactgggcgggcgagcgccctcgctcgcccagagcgatcggttccccctcccccctccccctccctctctccacctggtttccttttttggcaccgcattactttcctattttagtaaatttatgcacctaaagtttatacacctcaagtttacacatttaaagtttagagaccaaaagtttataaatcaaaaagtttatatatccgattcaaatttgaatttgaattcaaataatttttatatatatagtatttctatacatctaaagtttatacacctaaagtttatatatccgattcaaatttgaatttgaattatgtccgattcaaatttgaatttgaattcaaatatttttcatatatagtatttctatacatctaaagtttatacacctaaagtttatacacctaaagtttatagacctaaagtttatatacccgattcaaatttgaatttgaattcaaataattcaaatattttctatatatagtatttctatacatctaaagtttatacacctaaagtttatagatccaaagtttataaatcaaaagtttacgtacccgattcaaatttgaatttgaattcaaattttttatacataaatttttctaactttttgttttttttaaatttttttgtggtgtactgtaataggaaaagaaggggaggaggaaggggagaaaggagggggggccgatcgctggatcgctcgcttagcgagcgatcgcccatcaagcgcccccattggagggcccatatgtcaatcaaaaccacttagaattgggccaaatcatagcataggatgttgggggcccattaagcaacctcccggccgaaagagaggtcgggacgagggtttttgggtatgtccgaaccaccaatttggccgaacccatcctgaggccgttgattgccatatttcacgtgtacgctcctgatctctttccaatgacggttggagggcatttaggacatttcccatagctataaccgtcatttggagcctataaaaggaggagctcacttcatttcaacacacacaactttgagctgaattacaagaggcacagggtgagggaaagctctggaggagtgcccggaagtttggcgctctctccgatttctacctcaacgagtgtagctttttaggaggaattctggaagagtatcggagttgtcggtacactgctttgggttcggagaaacttcttttataaagtaagcattcgggatcatttcttatgttatttaattatttattctaagtaagatttccatctttgtgggttcattgtttagtattcgtactaagtgcaccagttctagtactctggataaaaaagaaagttcctgcgcaagtattagagtagtaattaataacttagacgtggtgtctagattagagcactacaataatctatgacgaaaaaaattcgtcatggatcactgaaaattcgtcatagtaatttgactgtgacgattctacgtatcgtcatctattgagcatcacagattaaatctgccgacgttttctccgaaattgtcacggatcagcacaatctatgacgttttttaaccgccataaaacgcttttgggctcgtgtagtccagccagtcccaacctttgtgatgaaattaaacgtcacggatggttgccacgtggcggccaaaatggccagtggcgtggtcgttgacacatgtgtgatgacgtgtcactgatgatgtggtagttaatgtcagcaaatatttttaaatgacccattatttttttaacggcccattatttttttatggcccattatttttttaacagcccattaattttctactgcagcccattattttgttgagaactgacccattttaaaataggcccattttagaactaggcccatttcagaactagcccattttatcaaccaactatcatatcaaagcccactaaacaggcccattaaatttgagaccaccaaattcaatccaatttctcataccatctcagatacaaacataatggcagataccatctcagattcaactaaaaacagatacaatccaaatacaacaacattcaaacaatagttcatctcagattcaacctaataacaaatagtctcagatactctgcttgcagaatcaaacaatagttccacagcaagcaacaaaaatttgtgtagcagaaccaagctaccaacttgtccaagttcaagaatcacacaacattcaagcatacacagttttggttcaacaaacacctgaaaacactttcagcacaaaaaaaattgaaggtccaggttcaggttccctccacaccagcaggacggcaccaaaaatgaaccttagtaaattgcagccatgttgatctgtgcacatactagtactaggtgttggggttatattactgaatatgcatccttagttcaataagcaagacataattttcatgagtgattggccaagatagtatcatctaaaatttaatggactcttaataggataattcaagtatagatcagccatctcagtgcatagttgatagcaagaattatcttggatgatctacaagtgcatttgagttaagcattatatctgtatatagttcagtaaagccatcatagaatgaattttgaatgcatgcatagttagaaataatcattgttctatttaacctcaagaggttaagataactagataatatcactattgtgctactatttctagttaaataggcagagcctaaatgggtagacagtaatctatttctcagtatagacactaaataaagcatctaggatccattggcagaatcataggtatcaatattaggtcagctagaagagcagagcatatttagagaaaagaatgacatctattaggtcttgttcagttactagggattaaatccccaaggggaagcaaaccagggagggattgagtgaatcccaccatgtcacttaaaccctgtggggatataaattcctttctcctaatccctctattaatggaaaccctgtgttcggttatcaatttttttttttttgctactgatcaataggaacagccgaacaaccaccctacaatgcttatgtgcattaaaatgtgacagacatgtgtgacgaatgatcttgaaccaaaacaaaatgtaattttttaatggccgatgatcaagagcatcaatgcatatatcaactacatttgaatgctcatttcaactgcacgtttcgatatccgtaaaatcttttgctgatgagcaactgcggaatacatacaaatcttcatccaaaaattcgacacaaactggctgtcaacacgaactggctgtccaggttgtactgaaattctaaacaaatgagcatagaaacaaatgagcattgtactaatacccaaccaacagtgacccctccttccctgtgctgtgcacactgctcaaagaaaattaatgatcctactagtatctcacagatcattcgaaatgcaaatgcatgcatacatgttaatttaacctgtccttttcgttttcttgatcaatgctggggcaaaacatatttacaggtgcaggcttgcagctagcatgcatggggcaaaacagatttacagtgcaacactgtgatgagtcgcgattaaacagtcagatcagatgacaaactatgccaatttatgaaacaccaacttatattacctttttttagataattaacaccaacttttatattacttgtaacaatgaaagcaaagaatgccatgaaatataactgaagaaatcaagaaatccaccaatgtgcagcaatcaatcgatcactagagattagctagctaagctcagtaattaagagaaaggaattcatataagagccttcgcggagaactctatcagtttctatttggttaccgaagctaaatggacccgagctgttgatgaccgaatagaaaggtttattttcaatggcatgtcctagatgatgtaggctttgcttcctcagcattaaaccaatcttcaggattctcaagcgtttcagctatttctagatcaaccaaaagctcataacttggtttattcttcggttaccatatctttgaatgacaaagtgcccgggaagaaagatctagatctctatcatcatctatctctatatctaaatatggaagaaccctcgaagcctgtccccgacgacgatgccccctgggtgaaaggaaaggggccgccattctctttctttcctcaatcgttccgatcatttctctcattcccttttgtttgtttggtggggccccgggttggttcgtttattcttttccatgtattagattatccgtccgagccatatcaaattaaaaatatctaaaatcaaattcaatatagaaattggaatagattctattagaaaacatatatatatcgatcaaggatgctgaagacatcccagcgtattgaagtacctaattatctactggcccatccaagaaccaagggaggaggaaatctaggtgacacatcaatgggaaagaagacaaattcaagaatgccgctgtttacacccaaatttggcacctagggataaaataggaaaaattgccaaagtttggaaatctgccggtttcctccgagtgggccggtttgaccgccatgtgttggccggtcagaccgccggtcgaaggccagtcagaccggcggtatgtggccggtctgaccggtagagcccgagttcgggtctgtttcgccgggtctcgaggtttccttgctcgggaaggcatgtttcgggtttcctttgaattctatcctgagttggacgtggaggaggcctgtagagggcaagaccaactcctatataagggacatggccggttcaattataactaaccaatctacaatcaatcaatcgaatcgttttttatattgcttttagttttctcttagtttgtccatctttgtcgatttgtgccgtaaatcgtccgccgccgctgcgagagtgcgacacctctttgtaggtttgtcctgaaaaccttccgttttgcccacgagacgggtagttatctagaatcggctctgctagccggttttgttatcaaaacccatcttggtttagcttttgctagatcgaggtggttggtgactctaggatcaccgcaaggcatttaggtgctgcgatcgtgcttgtcaacttgtcacaaaaagttgccaacacgatttttggcgactccactggggacatctgctcaacgtcaactcaacttcgacctcaccatgacgaagccgccgtcatccaaggcggaggtggagctggccaatgtgataccaatcatatttgatgatttcgaaggggaagatcgcaagtccatggaggagtacattaaggagatcacacaggaggcgctgatgagggcgtgcaccaggactcgtcaaggcgtgatcatcaagcctaagccacgtcctaagcctacttacgatgtggtaagtaatgaggaggtaacacaatttatccaacaacacattgcatctacaatagattcatctatgattactttgaataataagttaaatgcatctattcagaatcatgttgaaggatttttgaggactagattcggccctctcgtggccgattttatgttcaaagacaaagcctctaccagtgctagccaagccactatagatcagataagtagtataaccaacggggcgaaaacacaacagcacggcgaggggtgggcggcgcacacagccagtctaaccgggcctggtggccggttagatcgcgatgtcgctgtcggtcagaccggccagacggccggtcagaccgggtattaccccggcggtcagaccggaactcaggccggtctgaccgcgccactggacgtcggtcaaaccgggtcttgggccggtcagaccggcacaatcatcccaattcagggggtagatccaatgacaaataatgcttatttgtatcatcttagaacatttgattcccctgtatctactgccactacttgtccccaaattctcctacatgttcctaatgcttataatgatgtttctagggggtatcctcccgatactaggcaaggccaatataattatattgcgccgcaaccacaacctattaggccaccaaacccaccaccaaaccaacataggcctgataatatggaggaattgattagtggaatcattagggataaattcaggattgaagctaggaatcgtgctaaggtttaccaaaagccgtatcctgactattatgacaacataccatatcctcgtggttatagggttcccgaatttaccaagtttaatggtgaggatagtaggaccacatgggagcatgtaggtcaattcttagcacaatgtggagaggctagtagttccgatacttttaaattgcgcttgttttctttatctttgtatggtactgcttttacatggtttacttctttaccggcaaattctatacatacttgggctcaattagaacaaaggtttcaagattatttccatactggtgaaactgagtttaggttatctgatttaacatcagttaagcaaaagtataatgaatctgtcataggtttagggatgttaaaagctgatattatagtttaaacataactgatagagatttgtctgatcttgcttttaatggtttaattgctcctattaaagaaagattagatgttggccaacaatttcttgatgttagtcaactcgtgcaaaaggcactagctcaggaaagccgggttaaggatagcaaaaaatttgttagaccatatgagaagaagcctaatgttaattcaattgattaccatgaggctagtgatagtgaaggtgagggtgatcatgatatgtatgttgcctgccgccgagccgtgtgcgccgctgccgattcctccacccgattcgctcgattctctgagccgtttcttgaattagttgaggggatttgtttcccttatcctcctctatctcttcccccaaaaaaccgactttatccctttgaattcgacgcgaatttggattcgttttcgagtttatgtctccaccaaaccctaggttttcccggcgcgattccttgcgttccaagcctgatctctctctcccgtcgctataaatagagtcccctccctctcctctttcggccgccacctctccctctctatgccatcgcttgtagcgccgtccccgtgttcgccttctctctccgccaccggcagctgctccagccgccgtttgccgccgcctcagctgatgccctcctgtgccgccacctctctcggctctgcaaggtcaagagcaagcccggcagccgattcccttgcaccgaagacccagggaagcccgtcgtcgccatcaacccgaagctcgccgtcgtgttttgatctccggcgaggctctgctgctcctcccgtcatcgccaagcttcgccgccgcctccattggattcgcagctgcgaagtgaagcctggccacccctgcattgtcgccgaaggtcgccgaaacactgtcgccgccgtggacagtacctcgccgccatcccgttctcgtcgccggccatcttccatcgctgtccgtcatcacgtaagtgttggtaagaatttccatcgccttctctacctcccggtgccctccgtttgcattattgtgtcgtggttcgccggcaaccgccgctcctatgtcgttcaccggtgtagtttatccctagggtcttaatccaatataatccaatccgtggttggtctagcattgtcatctccgtgtgttgctgccggaacgttgtcatcatcccttcctctccgatcgctttggttcggtgagacttctattcgttctctcttttcaatggcatattatttctttttaatatatgtcatctaccaaatataatctaatattttccgaaggttgttttaatcttttctctcagttataaatcatttataaatggtttaattaatttggaatagtcttttctttaataggtttaattggaattaaatcttgtaaaattcgtaattaatttatatgaaatcggaatgagaccgttcaagtctcataattcatctaaaatcatgatctacatatttgtttacttttatgtactgtttatttggtttttattagtctttttctttgttttgcgtgttagcttgtcgtttccgtcgttgcgaaggcaagtcacacagatcctaaacacaattcctttgagcttgttgatcctatatttaaattctctatttatttcaactgtgcatttattttcgaatgtcatcgggtggtgtgaacctattcctttgttatggccaatttgcattgaataccctattccttcataccttgggtaacaaattaattagcttgaaccttatatattggtttggttcagctaatagctatatatatatatgtatgtatatatatatatgtatatatatataaatgtatatatatatatatgtatatatatatatgtatatatatatatgtatatatatatatgtatatatatgtatatatgtatgtatatgtatatatgtatgtatgtgtatgtatatgtatgttgtgtgtgtgtgtatgtatgtatgtatgtatataataattgcttagccatgcttagaaacattagctcattaatgggatgaatcacactacattattacttatggttatatttaattgtagctcatgatggttaatcgtgttatgataattaactgataattaaaatttgattaatggtgggttgtgagcacatggttttgaaggtcgtgctcatgacaattaaggaccggtttgcgagctactgttgtgagacattaaccgtaccaactacaagccagcgtgggcaacggctttaccttttgtatagcatggttctttacggggtgctagactgagaagcggtgagaagtccgtgggggtcgctggggagtccatgcctctggttatatttatagagggggtgattatgatccaggaatggtgcattgtggtgagttgtgttgtgcagagggtattgtcacaacctctattcgggtactttccagtatcgcgacgcatggtagacatgatgttgaggctgtgtcttgtgggtatagtggtacacctctggccagagtaaaactattcgaatagctgtgcccgtggtcatgggcgggttgagcaatgtttttcgtgattagtctcacacctctcacaataattattgatgctataactggtaataatttgtttagctcctggtttggagttagatctgtacagccgggtatggttgttcagaatggttgggcctgagcagcatgggcgtgttgttcagtgttgattaaaattaatgattaaattagtttattgttttactactcttaaatgtttattaaatgctgcttttgcaaatgagcctatattatgccattctttggtatccttgtgcacttgcatatttgctatgtggcttgttgagttgtcatatgctcactttgcaataattaatcaacctcagttgaagaaaatgatccagaaggagaagacgtttggcttataccccagttgagctgcctatgggagtggagccggagcttcgctagaccattaattttgctgttgttttcttttcttttgtaagtatgtaacgatgttattatgatggatttgtatattaaattgtcagtttgtgtgcctcggctgattccgggacgagggttttatgcacaaataagttcggaaattgctagtgagtttccgggcgtgacaccaagtggtcatgggactaacaaaaacaagccttttgtttgttctaatttaatgccgactcctcgtaaagatcggcaaagtaggattaagtatagttttgatgtggccaaatatgataagatctttgattatcttttgcaagaaaaacaaattagattacctaaaggtcatattatatcatcttaagaagaattgaaacgtcaagcttattgtaaatggcatgattctcactctcattctactattgattgcaatgtgtttcgacaacaggttcaatcggctataaatgaaggacgattgaagtttaccgatggttccaagatgaagcttgatcatgatccttttccggtgaacataattaattttgatgataagaaggtattgattcggccggagcaagccgaatctacaaaggggaaaggaatggtcattggagagcctaggccaaaaatgatggtgccaaagaatccggaggttggtgtttgcaaggaaaataggagtgaagcttcaacttctagagttcctaagaagactaaggtgaccttcaatatgcttttggagaagtatgagaagcaaggcggtgagagagatcgcaacaaaggaaaaagaccaagatcacctcctagggagcgatttggtcattgaccaagacggtcggaatcacctccatatcatcattctcaagacatgtcatgggggccttacccaatgccgccgccgggttatccttatccttactacatgccatggggggcaacaacgccaatgttcaatcatatgcctccaatgcaattcaaccaagggtagggaggaccaaggaggccaattcatgagcatttgtcttcatcaaacaatggttggttttatggtaagaaccgggccaatggagaaaagcgggaaggaaagcgcgtcaaggtgaagactaggacttcggaggtgattaccatcaaagtggggtctcatgatgtgccaataccttctggagatgaagttggggagtcctcaagcaacaaatctgaagccggtaccagctcatcgaagtcggccgatctgaccaggccctctggccggtctaaccgcagccatacgggcggtctgatcgccaatccaacaacggtctgtccgacgcctcaggccggtctgaccgctgacctaatgtcggtctgaccggcacctccggccggtctcaccggtggtctaagtccggtctgaccgggctccagcgccagtttgacaggaggtttgcaggaagcaatgtaggggcttcctcgtcttcaaatagacttaacagggggcactatttacctcctggaacaaagcagaaacctaggtggatgcctgaggatttgacggctactccaaggagaaggttgcaacgtcttcgggctcaagagataagagagaaaaaggccgaagaacaaagagataggaggttcaatgagttgtgaccaccaccggtatggaggagtaaattcgtagagaaggaagaaccagttgttttgcaagaggaaaaggaagaacaatcagttactaaagatgaagcatctccaaaggaagacatggaggtcaacatggcgtgtatgttgcctatggagttttgtgctatggatgaagctgaggttgctcaattttcactaggtcctaaagatgcggtttttgagaagccgatgagtcaaaccgtcatatgaagcctctctatctcaaaggtcatatagatgggaagtcggtctctaggatgctagtggatggaggtgccgccgtgaatttgatgccgtactcgttgttcaagaagttgggcgtggagatgatgagttgaagaagaccaacatgattctcaatggcttcaatggtgaaccaacggaggcggagggtatcttttcggcagaacttaccgtggggaacaagacctaccaaccgctttcttcatcgtcgatgtgcaaggtaactacaatgtcattttgggtcgttgttggatccatgccaattgttgtgtgccttctaccttgcatcaatgtttaattcaataggacggcgatgatgttgagattgttcaagcggatacatcggccgaggttgcaatggctgatgctacttttgagtggcgccatgggaatattcaatgcttatcggggatggatctctttagttatgattttattagtatctccaatggcaaatttgtacccatctctgtaaagccggctagtttagcacggctaggccatattaatttatgcaatgactagagaagctaatttagggtggtagcaaaagagtgtgcaagaatattggtctacaaataacgatattggtgaaacttttgaagattttgatgaggtagagaagcttggacaagggtttacattggccgatccattggaaaaagtagacataggtgatggaactaagccaaggccgacttttgtaaacaaaaaatatgagatccggttataaggttaaagtaatcgagctacttatggagtatgtggattggttcgcatgggagtatcatgagatgccgggacttagccgtgatcttgttgagcatcggcttccaatcaaaccgagttttaggccttataaacaactacctcgtcgttttaatcctttgctatatgaccgagtcaaagaggagattgatcggttgttgaaggcggggtttattaggccatgtcgttatgcggagtgggtttctagcatagtcccggtggacaagaaggggagtggtaagattagagtttgcataaactttagagatttgaataaagcttctcccaaagatgaatatcctatgcctatagccgacatgatgatgaatgatgcctcgggtcataaggtgatttgctttttagatgataatgccggctacaatcaaatctttatggcggaggaggatatgtacaggacggcttttacgtgcccaggatttgttgggttgtttgagtgggttgtcatgacttttagattgaagaacgccggtgcaacatatcaaagggcaatgaatttaatcttccatgatttgctaggtattatcttagaaatctatattaatgatattgttgtcaaatcggatggtatggagggacatatagccgatttgaggttggcttttgagaggatgcgccggtatggtttgaagatgaacccacataaatgtgctttaggtgtgtcggtggggaggttcttaggattcatggtgcatgagagaggagttgagattgatcctaagaagattgaaaagattcgttatttcaaagcgccaacatgcaagaatgaagttcaaaagttgctaggtaaggtgaattatttgagaagatttatttctaacctagcgggtaaaatcgatgcttttgtccctatactgcgcttgaaaaaagaagccgattttacttgggggagggggcaaaacaacaagaggtgtttgaagagttgaagaaatatttgtctactccacttgtggtgcgggcgcctaaagccggaaagccttttcggttatatattgcctccgaagacaaagtcattggtgccgttttgacgcaagcggaagatggcaagggatatatcattacatatttgagccaacgtcttttggatgccgaaacgaggtatatctttatagagagactttatctatgcttatactatgcttgtaccaaattgaggcattatttgttatctagtacatgcatagttgcttgtcaagccgatgctattaaacacatgttgcaaaggccaattctaagtgggagaattggcaagtgggcatatgctttgattgaatatgatttggcttatgaaccgttgaaatctatgagaggccaaattatatgtgattttatagtagaccatcatgtagatattgcttatgaggaagaggtttgcttagtcgaagttataccttggaagatttattttgatggttcttcttgcaaagagggtcaagttataagggtagttttgttttcacctaatggcatgtgttatgaggcatcggttcgtttaatcaagccgaatacaatgctttattattcggcttacaagtgatggagttggttggagctaagcatgtggaagcttttggcatgaggcccaacaacgatattattgccaattttgataattttgctattagacatattgctaggcatgataattctagagcaaatgatttggcacaacaagcatctggctataatgtgaagaagggattatttctggtattagaagagccggtgcttgattttaagtctttgtgcgaaattggcaaaacttcagaccaggggcggtctgaccggcattgcacggccggtctgactggccacatgccaccggtctgacagtccaccccgagcggtctgaccagccttgcacggccggtctgactggttctggacagagcgctgggggcacgctgtaattgattcaaaggccgaattaattgtaaattcggacatttatgcccaggaaacagaggaagattggagaattcctttgattagatatatgaacgatcctacacgtaaggttaatcggaaaattcggcggcaggcgttcaaatacacattgcttgatgaagtcttattgaagtgtttagatgaagatcaatctaaagtggctatgggagaagtgcatgaaggaatttgtggaactcatcaatcggcccacaagatgaattggttgcttaggagagcggggttctattggtcgaggatgattgaagattgtttctaatactataggggatgcgaagcttgtcaatggttcggcaatgttcagttggcgctcgccgccgtgttgaatcctatcatcaaaccatgtccgttccgaggttgggttttggatttcattggtcaaatttatccttcgtcatcaaaggggcataggttcgtgctagttgctacggattacttcaccaagtgggccaaagccgtgccgctcaagaacatgactcatacggaggtaattgactttattttgaagcatattatccattgattcagtattccgcaaacattgactacggatcaaggagcttcttttatgtctaaggaagtgaagagctttgccgaatcttatggtgttaaattgttgagttcatctccttactacgctcaggctaatggacaagtcgagtcgagtaataagacattgttgaagctagtaaagaagaagattgaggaacacccaaagaagtggcatgaggtgcttttccgaagcattgtgggtgcataggatatctaaacatggtgccaccaaagtcactccttttgagttggtttatggtcaagaagccgttttaccgattgagataaatcttggttctctttgctatatcaagcaaaatgatttatcaagtgaagattacaagacgttgatgggagacaactttgatgagatcatcgacaagcgcttgaaggctttggaagaaatatagaaagagaagaagagcgtggccaaggcgtacaacaaaagggtgaaagcaaagttgttttaagttgaagacttggtttggaagacaattttgcctttgggtactcgatctagggagttcggtaagtggtctcctagttgggaaggtccttatcgagtatgcggcattgttcgaggaaacgcgtattttttggagacacttcaaggagagcgtttcagcgagcaagcaacgggaaatacatgaagaaatacttcctgagcgtttggtaggtactatggccggtaattggattatcgccctaagaccaaaaacatgttctatgcttttagattcacgttgatcatcaaaaaggcaggggggcatgtgtttataaccaaatttggcacctagtgataaaataggaaaaattgccaaagtttggaagtccgccggtttcctccgagtgggccggtttggccgccatgtgttggccggtcagaccgccagttgaaggccggtcaaacccgcggtatgtggccagtctgaccggcagagtccgagtcctggtctgtttcgccgggtctcgaggtttccttgctcgagaaggcatgtttcaggtttcctttggattctatcccgagttagacgtggaggagggcctgtagagggcaagaccaacccctatataagggacatggccggttcaattgtaactaaccaatctacaatcaatcaatcaaatcgtttttcatattgcttttagttttctcttagtttgtccatctttgtcgatttgcgccataaatcgtccgctgccgctgcgagagtgcgacacctctttgtaggtttgtcctgaaaaccttccgttttacccacgaaacgggtagttatttagaatcggctctgctagccggtttagttatcaaaacccatcttggtttagctttttctagattgaggtggttggcgactctaggatcactgcaaggcgtttaggtgctgcgatcgtgcttgtcaacttgtcacaaaaagttgccaacagccacctcaccagttcgtcgcctaccgccgccgccgtagcatagcgcgagcgagaaaccctaaccctataagaggaggggagaggggaagggaaagatctcaccaggcaaaaggtgaccaccggaagacagctgccggaggaaagagcgcccatcatcggacttggacgggacgaggcccgccgccgctggatctgggcgggacgaggcccacatcgccgcccactcgtcgtcgtcgtcgtcgaggtcggcgcctccttgtcgttgtcgcggtcggcgccgctgcggaggggcagcccgcggaggaggcagcccgagcgtcagggtcagcgcccactcgtcgtcgtcgtcggggccgcgtcaccggcggaggaggagaaggaggaggagtgggtggatgttatttatatggcggcgagccaacgacgaaggggacgggtggaggcttatctgaattggatcggctagggttagggaactagtggtgttgaagcaatcgctgatgcaattttacaaaagtacccatggtgtatctggagttagcactaaaattatgtggaaaaaatggtcatttcatgttgaaatttaggtcttcctcccgccgcactgaaagaaggggaaaatattaggggagggagaggtggaggaaagatgaaatattttgaagtggtgaggaggcaaaatttttattgcaaattttgaatcgaattttatggcactaaatcagctcgtatgaaaaagttgtaaaaaacaaagttgtagaactcatttagatctaccattttttttggtcatttcttcatccgagtttgattgaactatataaaatttgaatttcaaattatgacaacttcaaacaatatttttaaatactaaatgatttcaaatgaaaaagtcatcaacaacaaagttgtataaatcatcaatatctacaacttttgtttttgtcatttcaccatatgactttgtttcaataatttgaatttgaatttcaaatttagacaacttcaaacaacattttcaaatactaaatgatttcaactgaaaaagtcatcaataacaaagttgtataacttatcaagatttacaacttttgttttggtcacttttctatatgtatttgtttgaatagtatgaatttgaaattcaaattatgacaacttcaaacaacatttacaagtactaaatgatttcaactcaaaaagtcatcaacaacaaagtggtataactcatcaagatctacaacttttgttttggtcattttggtatatgactatgtgacaatgatgagaagtccaaattcaaattattacatcttgaagagacattccacaatgctgaaggagagctactgattaagtcatcaacagcactatgtgacgaaccatgaagatgtactaatttgaaattggtcattttggtatatgaccatagtccaatagttagaagtcgaattccaaagtattacatctggaagcgacattcttcaatgctgaatgagtccaactgagtaagncatcaacatcaaaggtgtatgtaactcgtcgatatctatagtgcttattttcgtcatttctgtgtccgataaagtgatagtgacatcgttccataaatttacatgtctcttatatgattttgaagtatttaaatcacgacgaaattgctataacgtcacaggttttgggccggtttaattagcaaaattagagactgtcacggttt

SEQ ID NO: 6608 - DNA, 19313 bp, Oryza sativa
  unsure (1)..(19313): unsure at all n locations
cgatatcgtgctcgggtcaccggtcaagatgtggaaatacgaaatcggattctttgaaccggatgtcataagccaagagacccaaaacaaaagtggtagatatggatgaaaaaaacaattttgttgtagangactttttcagttgaaatcatttattacataaaaatgttatttgaagttgtcataatttgaaaatttaaattttatataggttaatcaaactcaaatggaaaaataaccaaaataagataggtatatctcaataagttatacaactttgtttttgacaattgtttcaaaaaagttcatttattatgataaaattcgattcgaaggttactggccagcccttttgctcatccctctccgagaagtccatttttcctccctcctttcaattaatttcaaaatgttaaaccttcgaatcaaattttatcttactaaatgaacttatgtgaaaaggttgtcagaaacaaagttgtataacttattgagatctaccaattttattttggttatttctccatctgagtttagttgacctatataaaattttaatttcaaattaggacaacttcaaacaacattttcaaataataaacgatttcaactgaaaaagtcatcaacaacaaaattgtataaatcatcaatatctacaacttttgttttggtcattttgctatatgactctgtttcaatgattcgaatttgaatttcaaattatgacaagtgcaaacaacattttcaaatactaaataatttcaactgaaaaagtcatcaacaacaaagttatataaatcatcaatatttacaacttttgttttggtcattttgctatatgactctatttcaataatttgaatttgaatttcaaattataacaacttcaaacaacattttcaaatactaaatgatttcaactgaaaaagtcatcaacaacaaagttgtacaaaccatcaatatctacaacttttattttggtcattttggtatatgactatgtttcaataatttgaatttgaatttcaaattataacaactgcaaacaacattttcaaatactaaatgatttcaactgaataagtcatcaacatcaaagttgtatataactcatcaatatctataatttttattttggtcatttcttcatccgataaagtgatagtaacattgttcataaaatttacatctctcttatatgattttgaagtatttaaatcacgacgaaattgctataacgtcacaggttttgggccggtttaattagcaaaattagagactgtcacggattatgggccttgtatccatagttgcatatccgtgatgatctctaaaaacatcacgaaaattttgtcacggattaaatatattcttgtagtggagattacctttgtttgttgtgtatcccactaatttgttagaggtagacggtagctggtgacaaccctgaatcccgtcctagtaatcctccacgtttgggtacatcatagagctatagcaggaaccatgctggcagaccagtaggggtctgtgcccgaagcaatagataggaaattacctttaacttagcttagataattaaaacatatagaaaatcctttctagcctagccagcctaccaacagttgttatccttggactgccttagccttagatagattagacatgttccctgagttcgatatccttttggggtcaccgaaggtgatgtgctacagcagtattccgtgcgcttgtggatttatctatggtcataagaaataccaacgacaagttcattggcgatgcttttacagtggcggtgcatgctacaactgggatggctcaattggaccttatggccagatttcagtgtcctagtgagcaaggtgaagagcatatgaagtgatcgttggagaggtgctagtaatagcgatggttggagcgcaacactggatttggggcctgagtgtcattggatcaaatgtgtgtgtgctgggagttgttcgtgcaaagacaaatgacgttggtttttctatgcttcctttggacggtgtcggcgagcaaaggaactaaggtcgagagataccgcatctgttgaattggggtggcgaaggattcaattgtaagtggatggaattctaatgaagggtttcaagaattcgggctgctctcaggatcgtcatagtgcggttttgtgaagctaaagcaagatgaaaatacttttgaagcttaatcttctagttttgtgtattcgtgtattcacttcgttgttcctcaatcatgagggttggattctaagtatttctataacttttggttgtgtatatccacttatggatacatatgctagatttcgatctattatctaaaaaatgtctcatcaatcacttctaattcaaatttctccctatcttacccccaaccgtcctcctactattaaccatcccttatttaatttgggggggcatttatgtcatttatttttcatagtattttatcttgtatatattgtagaaatgcacttatttagaaatggatgtagtaaatacatttaatttgcatggaaagtttaaaacgcacacacacttgaggtaacctagtcgaaatgtctaacgactagcaatgtcccctttattttaccataagattgcccatgctttcgatcgttttaattcacaaaacagcattttccttgctccatgaagggacccagactatgctgcttttggggaggaaatggcacgcctccacgtccccaggcttggcatgctgctcctgcaagaacgggtgttttgggctccactgcgtcatgtccaggtggcacacggacaccacctccatagtcgctggttccgcactgccactgacctagctgaccagcaccaccatgtaggccctggtggccgggccagccatgtggcagtagaatactacgtacgggtatgtcatatcatggcaggtcaccatctctgatgactcaccgtcgccactggatccggtggggacgatcctatgcagggctgttatggcatacctcctacgtggctcctcggagacggcagcagcctctaccggcatgttggcagagaaagcctgtacgtgacgtgtcccgaggagggaggaggggagcttgaccaggtcctccatggaggtggcgcatccggctgtattcctgttcttctcaccggtgagcggtagccatgggttgctgtagcatttctctagcacccaccgtatctcatcggcgatggcgagggagactggcacgaacatgttgagaatgttaccaagtcgatcgatggagaacggttaaccatggctaggattagacttttattgggcaagagtaaaattgatgccccatggccaccgccgactcaagtaagttacttggcatccttattgtgtgatattggaaaaacacccacagtaaggtattgggctgagtggaaaccttggcctccacctcaagaaattggcactacacatattcgagtgaatcaatgggcaagtgcaaaattatggaccttcctcacttggacatcccctgttgcagagaaatgggcagctgaactgaaagaaaaaggcataagattggaagatgttgaatttgattggaaaactcttgatccagatgtgcaagaggtcgattacattacatgggtttgcagttaggattcttcgtaggatcgaaacacaaaaactaagccaaccagagggggggtgaatggttggtatacccaaaaaccgaaaacttttagcgaaaataaaagttaccctcgaaatcgatggatcgtggtctgaccgaagtggatgcgccggtctgaccgcctgattaacgtcggtctgacagatgtagatcgatcggtcgaaccgtcgaaatcgcctgccgccgcctgactgcgccgtcggtctgaccgccttagctctgccggtctgaccactgcctattgccggtctgaccgccggtgcgccaccggttggacagccgaaccccggtgaaacacaaatcgaagaactctcaaagtagatgacaacattattgcttctctctctgtttacaaagtgcaccaacagcactccttataaaaatctcgactaaactcgaaaccctaactaaactagcaactcaattgctctcaaaagcgataccggaaaacctcacgctccccccctatttatacatgaggtaggcatcctaaagccacgaaccaaactcatactaagagtcctaaacaccttaggaaacccctctagtacaagacacaaactttacataaccaatcgtaccaaatttggactccttccaaattcgactccgcatcccatacgcacacaatacctccatcgtatgccatatggaatcttcaccaaccacgtgcatcaactctagccttagtatcccgcataatatctgaccaccacggacatcgtcttacctccaagccgactcccggtccatcaccgaaaatactgtctcaaggcatcaagtcacctacacatgaaacaaacaaagaaaccatattccgagaccaagctatccccaacttgactcattgttagcaaacaatagtattacatacgtatagtatccatctagaagccataaccatgaaacaatcacggatatccaaagaaacaacccaaaaccgaaaccgacacagcgtcggccggtcagaccgtgggccggccggtctgaccgcacacatagcaccggtctgaccggcaacatccgctcggtcggaccggacacataaaataacagtgaatccgatcatcacctgaaaattgattatctgcaaaaccacttcgacgataatctccaaatatcaaaaccaataatcacatatgccaattgttcatcacaaattaagaatcaaaacacacattgatcttacaatctcccccttgatgaacacattggcaaacccatcaaaaatgttttggtgtttggaaaaataaaaaaaagcgataaaaagcacacttcgtataaatgtacacattggtctcaaaaatccaaaagaaaacttctccccctttttaaaataaagaaattctcaattgaaccaaaaacattgctcttctcaaaaactcttctcagctcccaaaagtccaattttttttatattccttctcccccttttgacaatgatttcatcaagcataggaattatgttcactaatgtataagagcttagcatacatatagcatatcatgtcatgtgttgcaacaaaaagaagataaacccatctataatataacaagcatgcattaaagtataaccatgaatcaaagattttacaattaagcttgaatcaacaatcgaaattcatgatttcatacaatttataatggaacatcttaacaagcacataggttaaagaataaacactaaacacatatacctattgcatttatcactctttctcaaataaactttagcacaaaataaccaagagaattttttgaactttttcttttcctgagcctgtttgctcatatttttctcttttatttcgggtacgcccctgtcgtcaagactgtttccagggattcggcacctattattttgctcacatcgaatacgtccttgtcgtcaagactgttttcgaggattcggtattcatttttttcatatttttattctctttttcacaatgagcaattaaatctatttgaggaataacaagtcaataaagcatatatatagagcatttataaatcaaaccatatgctagcatcaatattgcacattttcttaattcaagtgaaatttaagtgtcatgcatcatctcccttaaaaacaaaatctaaatctcatgaaaagactagaacacatacaagctatgctagagacaaataaaccttcaaagtattgctagcatgcacaagaaaataccatatgtatagaacaaagctctcttttctcaattttttctcattgtcatattattgcttgataaaaccatgaggtaaaaactcctcctcaaaacatgccaaaaggatttacgaataagcactaactccccctcaaaataacctccaattctctccgaacaaaaatcaagaagaaatcaaagattttgaaaaagacatccaattgccaatgatatcacaaagattctcatgaattgacatgtatacaatagtattaaccaaaactacaacctcaaacactagcatatgaaaagctaataattaagaatgtagaaccaaatatctgtcaatccaaaagtaaattgatgttaccttgaaaagcaatcgtcatcttaaaattgaatactcatggggagtatgacgccaaaatacctatgaacgagaagatatcgaggcctccgtgttggggttagaaataagaaattttggaatccaacactgagtcacacgaccagtagaaccagtgggtacatatgtactgaaaaaatcagaatcagacttaccagaaaacttacctttttgcttcagaaaagtccgatttgaatttcgcacaaatttgccccgaggccggtctgaccgccgcagtgcctgcggtctgaccgggcctggcaaccggtctgaccgccagttcaactgcggtctgaccgctggccggtctgaccgactggtcagtgtcggtctaaccgtggtcctcgaattaaaacccgatttttgccaacgttgtattacaaaagcaatttctctttcctttttctgtttatgggcaagtctaaaacaaaaaccaaccaaatgtccatcttttccaaaaaagaacaagtgtacttctcacgacaagtttgtgaagtaaatggttttgaaattgatggttttgcaacaacataaggttttgcattcacaacatttgatttcgaagaagatccattcaaagaagacatgatgccagcagatttaaacacagtgttcttaggctcagtttcaatcaaaatttcacctctcctagcaacacccaaaacagtaggaggatgtctagtatgatgagcataaggatcaaaacctaaaccatgattgtgtgtgctaaccttagattgatcaagaatcatgttgaggttctttttaccatcagacaatctttgcaacgaacttttcaaataagaaacctcctgagtaagaatagcacaatttttgcaagcatccaaaagacctttttattttctacaagttgagcaagaaagcacctcatcttgtttaacaacctcttccatgtgtttaacacgctctagagcatctttcaactttaactcattcaaaacacactttgaacaatcttgtgaaatcacaacaccattgttttgttttgccttatttgcacatgaagcattgaccaaagaacttgcacaaaaagcaactttgtatttttttcaaaacgttctttgtcaaaatcaactcatcaacaacacgagcatgtaaagcaaatccaagagcaaaagatgattccaactttttagatttttcaatctcaaattccaattttttgcaattaacagaattgacatctcgcaaagcattaatttcagaaaacaaaacttcacaagatttacattcatcatcattaggaatcaagattttaatctagcaatttcagcatttagaatctcaatagtatgatccttctcatcaagcgcagcatattctaattgatcataactaagcttttcttcattattatcatcagattcatcaacatcagaacatgcattacaagcaataaaagctagatcaataacttgcttacctttgccctcatcttcatcttccggttcatcaaaaacttttatgagttcttggattaaccactgcatgcaatgcttcttcttctccttctccttcatgttcttcttcttgttcacgtcatcatctttgactctctcatcatctaccttcttgcctctcccaagcttagaaaaatgcgagcgaagatgatcaagtgcaccacactcaaaacaacgattcggttctccttttttactgttcctaacatttttcatagctcgagaaaatttgttagataacaaaaccaagtcgtcgtcctcgaactgttcgagttgttcatcggaaatggcattaaataaagcaaaaacagaagacttcgatgaagaagcaccaacatccaaagaagtcgaggaagaaatcaaagcactagacttataatcaactttacgagcaagaatattcatctcatgagtttttagttttgtgtaaagcgaatccaaagtcaaagtagacatatcaacagactcctgaattaatgtaactttcatctcccaaatagacatgtcaagaccattcaaaaagtgaagagaaatctcatattgtgaataattagcatcataagaagaatcaacagatctaagatcactcaaaattttattaaaccgagaaagatagtcatccaaagcttctccaggtttcatctcaaatttaatgtactcctttttgaaaagatcacgatgaagttctttaatattatttgttccttgatgaaaattactcaaagcagtccaaatctcatgagcagtttgaagatgagcaacacgatcataatccgaatgagaaatcccactcaaaagaatattacgagctttgcaattttgttcaaactcagtttttgtagcagcagtattaataacttcaggaattacataaggatgagaaacttttctccaaatatcataatcttcagccataacataagattgcatcctactacaccaatgagaaaaatccattccatcgaaaacatgaggcttagttgaaaacctaacaggagtagccatggcaaaaactctagatcgattaaaatccaaagaagcaaacaaggctctgaaactacttgtaggatcgaaacacaagaactaagccaaccagagggggggtgaatggttgatatacccaaaaaccgaaaacttttagcggaaataaaagttaccctcgaaatcgatggatcgcggtctgaccgaagtagatgcgctggtctgaccgcctgatgaacgtcggtctgaccgatgtagatcgatcggtcgaaccgtcgaaatcgcctgccgctgcctgactgcatcgccggtctaaccgccttagctctgccggtctgaccgccgccttttgccagtctgaccgctggtgcgccgccggttggaccgccgaaccctggtgaaacacaaatcgaagaactctcaaagtagataaaaactttattgcttctctctgtgtttacaaagtgcaccaacagcactccttacaaaaatcttgactaaacttgaaaccctatctaaactatcaactcaattgctctcaaaagcgataccgaaaagcgataccgggaagcctcacgctccccctctatttatacatgaggtaggcagcctaaagccacgaaccaaactcatactaagagtcctaaacaccttaggaaaccctctagtacaagatacaaactttacataaccaatcgtaccaaatttggactccttccaaattcgactccgcatcccatacgtacacaatacctccatcgtatgccatatggaatcttcaccaaccacgtgcatcaactctagccttagtatatatcccgcatgatatctgaccaccacggacatcgtcttatctccaagccgactcccggtctatcaccgcatatactgtctcgaggcatcgagtcacttacacatgaaacaaacaaagaaaccatattccgagaccaagctatccccaacttgactcattattagcaaacaacagtattacatacgtatagtatccatctagaagccataaccatgaaacaatcacggatatccaaagaaacaacccgaaaccgaaaccgacacagcatcggccggtcaaaccacgggccggccggtctgaccgcacacatagcaccggtctgaccggcaacctctgctcggtcggaccggatacataaaataacagtgaatccgatcatcacctgaaaattgattatctccaaaaccacttcaacgataatctccaaatatcaaaaccaataatcacagatgccaattgttcatcacagaataagaatcaatacacacattgatcttacattcttatgcttgcattggtcagaagtgctatgttcagcacatcctatttatgcacaataattggttttctagtggtatgcttgatttgaactctaaacaatacatgtgtagaatgctacttactttacatggcaccaagtcaatgattcactttgcaaataggaaatattttcttcaaggcaaggcattcacaattatggacccaatggaactcatgcaagcccaattagtgcagttagtgtgggatctagatgctcagatggttcagattatcaatttaatacctagatgagggaagaatgcactaaatcatgtgattgtgagatcgtcactgccaaagaacaccatgttgttgatgctacttttctgctgtttggcacggttcaacatcctaaagagaagagctcacaagttctcaatcatgtactacatctgcatggtgatttgttggcttgttggttctctcaaatgggctgatgaagcaatggattttgataaagtgcttcttctcttgcttactgctacatggaaggttaatagttatgcaattccaactagagggactaccgagatggttgtttcttctgtgcaaaattcgtaaggtgttatattcaagctcagtcaaacaggggctgagcatgataacaagctgaacacatttctagctcatgggagtttggcctactcagtaaccaacaattatctaatggaaagtatcaatttatgtactcaagctgcctttttgatttccaaagttcatctcagcaactgcaagctagaggaacaatggtgaatgtttttttgtattttggacatcccgaagaattctcagaactaaaggtgccatgggatctaggagtttattgcattggcttggagacaagccaaaaattaagggaacgggttgttaggagccgatgggcttcctaaggtgcagccgccccacactattgatgcagcccaagaccatgttccatgtaaagcctaagggcctgttcggctgctttgtaccgccgctgtgttgccacagccgaaagaaacaacacactgtgctggttggctgcagcacagtaaaaataatggcagccgaacagagcctaagaagaagagaatataaaagcagcagtactacgggaaggaggagagggagagaatcccaaaacggaagcttggcctggacggtgcgggcgaatggcggcagtggcggcgacttaggtctaggcttggattctcgtcgagtacctgttttcttcttccacctctccatttcctagctactagaacttttctatccacttgtatccttgccatctccatctccaccctccattgttgcagtggatattgtcgtttggaaatattgtgaattgggttgttgacaaaaatttattacaatctaaccagaaagatcaaaaccgtggatttattccctgccaattctttttcatagaactacagcttgaagatgaattagaagtctccttttgctaagcctaagcttacctttgagcttctttcgactttacagaggtaagaggcaaacaatagcacaaatataaagtaagttttgtatttttatcgtagtttaccaaacccaaacgtaagcatgccacagcttactggtaaaagaccacttttccgatcggtcagatccttctccagggtttcaactatcgatataaaaaaaatatcaaaggtaccgataaacaggattatcggaaatatcggaattttatcagcgatacgagaaaaattttggacaaaatttattaaaatttggctgaatttgtgcatgaaatcaagtagattgtatctagatcatttggtataaaaaataacatatgttggcgtagccaggaatttttttctggtagtactatttcagaagttcatattacatataaaaatttttgaacaccgtaaatcatatatagatgtaaaaatttagtaaaaaggcgatacaaacatagaaataatatcatttaacatcaataattggctaatttataacaagcaagttcaaaacgtgcgaatactatcatatagatatttaaaataaaaaagatcttagacatggaaagaaaattacttgccgataccttaatctacgcttattcatagccatgaaagtttttattatgtcttcctcgcctatattgctcaatatatgtgactaagccattttaaaatcacctgatcaacttactaattattttgtgcaagccatttcaaaagctgaaggaaattccctctatttgctagatttatcactttcattatgcccacgaaatgccaatccttgttttcaaagaaatcttacatctaagtataaacctagccttagaactaattttgttctcgtattaaaccttcacaatgacattatcaaggtgcgtctttaaagaaaaatatatttctcttgaacttttgtgtgcacttcatgttttgcaaatccaatatacaaactacaatatagcaaatcagcagaacgttctgatattcacattcactattcactgattcgcaaatcacatattcacattgactgattacaaatcgttaatttacttcacctgagcacaagatttgaagaggggctagtaggaaggcagggatatcaacaagggccagggtactaggggacccgggctcttagcgtggctgcccgacaccatgggggggacacgaattgggtggggagccgcacttgcccacgccgaggcgccgctcagctctacccaccgtgaatcgatgcatgcagagagtggcggtgtctagacggcgacgtgacgagaaaaggaaccacagcggcggaggcggcgcggcggaagcggcgcggcgaggcgagaaacggtagctacggcacggcgaggcgagaaacggcagcgacggcgtggctgaggtgaggaacggcggcacaacgaaaagaggagacggggagtggacagaagggaagaacggcggcgtcacgggttgtttctctcacgcgtgcaaagaaccacgtagcaatggtcaaacattggtacggaaagatagggtttgtcttttttttgggacggaggggagggagtatgtagtctgtaaataaccagtactctctgagtgcaaagcatcatataagcaatcgaagagcacaatatcaagcatgcatggcgacgggagggaggagaggccgcgctgtgccgctgtccaagagcttctcgaggaggctaaggcacggccgcacgggttttggaggaagcggacacgcgagggggatgatgcagctccatgtggcgtccgcgccatccagatgtatggcgacggcggcggcagttctcgcctctcaactctcgaacaacaggacaaggcggcgcactggggctcaatgaatggcgacggcggcggcagatagatgcatggcgacggcgccggccggcggcatatcgatgtatggccacgtcggcggcagctctcgtctcgcctctttctcgactctcgaacaggaggaggcggcgcacggggttgggagtggatggggtcacgggattggaacttggaagtgggctctaggactttgactgggctagggcgcgtccgcgcgtgggccaaaattttgggaggctgtggaccgggaaaagaaaaagtacaccaaaggtccctcaacttgccatcgggatacaaaagcgtcctcgaatcgcaaaaccagatatatggggtcccttaattatacaaaactggtcaaaatagatccctcggcggccctcggcggttttgatgcaggttttgccctacgtgtctgcttagacccacgtgggccccacatgtcagcctatccagtcagcctctctttctttcccctcttctctcccttccccttctctctctcactcttctctctgggggctctgggcaggccggcgctgctggccgacaggtggggaagagaccgatggtgcgaggtgggagaggaggtccggcggccggcgatatggcggcagtgatgacggagacgacgcgggagcaggggagcaaggcggcggcggcggcggcgagatgtccatggtgaggtactggaggcggagctccgtcggggcggggagcgggtcgacggcggtggatggcgggcacgggatagcgtcgcggcccaacgccggcgccagcgccggcatcgcccgcccgcgcgcgatctcccccaccgccgtcatgaactgcaacgcgccgagggccgagggccaatgcggcggcgacggcgtcaccgatggctgccatcgaggcggttcgggagaggcagcagaggaaggggagatcgaggatgacggcgccgtatcggcgggcgtggcacagcagtcggtgtgctacgacggcgacaagcagtggacggtgtcagtgttgtgggggttcgcggtggtggtgacgcgcggggtgctgtcgccgcggagatggagatgcccatgcgcacgttcctcaattggtaccgctgtgccgactacacggcgtacgtcttcaacacgcggcccctggcgtgccaaccatgccaaatgccgcaggtgtactacatgcggcagtcccgcctcgaccgccgccgcaacaccaccgtcaccgagtacgagcgccaccgcgtcgcgcccgtcaattgcggctggcgcatccctgaccttgccactctgctcgaccgcgtcatcgtcctcaagaagcccgaccctgacctctggaaaagggtaatcaaacacacaccgtagttaaaaaactgaattgatttgtacaacaaaaaaccttgatttttttaatgttgctcttaaaccgacgcgcgtgcagtctccaaggaggaattgctgcagggtgatgtcgtcacccaagcaagggaaggaccggaagatgaccaacgatgttggcgtctgcagagcgggaggtcaaagtgagtgtgtgagccgggaggccgctgggcgccggccggacgcgccgaagcgggacggagagggcgtggccgcgcgggcgccggcatggcgcgcgaaggcagcaggaggcgcgcgctgccgccacctgcacgcccgcaccgttcccgcctcgctaccgcctccccgggcccatctttggccgccgaggagctccgccgggccgccgccggggtctccgtcctcgacctcgcccacgtggcgacgccctcccctcccttatcaccggcgacgccgacgccctccctttttccccgtcgcggcccccgccactgccgccgctgccagccatcgccgtggacgtgctaaccccgcctcgccgtggtgccatggacgcgctaccgccgccgctgccgacgcgctaccgcctgggtgtgtgactgtgtgtagaagagaggaagagaggaggaagggggaggctgacatggattgcctgacatgtggggtctacgtgggtcccacgctgactcagccgccacatcggacaaaaccggggtcaaaaccaccgagggacctaaagcgaatggttttattagttgagggatgtctggtatctggttttgcgattgggggacgattttgtatctcgatgacaagttgagggaccttgggtgtactttttccgccggaaaaatgccgcggcaaattcaaaaggggccgaaatttttggccaatactgttttcttgggtgcccaccgataaacccgattttcagaaattctggaccctgtttcggcgaaattttgaaccctgtccttctccaccttccccaagctgcaacgcaccccgaccacctcctccacgaagcccgtggccgccggagcgccatcctcgccatcgtcccatgtcagccgccaccatctcgtcgccatcgcaagcttccgccgccgcctctcccgtcacccacgcttgatgagcaccagaatccttttcctctttccctctgtcacatgtcgtgcatgctgctgcatcgaacagtcaccgccggaccgtgcgctgccactccccagccggttggctagtgagccctcgcccctttgttgtggtcgtccgatcaccgtcacatcggtgctgcatgggttccgcgtcggcgccacatgtgcaccatgtggtgcgctcgcccggccacgtgtgtccgtccctcttagacagcgatgcgtgggacgcgcctgtcggcgccacgtgcgcaccatgtggtgcgcccgcccggccacatgtgcccgtccctcttagacaacgatgcgtcggacgcgcctgtcggtgtaaggttttccccccccccccttggctggcatcataaatcaagtttattgcgcaataaatcatatttaacttagttaaatatgatttaatgaagtataactacagtgtaactgcactgtaactaattacagtataatttctatataagttaggtataaagttgcatatattattttaataattatatacaaattatattttagttatagtggattatattacaattatagggggtgtttagatctaggggtgtaaagttttgacgtgccacatcaaatattatatagggtgtcgcatagagtgttcgggcactataaaaaaaaactaattacagaatccatcagtaaaccgcgagatgaatttattaagcctaattaatttgttattaacaaatatttactgtagcaccaaattatcaaatcatagagtaattaggcttaaaagatccgtctcgcaaattagtcctaatacgtgcaattagttatttttttaagcctatatttaatacttcatgcaggtgttcaaacgttcgatatgacaaggtaaaaaattttagggtgagatctaaacagggccatagttagatttgaaatttttttattaaaaacttactacagttttttagatagtctgttaaataaaagcacttgtgtatgtacccatattgaagacacaatatccatattaattatgaacatgcacacgcacaaatatgcagcacacatgtggttcacacgatgacaaactgaattattcactttttacatactatataagtagatagctcgatcgaccgttgctgcaaattacgcacaaaccacgccaaattgttcactttaggttgtagagcttgtttacatcatcgatgatgattaagctgctgcgcgtgggcccccctgctcgtggcgtgggacccagacgatgctgagcttggtgaggaagtggcacacggacacctcccccggcttgacgccgtgcgccacgaagaacgggttgtccgccctccaccgcgacgtgtccaggtggcacacggcgagcgcctccatcttcgccggcgaggccgcctcgccttcgccgtcgccgtccccggtggtcgccgccaccagcgtcaccgcgtacgcggcggtcggcttggtactgtggcagtagaacacggcgtacgggtacgtcaggtcgtggcacgccacgacggcagccggcgccggctccgacgacgacgacgaaccggaaccagccatcgccgagagctcccgcacggacgtcacgttgtacctcccgcgccgcgccggcgtggtcgcggcgtcggtgggaaggtcggcggcggagaacgcgcggacgtcgcgcgtcccgaggagcgacgcggcgaggtcggcgagcgactcgagggaggtggcgcagccggccttctcgcccgggagcagcgccgccgcccgctggccgcaggtgtcgagcgcccaccgtatctcgcgcgccatggcgagggacgccggcgcgaacatggcgaggacgtcggcaaagcggtcggcggagaacgggatggcgtcggcgacgtggcgagggaggaaggccggcagcgaggtcgtcggcgggatggtcggcgtgatgacggagcccggccgaagggcgtcgcgaaagaagaagacgtcggccagttgctgcatcttgttgccgtgtgcgtgaacatggcgtccatgatccattcctgcgaatgaaccaacaacgtagaatagctagaggtatgtatatcgcctcaaagagtttgagaaagaactggcagtacaacttgtgagataaattttggtagttccgttaaggaaatgcatttcttaagtggttaagaggtaaaaatttgaaattcaaagatagctacattttaacatggaaagagtatgtattaagatctgccaatgcttgaaatttctagaccggtgaaccatgtttattttagggtgaatatgatccctatagtttcgcttcgagctcagtttagtccttgaggtttcaaatcgttcaaataagtctttcaaattaatcatttgggttaatatagtccttggacccacaaaaggtgctacgtgagcatgccaagtcatcctcgcatgcagcgaacagcggtatgaataaaataatcattctatccttatataccatatagaaaagaaagaaaaaaaaagaaaattaatgtttcacacatgtatgtatatgtctcagagagtttgaaaaagaattgaaagtataacttgtgagataaattttggtagctcccttaggccttgattggttaatccctgtgagggacggattgggggagatttattccacacatattgtggtgtggaattattcctcctcaatcccctccaatcctctttaatcccctctaaaccgaataagatcttaaggaaatgcatttcttaagtggttaagaggtaaaaatttgaaatacaaagatagatatatattttgacaaggaaagagtatatattaagatccgccaatggttgaaatttctagattggtgaaccatgtttattttattattattacaattatccactttgtatctttgagttacaagcatagtgaactatatatatatatatatatatatatatatatatatatatatatatatatatatatatatcatatatcgataggctatacaagattaagaaagtcatcaaaatgagaaattttacactcctggatgatggagagaggtgacaaatatatttttaacataaaatttagtgtctcttggtaaccgagatatgtgatagcatcgctctatcaaaatgtgcgtgcttagacaattttaagggaaacacaaaaggttgaaaggaaaacaacttacagtatgaataccctaattgcttttctagacgcattcataagttatatgaaagtataacagacaaacttgctattttcaaatattctcaccttcgaatgtgtgttgataattcttatgtgcgaatctcgtagggaacatattgcttagatttacttcatgggcatatgacacttgaaactttttgagttcctctatacgtgacagctatgtacaga

SEQ ID NO: 6609 - DNA, 985 bp, Oryza sativa
  unsure (1)..(985): unsure at all n locations
gcggccnggtagattgactanctcgnacccnacacatatacatatatatattttttttcttgtgttgtgtgggaaacaaattgtttagttttacatctggaccatatgcaatgaaatttcattgagttcctctaaagttggcagctcatgtcgaaacaatttatttggttttctatattatgtcaacaatatataaaaaatacaattcatgaattgtgtgtatactacttattctcacctttctctccttgtagggacatttcgcattccttatctgccatgaatcctcccatagcaaaggttttgcttgtctcctcttcgccattacttccatatgacaccgagacttcctttagtccatctgcagctcgtaaggctcatttgtttttattttcaatagacatttatatgagacatgcaatacattacactaatctcctttagttccaaataatatcatcttcgtttatgtatatttatttcttatgttctggggggaactaattgtgtagtttcacttttgggccatatgacacccagactattccgagttcccctacagttcatggtccatgtagaaataatttatgtagtttttccaaatatgtcaacaacatagagaaaacacagaacacataatgcactctcaaatattgtaccttcatctacatctgaagacttcttgcgttccttatctaacatataccctacttgagagaatgttttccttggctcctcttcaccatcacttccatatgtcatggagacttcctttagtcccgctgcaactcatatgcccccattttataattccaaatatacatgtatgcaacatatatacactacatgtaacatgaacatccacaagttctaatgtaacctccgcttgttagtatatatttctgatgtgcatacctgttgggaacaannatgctagtttcacgtttgagtcatatgacactgagacttctctgaggtcctctan

SEQ ID NO: 6610 - DNA, 1492 bp, Oryza sativa
  unsure (1)..(1492): unsure at all n locations
tgaacgcacaccagggagtagatttgttaacatgacagaaatagaagtgggggtgccccccgccaggaagattatcntcccgacggcggggaaaataacggcaggcggggacagancattatttgccaagaaaaaggagagtacgccccacacgcaccggataggaccacgcggaattccagccagagcgagtagatatcaggacgccgagaaaggacgaggacagacatttcatataagcaccgcaagagacaacagaagcgatgcaaaaggtagaccctcggcgatacatagaaaaagccggaaagaaaaaaacttaccgcagaggaataaacacaagggaaaggcaagagacattaaagcgcatttttttgttaaaagatgaacaatttgtgacccagggcgaaaagaaagctgcgtacataataaaagaaccccggtcgaatctgggtactttcccattaggcttccgccaccgacatcaaaataggattccaaacgacgacacgatcaagagacactgttttgcacaaataaatggnggtgnnngggtcntcaacaacaaagttgtataactcatcaatatgtacaacttttgttttggtcattttgctagatgactttgtttcaataatttgaatttgaatttcaaattatgacaacttcgaacaacatttacaagtactaaattatttcaaatggaaaactcatcaacaacaaagtggtatagctcatcaagatctataatttttattttggtcatctcttacaaatcgctttgtcagatgaagaaatgatccaaataaaaattatagatcttgatgtgttataccactttgttgttgatgactttttgagttgaaatcatttagtacttgtaaatgttgtttgaagttgtcataatttgaatttcaaattcatactattcaaacaaatacatatagaaaagtgaccaaaacaaaagttgtaaatcttgataagttatacaactttgttattgatgactttttcagttgaaatcatttagtatttgaaaatgttgtttgaagttgtctaaatttgaaattcaaattcaaattattgaaacaaagtcatatggtgaaatgacaaaaacaaaagttgtagatattgatgatttatacaactttgttgttgatgactttttcatttgaaatcatttagtatttaaaaatattgtttgaagttgtcataatttgaaattcaaattttatatagttcaatcaaactcggatgaagaaatgaccaaaaaaaatggtagatctaaatgagttctacaactttgttttttacaactttttcatacgagctgatttagtggcataaaattcgattcaaaatttgcaataaaaattttgccttctcaccactttaaaatatttcatctttccctcacctcttcctcccctaatattttcccttctttcagtgccggcgggagaaagacctaaatttcaacatgaaatgaccattn

SEQ ID NO: 6611 - DNA, 19470 bp, Oryza sativa
  unsure (1)..(19470): unsure at all n locations
ttttcaaccataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtatatagtgtatcatgaaacacctggtataccatggtccttgaggtatcatgatacacctggtatctcaaggtatcatttggtacctcgagacatcattcggtatcctcaaattatcacctacggtacccttgaggtatcatttggtaccctcaagatatcgcccgtggtcctcgaggtatcatgagatacactcggtacctcacggtatcatttggtacgctcgaggtaccatgatacatatgataccctcgaggtatcatctagtacgctcaaagtatcacctacagtatcctcaaggtagtgcccgtggtcctcgaggtatcatgatacatatgggttatacatggggatttttttaggtatcaggtatgttatagtgatacatttagtctctatgctctagaaagagatatcaagtgattcaaataaaaaaacacaaagaaaggaaaagaatagtgaaaagaaaaaaaaaggaaaaaaaatgtatggttgggccgtggcccaatacacaggagcgcaacagccctaccgggccagctggcctatccatgtactcactctatcctataatataagacatgtacacattccaagattcaactttaaaaacatttaaccaacaattattataatataaattaaattttatttgttaaaattattatcattggattgacatttaaatttactttaagatggttataaatttgttgcaataaaccttatagtatatgagaaatttaaagtcaaagattagttttgaagactgtgccaatggttgaccatgtgttatattatggaatggagggagtacatatgtgcaagtgtaggagtccttgtggtctagctagccacgtaccgacgtatgtatgtataggagtcctcgctaaacgtggtggcttgtgtggatggaagcgtgccatgctagactgtcccgttgaagaatggtacaccgttctttaatatttctatctcagcaaaccattaattcatcaacagtgtgccaacatgatggtactagttttgcagtttttattaaattaataatacttcacaaaaaaggtcgttcattttctgggttactaaagatgtaacgagcaaatttcttgttaactagatctggcttatgccttttgttaatctcctttagtccactgtaatagtaccaatttgagttccctttccttagcttcacggcttgtttgttgaatactatgtgattgtcataaccaccatgatgattggcatgctcatgcccatcttctggattgccaaaggtgtaataatatgaaaatttcttcttagctaggtgaacatgatcatgtccatgtgcgaggttgccatagattgaacgtgaaaatttgttcttagctagcttcagcttaggctttttgtcaatcccattcacttcgctgtgttggtataaatctgaagttttcttctttagcttcatggcttcatagttgagtaccatgtatttgtcattgtgaccatcatagtaaacatgacggctaactgctgggttgtcataaatgtaacgtggaaatttcttcgtaactaggcaaacatgatgatgtccatctgctaggttgccatagatgtagcgtgaaagtttcttcttagccatgttcagcttagattctttgtcaatcccatttgcttcactgtgttggtacaaatctgagtttttcttttttagcttcttggctttgtggttgagtaccatgtatttgtcattgcgaccatcatagtgaacaaggtggtcatttgctgggttgccatagacgtaacgtgaagatttcttcttcactagattaagctcaggcttttggtcaatccccttcactgcactgaactggtacaaatatgagaattctttctttagcttcatggattcagtattgaataccatgtgattatcattgtggccatcatagtcaacacgaacatgcctgtctgctgggttgctatagatgtaacgcaacaatttcatcttatctagtagaatatgatcatgaccatgtgatgggttgttattgttgtgacgcgaaagtttcttgttggctaggtctagctcaggtttcttgttaatctgatttgttccactgtaccagtacatatccaagtttttcatctttatcttcagagcttcatactcgaataacatgtgcttatcactatcgccatcatagtaaacacgatcatacccgtctgctgggttattatagttgtatggtgaaaatttcttcttagcttggttgtctagcttgggattcaatttgagtattgagctcttctcatcagcccccttggctccactacctgatgtaagaaggagattcttcttctggttgcctgtagatacatgcacacgatgtcacagttcttgcattcgttgatcattataaactgaactaggagttggttattttcaccactgattttaactgtaaatgaaatctttattcttatgcgacatataatcttccccaaaggttgctcattcatgtactgttcttgtcaaaacatatctgacatttgtcagaatttacatgggaatcttccttattctaattctactacctccaccccaaaatataggggtagtgtggtgtaatcagcctcacatttgttacaaatttataaatagtgccattttacagttcgcaaattaatatacaaagtgcagtaccatggcacctttcaattaaatactatcacaaataaatgatgttttgggaaacaatatgatcatgcaccaaggtattagtttgattatgaataaattaataactagtataaaacgtataaaaatgaaccaaagtattttgaaattttttgaagataaaactagccataccattttcaagttgaattgaaatattcaaagagatattgatggtcaaagtatattgattgcatgcattacaaacattacccaactagtaggtatttaaattctatctttttttctagggacgcaatttgaagatcggatatataatttaaaatgcatatgcaggcagaggcctggattttattttcaattattaaaacaacagtttcaaatgttatgctacatttgcacaatcaactataaggcagtaaatttatctgcatcttcatatactgttgatgaaattggcaaaattcaacacttgcaacccctgtacatacgtacttgaaacattagtattttgtacgggattatatatagacacttaattttagtggacattttggactgtcaatgtccaaggcatatgttttggttacaggagagattacttactaaaacctcatcaactttgtttgatttgagttatcaccttataaaaaatttaataaaacttgagcaagtgaacggtattattatattgatcaagtataactatatattgttaactttccatgtttatagcattaacttcaaataaaatatgcatttggtcatgctggttttgagtgtgattttggctgtgttgtaccaccttgtaattaaatttgtactccctctgttccaaaaagaatctaatcctagagtgaacatgtgtctagattcattattaggattgttttttttaacaaagctaggggcccagcttttcaattacactagaaaatggcgcaccagttggcgcgcttattaattataacctgtatataatacttataacttatttagaatatatatttgttagtttttgagtttttctacaattttcaattttatcaattttatctgtttttaaaactcatggaaaatagactgtatatattttctggtttatttagaacacaataatttcgcacaattgtcagaacggctagttcaatgctcgtaaaatttatttaggatagagagtttagttttctactaacttatcgaaggttaaaatatttccaaatatcataaggaaatttgatgtattttggtaaagaaaatcacaaatctgaatatttttttctatctctaggggggtatgtgtaaacatcataatttacccaatagagtttcatatgcacacaccatagcaaaatttagtttgatatatgcacatgaattacatagcaaaattacttgtccaacttataaaaaaaatagcctacttgataataagttttatcttagggccatttataaacactccaaaccgagggcctatttgtaaatttaaattttttagaggaaaaagttcagaaaattgttttggtagaaccggacatgttttttttatcctctgcataatttttacctggggtgtgtaaaaatcataatttgcccattagaggtgcgtatgcatatcatttagcacaattttagtttgatatatgcacatgaattatatagaaaattttaatttgatgcccattgcctcatgccagagcaaaatttaaacttgataaaattagttgcgagctacctatcaagcaaaaggcacccctcttgctattttattttctatccacatttcattttatttctcgtttcaacgggtgaaaacaatctatctattatattataaagatagcttgaaaatgatacggtatttgctttgatcgcatagaaattgttacattaattaatataaaaagataatagttgtatatacataatataatgattgtatttatattaaatgtcacaaaactacaattatttggttaaatctaatcatgtttttaaaatatgttacaaaatatattgaacaaaagctaagaattgcaaatttaattctataattaaaatatgttgcacaaaacaataattgcaaaaatgaagtacatgtaatcctagtgatatttgcgtgggactttcgtcgagtttgggtagaatcatagtcggtgatattcggtgcaccgtactaccgtactatgtaggttatttgctcagtgaatcatagtcgaaaatactcattatttctcatagttcttgttctatgagtggtagggtgcaccataatattcaaaaaatgctatccacttagtatactcattcgtcagagtagcttggacgtaccgtcaagagatagaagtgcttgctcaatcacattgagttagtgaaaagaccacttggtttgatggtatgattgatcttctacgtccattataattaccacattgaatgtatatgtcagatatacttatagattcaacaaacttctagttcacgataagtcatctttagttaaaattcgcacaaataattccaatatattttatgcaattctatatattttaccgcaatattaattaaaaataataaaagcattacaaataatcaataatcataaatgccataaataaattttataatcatgaatatatgaaatataatttcagtgtattttgcaaatttacaatgccattcaaacaaatattccaaatacagagggccatttatgtattttctagaaatttcagggtttaaaacgcaaagtttccaatgcagaggaatatgcgattaatttttggaaaccacaagggcctttttgcaaaatctatggagattttttccttcttctctactttctttcctccttccttatctttccttccttcttctatttacttttctttccccttcctccactgatggcgccagcgggtgcagaggctggacggacggcaacggcgcggtgggtgcaaaggccggtgaggcgctgcggccggccgttggcgtcgtggccgggtgacggagaggaggaggccgtgtggcggctccgtgcgatttggaggccgggacggcgtggtggggctggctgcggcctcggatggaggaggcggtggcgacagctgcggccgctcgcgcgcgcggatcatgcagcggcggcttaggcgcgtggatccggtggcggcggctgctcgggcgcgcggatccgggtattcccccacacggatcctgagtcggcggcggcagcgtagtctcacctccccacggtggcggcgtgccctctcactccctctccttcccgtccctttcccctctcttctctatcgccggcaactcccacaggccggatccggcgtaggcgtcggtggcccggttgcggtgccttcccctccaccagatccggcggcgagaggggaggcggtggctgcccggtggcgggatgattatttagatgttcttgtgtgatgttttagtgaaaaatttctgtgatgtttttcaatgtttcctatgatgttttttggtttgggattgggattgattgatgcggggtggataaggtcgatgcatcagctcgattaggagaggggaatctgttgttcttgaggatttttattcaatgtgatttctttatctactactgagtcctgactgttctagatgaggtccattggatatttttttttcaccgttgatatgacatcagacggccacgggaggggtgcgcatacgtggccgcttctccagccgagaatcccgctggggctcgaagcgtggtgccacgtggcccaatcactgggcagggttagaaccgtgcaatcgtatatagagatatgtaggggcagacctaggtccaaggcaacatgggtcatggcctggcgcgggttcataatccaatgggtctagctagggacagaatagtatgggccagcttgggccttaattagcctatgccttgtccgcccctataactatgatgagatcatatggcggtataataattgtgtgtgaaataatggtatatatatagagggagtgaaacttggaacacatacatcattacaatcaacaggtgacgatgtcgttgctgtaaaatttactctacaaattatgtgaagtaattgttatataaattgaccaacatcggtcgaggagcagagtgatctaatatactccatgcatttatttttgtaaggtttattttgattctataagaaatcaaattttgtagattttgaccaatgtaaagttaggaaactcaaaagtatatttaattaatgcataaaattaaactaaaccatacgctttattcatacaattaatattggctttatgagaaattgatggctaaagtttgatcatgaagacattttataattactatatgtacatttaaagtagtaagtactacttcaacaaagcataggagttaaacaaacatttataatatgagtgaggattgagtaaagtaaagtaaagtatttcttgtattgtacaccatccccgcaatccaaactacaaattgctataagttgtatagtaccacctacacattcgatgattaattatgcatctcctctactatttttataaaaatagtagaattttcttacgccacatgtgtccgatttggccaacattgtctccactcgaagcaatgagagtctgcgtccgattcctgcgtacatcgtgcaacgccgcacgtttgttaccaatttgcgttgccggcatccgattggcattgatgtcttctctgcgtagcccactatatttccttccatatctcgcatgatctacgttgccgagggaggcgacttgacatgagacgggctgggccttcctgcatcgaccgtgccatgcatatagatcgaatccgtttcagtccgaagcaagagactacgatggaatatattgacgtgcaatcctttcgcgcattggcaaataaaaagggacgatgatgggataataaacaacaagacttaactgtctatctgtataggttttgcatggatgcaaaaatcatagcaagggctcctattttcatcaagcaaataatggccaactcgtcgaccgacctcgagcttcctttctagagtaggatatactgcatatacttaatatgtgatattaacattgcttcaacccattacaacgcatgagtattttctctagttactatataattgtatcccactaattagcttaaatattttatatgtctttccacaggcttcgtaatgatcactaaatcatacccgtacaattagattcattagtaaaatcatagctgtttgattagatctatatgtcaatctctatctatatactattataaaattggagatgtttctgttggaattttggtacgttatccttgtttgagttggttgtatgtcgtccgtatccaattcgatgcgaatctagaataactattatacacccatatcccatcccaacccaaccctaccggccaactctatcccgcgtgcctccaatcggcgccacacacgaccctcccttgatcggcatctttttttctctcccttttatttttatttttctcattttttctcccgataatcctaatactctccttctccttctaatctcgtctcatttatctttttctcttccaaatttccctcctcataaatagtttccttttgaatttatcattgtttaaggtgtgcatacgacaagtttgttactctgcaaatgctttccaactatagtaaaaaaattattaattgaataatcaaaatttcagtctttgatcgatgagtatagcaaaatgcacatgcgtcaacttatggaatggccacccgattgatttgtgaagctatggaaagacgtacataagtgattcttcgtgtgatgacacatgaagcacgcacaacccggttgaatgctatatatggtttctgactttgttttgctattgatttgtttgtttaatttcggtttgttgtttaaattgatcgagttttattaatcgtgaaaattattttcacctgttgcaatgcacatgtatttttgctagttatttaaatgccagaccagcccggaccaacttctacaaacaaatgagtccatccagaccaacaaagtaaaatcagctattggcatgtggcacaatatactagtatgcagggacttagaccatgtgcactttttccatatgaagatgctagggggatgtgtttggttgaaaggaaatccctacatggatatgaccatccaacttaactatgtttggttgataggaaggacgaatcatgaatgagaccgttataagagagaatatttcatgcagatgctggatgagctatttcggaaatattggccggatgagaccatccaccttttctaatcttgacaataatgataattaatatattttgttgttaaatagtaattaattgtcaaggtttgtgttgattagagataatgagtcattttgttgttaatttgtgtataatatggagaagttaatgataactaccgctaatatagaatatattatgttattaataaaaactttcatatttccagttattcatccacatcaatctaaccaagtaagaaactaaatcattcccatccacctaacaaattaaacaaaaaactggatcatatccctaaaaaattagatcatcatagctactcaaacttgacaatcaaccattaatctggatcataattcctggtcatggcttatcccttttgaaaattttgttaatagctagtccctagttacttctgttaagattgttctcagatacgttacaatgagcattcacatcgatctactcaaacaagtaccaccataatacctggggttgattgtcttataccaaaaactcttatggttttgtgcaacttgaaccataataccctgtattttatataatttaatatgtttttttatgcaggtgttaagtaattggtgctaaaatctagcactctattttggaagaaaagaaatgagaggaatgcatataaccagtaggaatcactatgaggtgctatagcctataggctgcagtattttttaattacttagctatcttaagcatggcctatggttccatcttggtgtttatatctagctactactatgcaaatatattacccttttatagagagagaattaccagatggttgtgtcaagaggttgagtatggctgatggtattggagaattgggatgaactgtcttccagtatgccatcacgtcagccgtgcggtctggcaccatcatcgtcatcttctttgcgctcaacaacttcctcccctcgccaactccgaccaccatcacctgtcaaccaaccaaccaaccatcatacatcactactgatgtagccaagatgtgttatttcaacaaaagctttcatagatgattttttcaatttatacacttaaaaaaaaaactaaaacacaactaaaccacccactacaatatcacttgtaggctacacgggccaatttcacaccacactgcaggttgcaaacaggcatgggtattacgaatctcccccaaagattctaccataggataacccaattcccgccacctaccagcttggcaaggaacaatcaaggcatcgttcaacacacatgtgaactatgaaagtatatatagcctgtgataatttgtgacatatacacaaacatcatatcgtgtagagtgtgattcaaaaaagtaaattattccttgcaaaaaggaaaagaagaaaaaatatatcgtgagtgggtgaaaaagcatggatgtaagagctcaacttaatggagacaacacttacaagaataaatgagaggagtgacaaaagagtactcattgcttagtctcagataattttagcattggctgcttatagttcttgctcaatttggtcaggactagcacaagaggtatttataggctagcatcgctatcacgatcacgtacaatcatctgctaaaaaacaaagaaattgagaaatggtggcaggatctaaaaattaattctgaattaattttccatgctggggcgcacatgctttttttacactgtatatgtattaaattcaaataaaggaataccctgtgaaaacagtgtaaatccactgcaaactttaaaaggtattaccaaagtaacttttcataacgtctatgtatcttattatataaaattttacaatggcgaaagatataaaatcatcaatttaaagtagtatggctagaaaactacatgaaatttagtaaatttacactgtataaatgtaatacatacattgtaaaaaagatggaaatccaaaaatgatcaatcaattgaacatctaatctataccttctataaaactacaatccactaatcacataaagctcaaaatgcaagcataacagttattagttaacatacaagtagatcacacatcaacccactaagcactaaaagatcaacatgcatagtaaatactaaaacttaaatgtaactacatacattacctataaattattattttttaaagctcaacatataaaaatgttaattcattattactcatatcatttccacaatatttatatctaaattcattcatcatttcaacatcatttaatacatattcattcatatatcctgtagcaaagcgcggggtgtcacctagtaactgctatacaacaatcactagtattctcgattgacaacctcctcaatccaagcttccatctcgtggtgcttggtcacgcagttcatacgagtgaacgaaagtgagttttactatgaacttaaggatactgtgaacgatctcctttcagaaatcactcctgttgagaggccctcctcctcccttttttctcaatatggaagagaggcagaagagaaatccagagatagctcaactttttcatggaaaagttggggatcgaatgcaagattgagtccctgctggatggaatggaaacactagaaagatcataagaaaccgagctcaaagtgaatcgcaagagaaccccccatcccttagaaggatttgaagctgtttagacactcatagacaagtaaaatccaactcaggttcctcgagaagtgaagtgaacgagcaaggtaaaacacaatcaagttaggaaaagagtctttcatgccaaggtgaacatagataggtagagttagtttattttccttaattaccagagagaagacttacatgcctgtttgactccgcatatatacccccattaaaaagagctctgcatatagatattcgatgacatgtaaatcaaccattttttcctttttgataatcctacggtctgctcttttccctggggtgctggatatgttcttcattgcttccgacagcaatatttcaacctgagcggcttttcctttatatatgtaggtattgcaatgaaacatttgttcctagtaaaatccctaatctaatcttgctagttagatctagagacaatgatgaaattcgtaccacttaatgtgttgctatgaagaccagaggagctgttaagttactctagttaatttggccacagcctaatttgccattagtgtcacattcacaaactgctgatcacaactgtactaaattttggcgactgtctgggcatataacatacagacaagtggtgtaataaaatgtttggcttgattcagttgtaaaattgaaccaaacagttcctgaataaattgtgcagctaaccaacaaacaagcccctcaagcttcaacatcattttgttaggtagcagttatgtttcgtttggatggtctcttgtgtgttctgtttggaggagtttttggcagctgtagttttcttgaagtcaaaagcttgtctaaacaatatagcttttcatccagattcttagaagatgtagttatagaatccagaaaataaactagattctcaccagctgaatttctactaatagcttcatagaatctaaagctacctaaacatgcccttagatgatgccaccagtgggagctattctattatcctttttagctagatgtgccatgactatgggtttgtttagccaatcttaaggttttagctagacgatgaaatctgtttgttgaataattttctatgtagtatgtttgtttcttattttgaaagaaatgtatggcatggttcctataactttaaatttttaatgtataatgtcattgacttttggagatatgtttgactattcatcttatattaaaaaataactaattagcaagtgtgaagaaaatataagttgtgcttaaagtagctttagtaataaacaaaccacagtaaattaaatgatagctacgcaatccttttagtaagaagaatttgatcaaatgttttctcaagtatagcagcatcatatattaaaaacgtacaggaggaattatagcacccgagggagaaaaagagggagcgaagggcttccagcagttcaatgggattgtaaatacttttggttttttcctcctttcaattaaattcccgcagttcttctgccgtcgtttctgcttaaaaaaaaaagggcttccagctgagtttcatgacagcgccattaattgattgttagcccgatagaggctccacgacaactcccaactaatatcatgaacatttatgcatacatgatctgacgatcggtatgtgctactgacttggaaggtatagaaggtttggtatggatcgaccattaataacacgttggccatattattaattagttgatgacctcaacggtatctaaaatttaaagtgtgactttcaaatacaggaagttagctagatggcatgtatgccattaaaattctgtttgtcactcccctttaaaagaaattgtttgtcacaaatagacagttcctatttcgaactaacacacaaatatgcaactgggtgacaaatgtgcccctactttcgtctgttcaaatgatctgggtttgaacaatgatttttgtttgtgtacttaaccaggaaaacatcctctcaaaataagaaaaatattgttgggaggaaggtgtagtatagtctattcatgatattttactagaattaattttacgatccatctattttactagaaattaatttactcacattgtttaattgaaaagacattatccaatataatgttttggaatagcttaaaatttatccaagcaaatatatatggacaaaagggtccagtttgagttttagcaaatgtattttgaagcgtattttgacttgtgtttagggtaggacacatgcctcgggagatttgtcatccaatggacaatgacacattctccctgggtttggaataataagcatgacatacttgtgccaagtgaatttttagaggcttatttaggatcgagagatgttcctttgaaatctttttttttcttataacctgaggagatccaaggtgacaagtcggccaccgaatactgtcgccacttccggagcatggatgatgcgatggccgacctcggcgaacctatcaccgagtgcacgctagtcctcgcactttcacgaggtttgaataaaaagtacaataatctgcaaactgtattgcccttatagcgtcgcttccccaccttcctcgaggcatgctctcagctgcttcttgcggaaatcaacaagggacaacagaccaccagaaccgccattgccttcgtcgcctccaccaacaacggttccggtggagctgggtctgtcgtcactgctgcatccagcaccaccaactccacctccgggaacggtggcaacaactgcaatcactgccatgggtgtggcaatggagatagcggcaacggtggcactgctcaggcctccgaacaaggtggcggcggcatccaagccacccactcaggccaacaggctgcgggagagtggcaactagtcccaacaccaagtcacgccgtagcacaccccttacaatccctgtgccgataccattcaaatatcaggccatgctctcagcatgctgggccaggtgttggcggtccttaaataccaaatgaaacactggacgtagtggtagggtttgttactaaccaattccacaagtgttggtaaatatttgtatgtagttgattatggatgaaagtacacctgctgtgtaacgaaattgtcctccaaacgtcagaacatcgtctcctactccagcactaaagccgagtatagagcatttgcaatgttgttgttggaacatgctggcttcaccaacttttgcacgagctgcattcacatcccactcgaaccactttggtctattgtgacaacatcactgcagttcagcaccagcacatcaagcacgtcgagattgatctccattttgtccatggttgtgtgactactcgcactattcaagttctacatgtgtgaactacatcccagtatgctgatatattcacaaaagggttgccgactgatgtcttctttgagtttcggtctagtctcaatgtccagcctgttgacgttgcgattgccgggggtgttagcatatctcatgtatatcgcatgttttctttcttttggccagtcctcccaatatccctcccaggcatgtttctataaactggttgagtaggatactaggataaggatgattatgtgcctatatgtactcggcgttgtgatcaatcgatattgtgttgagtccatcaatctaagagtctgttgggccactcctctcaggctctcacgatgcctgcgcctgcacacgctcttgcacttgacgtggccgatctcacatcagtcatggaacaccaatctatggagcttgcatgattgtgacgacacctgatctctatctgcaactctgtgtctccattttctcatcctggatccaatgggtggcggtgagaacattggggatattatggaataagttcaccggaggtccctcaatttaacaccaagattttttgagatcccttaaccacaaaacaagaaatgtgcacccctaaacttatataaaccgtgcacataaggtcctatggcagtatatgtgggtggtttcgctgacgtggcatcctagtaagcaaaaataaataaataaagtacgtggggcccacatgtaagagagaaaacgatatgggcccacatcccttgtttcttcccctttcttctcttctctcgtcttcttcgatgggccgagacgcgcggggcgacggctggcgagagcggccgcggcggcggcggcggcaggcgaagaagtcaggcgcggtggtggcaggcgaacgcggtggcggtgggcgagagcggcggcagcggcgggctaagcaggcaggggcggccggcgaagcaggcaagggcggcagggttgagcgccggcggccgcgcgtgcccaccgtggtcctccgtgtccgcctcgtcgtcctctgtggttgcgccgccggccgcgtcgttgaggcggctgctcgtcgcggtggtcttgttcacgtggccgagcagagcggacggcgggcggaggagggggccgcaacggcggaggtggccgaaggaggagcgtggcggcggtgggcgagctccgcgggcctacaccgccagccgagccgtcatcgtcctcgtcgtcggccgagccatcctcatccgcgccgagcgccgcgcaccgctggttccccctgccaactacaccctctccgcgtccccgtccgcatcctcgcgctctccgtctccgaccccgacgtcccgctcagccccgccgtcgacgagtcctacacgctctccgtcgacaagtcctacacgctctccccgccgtgctcgtccgctcgcccaccgtcgtgctcgttcgctctgcccgccgccgtgctcgtccgctcgctcgcaggccgcgctcgcctgctgccgctcggctgccgcgcggacccgccgccgcgctcgctcgctgcccgcccatcgctgctccgccctctccgccgccagcgtctacgcggccgcttcttgccgctgccggcggcaacggcactcccggagtccatggagctcggcgacgacgcgttgagcgagctgcaggcggccgagctcgcgtctttgctgctgctgctgcaggtgcaactattgctctcctgggttagcacttgctcttgctccatctgtgtgacgagctagcgcgcgacgaccaccaagattgcttgctagtggaccgccggcctcactcagtgaagaagaagagaaagaggagagataaaagagaagagaaggagaagaaaagcaaagaaaaaaaaagtactattgatatgtgggccccacgtacttttttaattttttttttactagaatgccacgtcagcgaaaccacccacatatactgccatgggacttcctttgaacggtttgtgtgagtttatgggtacacatttctggttttgtggttaagggacttcagaaaatctcgctgttaagttgagggacctccggtgaacttattccggatattattgacaggagcagtgtggagccaaatccgccgctgttgctgattgctactccatcaagggctcgagctgtgtggatcaggccgcttccgccgcttggcccactccactagcttgcctacaccctaacacagcaaggggtgggcacatggctacggtgtaggtgcccccacctaggtgaaccctcactttacagtgtagattgcaacaacaacatgtaaattacaacaacgattcttctgttaactatttcgacgaacctgcagtttaatctgaaaatttaggcaaaatgtgaccattgcagtctttttcttctttctcaaacacactattccagtcttttggaatgaccctaaagctgatcagttaattgtgaaggaaccctctacttcgcagaagcagaaatgatatttggcatatactttgcagaaacagaaacacaacttggcggtggctggtttatttagaaatctctgcttggttttgatggcaagcatggtaatttcagaattctccaattcttgttgacaaaaaaattctgctggttgaacatggtgtgatagtgatttgagacattaatcaatgatggattatctgcttgcctgttctttctgttacatgagttgtggggtgtttttctgttaaattaatctaggttgctctcttgatctgatctagacagatcctgagcaaaggttgcaattaggaaaacaaaaagaaaaggtgagagagggtgctagttgaagttattgaatggcttagtatacctgttgactgtagatcagtcaattttagttcaaatgtttattgattttgtcatgtatactgtactatggtttgtgaagaacaagaagaatttgtatttggtctacttaattgatctaaattatgtagaacttcatgattttcttcagtgcaaaacatttctaaaaaactgccaattgtagctttttttcatttttctttgtatccccataaagaactaccataacttttttttttaccttgtgcgaaatgacatatgcaattttttaacaaagaagcagtcttatatcatgcgtgtgaggccatatatcaacattttcttcagtgcaacagtcttttctattctaatctgctactagaaaatcatgtgcctcacattttacaggatctttgatgatatgaatgcttaaggatgctattttgaattgctggttttctcagcaagcaaaagttgcatggttttgtctgatcattttttattacttcacaatgatgatagataggatattgcattgtgttgtctgatttggacattcttgaactgcagccctttaaacttatatttttcatattgtccttacaaataatgagatcttctcatcaaatgtttctagacaaacactgcttactacaggggaatctctgtgctctttatccaatctgcagagatgagggtaccagggagttgtacaaggttcttggtgccacttacatattgttatatgttatactatttaatgaatgtctaaaacacaaggaataggtcccccatcatagcaataagcttctgctttatgttaaaaaaaaaacgattctatgtgtgaagctttgtgatctcataggcaactagagaggtaaaagcacatggtaaacctaggttccactggtggagaaatgctctttactcccggtttagaaccctttgtagtcccaatttttcaaccgggactacgaatccgggactaaagatcgctatctttagttccggttcaaataaccaggactaaagatcaatctttagtctcggttaataacaccaaccgggagtaaagaggggaatctttagtcccggggatagcggcagtccctcgaggtcccttttctttcttttttttttcattgttaatttgctaatggctagagttaatccctgtnnnnnnnnnnnnnnnnnnnnnnnnnnnnnnnnnnnactaagttgttctacaatncacgctggggngngggagagggagggaaaatattattatacgacccccaccgtattataaganaaacacccgcttattattaagaacagcacaccccgcttagtagtaacgcgcggggcg

SEQ ID NO: 6612 - DNA, 2157 bp, Oryza sativa
  unsure (1)..(2157): unsure at all n locations
cgccgaagactttccgtccgatttgtgtacggaccccccccccttttttgaattttctgtttattggaaagagtacagggggtatgaataaacgncagtagcagggaagaacaggggagagcagtagcaagggaattggttctaagaaaaggaagagaggggatgatccaatcttatctaaatatctgtctgggacttaaccgatgtgggagagaaatatttactcccggttgataactccacccgagactaaagatagatttttagtcctggttggtagtaccaaccgggactaaagatctaaatgatctttagtcccggttggtagccccctgacatacctctgacagggatgaaccaggactaaaatcatctttagtcctggttggagatcaaaatttttttaaccggaactaaaaatcgtttttagtcccggtttttaatgaaaccgggactattgtggaatttggtcgaccgaccaaagatggtttctccaccagtgttcttatacattttcttaacattgatttttattttaactgcattttaagttgatcttaaaatcggaccatatgatttacttactctgaatagcttattttctggatgttcttcaggaatttggatgcaactgcactaggaattcatctggatttttttggttggttgtgataactgcagcaaaacatctcaagaggataaaccttcactgtcattgaaataaaaaatacacttattaattgaataacgtatttttaatccattctgaacagtgcagaactttctgaattatctatcggtgtttagcggttgattgttgttttattgaggggtattattaaatatcaaagtagatagatgcagataaagaatcaagttttatgacttggttttagttatacatatttttcttcaaagtgcaaaaataaaaattgtactccctccgtcccatgatataagggattttgagtttttgcttgcactgtttgaccactcgtcttatttaaaaaaattgtgatggtgactcatacatatattgtcattactaaatatcaccatagcattagcacgggcacaataatgttttatagtcaattaatgacttgtttctttttagtatcgctaagcagctcacctaaaaaagttagaacaaaaccatacacaggggccaaaaaaagcagggtgagtggcggccaaggatcaaagtgtcaagggggcatttgcccccgctcactgcaaaattgagtggtgttgatgaaaaacacgaggcctgggagatctgcttaactccagtgcaggtccaaaactcgccttcgggtatgctagcgtaccataccaaatttggtcgttaacaggtgggggcaaaggtccccacttgtaatactctagatctgcacatgaccatacatccctagctccctgccaaatctatgctccctgtagttggtcggcttgtagtagacttgtgacgtacaagtgtaaagaaaaatctatgcactccatcgttataaaaggaaacgctctctcactcccttctcatcacttcgctcactcactctcactcatttcctcccattagtcttcccactcacgtctcactcctctcactcacttctcactcgaatgagtcagcagccaccctgttgtgggcacgcattctaaggggctgccaaggcaaccagggcgggaagggtagtcggggtcagctaggatgaaaaggagaaccaggtggcgacggtggcttgagcgtacacggtggcgcaagcggcgacggtggtggtctaggttaccatggcgctagaggaggatgaggacaagatagcagaaatggtggccgcgggtcaacggcagtgggcgcataaggtctagggcgaggtggtaagccatgatgcggttatgatcgttaggttggtttagtcattctttttacaacttgcctcgatccttactgcaaatggcaaattcatgcaagaaagagtgtagctaataggtggaggataactagtgcaggtgaagacaaacatgctcagtgcggaattatctggccagtacttgcaactaacttccagggtttattggccacaggttacagacatttggtcaaactgagcccaatcttgtgtccctgtagggatnggtcgaggcaagtgagcaaat

SEQ ID NO: 6613 - DNA, 8209 bp, Oryza sativa
  unsure (1)..(8209): unsure at all n locations
ntcaagttgtttgggaatattggacccaggcatattaatgccatgaaagaaaaaaaaaacccgaacatgcattttcgtgttgaggctcaccatgagaagtcaagaattggggaaggagtgcatagttgtgtatttgcccgtgcgtcatgatattcgggcagttagtggaggcattcaagcacttgaggtcggtgttagcaattgatgggaccttcttgaccggtaaatttaggggtgtattgctcacaaaaatagggacattgtctgatcagccataatagagaagtgtgtataatatctgataagcacccaggcatattgaactccatcaacaacgagatactagggcatcaacccattcaccatagatggtgcacgaggcacctatgcactaacttctatatcactagagctacccaggatcagatgaatgacctcgagcgcatatgtcaaataaacaagaaagttgtgttcctatgtgcggtgaagtgccccatgggtttggttggaaagtgatcaaagaagtggctagaggacaatatgccacttaaggttaaatgggccagatcatttgataccgatggacgtctatacaacttcatggctagcaatatggtcgagagtttctacaatgtcttgagaggcattcaaaaattctttttatgtcaaaaggagaatgtgtaataacttttttataccaagagcacgatatgagaggagagatgagttgcacaagaaacgggggcgggtggggtaggaaagaaaattcttgacattgaaaatagaggaggagcgagggaggggggaatgagtgaagagtctagtggagacaacaaatgttgataaatgtgggtgtaattctttttacatcaagatgaggggctgtgaggcgcactattaagtagcgcactgtttagcgcatattagtttgttttttttactttacgcatgcatgacctatttagttttatatttacatcagattttctttcatatgaccgatgaaaggtctgagagttttataaaaaattaacagcaccatacatttaaaagcaagaagtaattttttttattagataaggatattttttacctggcctatacatccaaccgtgtgtatatatatatatatatatgtgtatatacatatgtatatgtatatatatatatatgtatatgtatatacatatatatgtatatgtatatatatgcagctatttaaattgggaacttagccatacgaacaaccaaatctaaaattcactcctatggagatatatttgaaggatcttatggtgctaggaataattaaatgtgcaaccactatatcttccattcactcaagtacattcttgtcacatcacatcttattctcacgttaagctcgcgctcttagtatgatttcacgtgtttctcgcaggcgtggttatttgtcacatcaagttccagatctcattcaaatgcatttcgctactaggtaattaagttaataattacatttgttagaagtgtatatcacaataataaaatgcaaacgcatttccaatattgctgattaaataacacttattctaaaagaaagtaatataagaaagaacatctccaaacgattctaatgaggattgagctggatagcggggataacaggtactccctccgtcctataatataagggattttgagtttttgtttataacgtttgaccacttgtcttattcaaaatttttttaaaattattatttattttatttgtgacttactttattatctaccgtactttaagcataacttttcgttttttatatttgcaaaaaataataaataaaacgagtggtcaaacgttgcaatcaaaaactcaaaatcccttatattgtgggacagagggagtaaaaatgaagggagctaggagagcgatggatatatgccttcctagctagttcccacacccctcttagctacggaactaaaaataacaacaacaacataataacagaacacataaaaaaatggattagtatgattttttaaagtaattttcctatagacttttttagaaaaaaaatattgtttaatagtttgtgaagcgtgtgcgtgaaaaacaagttagaaaaggttgggacattcacataaaaactcagcctaattaagctggtgtttatgtcacttttaggtccgtatgttttgatacaccatgaacagtagtgctccccctctcacatcgtaaaaagcagtgctccctcgtaataattcagtgaaatgcaaatcagtactatgttgtgttcttaaataatgtagaataaaaataaaaatatactaccgttgttccaaaatataccattataagatggatacatgtattaagaaaatgaaagtgattaaaaacatgttgtgattgattgagaagaaaaaaagaaaaaattaaagggaacatagttgtaatttgttgaaaaaatatattaaaaaattagctttattttggtacaagttaagtacatatctgggttagaagcagtgagaaagaagtgagaggattcattcgatcattcgtcgccagctacgaaaaatctacaaggacaggaacaaacagatggatgtttcgtcgccatcgcatgcggagcgcgcggtgagccctgcctgccgaatccacgagatatcatatcaaccctgcagcactagctgccactccgtttggtgcagcgtccataaccaaatctagaaataattgccatttccaattaaataattgcacgtgcactgcatgtctggttaataattaaataatcttcgaaagttttgacaaacttgacccggtccattgtcgagataagctctttaaattaagggtcaatttttcaaattttcgcggaagtaatccctagctaactagctagctgaccaattaccattgtttctttaatatatgacttatttggtttttcaaatttatttgactattcgctgaaatattcatgcaaagaaatcacaaacacggtagacatgcttaaagtacttttgattattagtattttttaaatttacttaacaaagtaactaataaataggaaaaaattctatatgtcccaaaaacattggatagaagttcattgaacaccctaaactttaaaattaaacatccaaccaccgaacattgtcataccattcatatattacagacattggttttttatattttaaagtttaaacgaggggttttgacaaaaataatataacatatgcttacataaaatccatcatccgttattagtttgtacagtaatgttatattaagttcgcactcatcccttctttctataaagctaatgcccactaaacacctagagctcaacatgtaagtgttgtatttattagtactcctaaaacctagatgcaagcatgccacatcaacccattaagcacacaaatctcaatatgcaagcatatagtaattatatctacaatttatttcattctaaaactaaacatacacatgctaaaccatcattctcaaattattttcatattatttcaatccaaattatttcattaattctccaatatctaatatatatcccgtggcaaagcgtgggatatcttttagtttatataggagtacaagtgaaagaaataagggggtaaagaagagaatcaagtgaagatttaacatatacatccaagacatatgtcacatattcaaactcatccattgtatatacaaattatatagtaatcatttttttaaaccatcatatgggctgcatagatggtattataaactacataggattaaacgtctggttttaaagtttagggtgttagatggactatcatctaaagtttacggggtatatggaatttcttccccaataaatattattcaaagtttaaggaaaaaaatctacatcatatattagaaatggagaggtatatacgtgggtttagactgatggtgtgatattatctttcacgttatattttaataaacacggatgacctataacatgtttattttttttcctccgaggaatggccctcgtaaccatgttgtctattcagatctgcacaatatttttataattaatgatttctaatatagtatacatgacaggctatcatcttactataatagagcgtatggccccatcatttggcttattacggaataagccaaacgacatatttgcaaatgaaaaataatttgtaaataaaacttttttatatgtgtttttagtgatctaaaagcaaaggctaaaaagaaaacttcggtgaaaatccctaaaatcatgataagtataagcataagcgaaaaatgaggcttgtttctcccttgttttctcatgatttcacatcatcatagcatactccctcatactataaaattgttcatgcgcaagctactccctcacctagtcgattaattatattggccgcgtggtcactagcatgcatcatttcgttaattaattaattgctcttacgtacccttccattttcggtgtataaataggcaacctccagtggacatggcctcttcagagatacatataccatcaactcacgtaatggatgtcctcgtactactcatctcactgatcctcctggtgagtgtgaatttgctgttaatttagtttagaaattaacctctgaagatacattctgcgtgacagttaattgattatatatatgtttatatgcggcaatcaatcgtatctctcctgtcagtaatttttaccaacgtaacttaatttatcaaggtatatataccttacaaagtgtaaaccctgcttactactcttacttattagtatctctgctatcacttaatttttttttcatttactcggaattgattgctttacattgtttgtcaattatgttaggctttgttcggcaacaatatacagtgttttcttttaaaaaatattttgtgtttctaaatgaagagttagctagctagttttggaatatgtaataacatgggaagaataactgtaaactagcatgcactacccagtacctacatagagtgcttatattatggtatatatacacattatttagttttcatttgatttattgtctagattagttttttctgtacttcatatgttggtgagtatacatgtcagttgtaacttaggtgatgtcacaaattatattataagttgcaacaattttggaatgcacgataatcataaatataaggcaaaatttgctacacgacacgtaaaaattgtgtaattagctgagggacaccgcaaaaacgtgacactgccccaacacactacaaaaactgtgaaatttgctgtaggacaccgtgcacattattttatcattttctagctgaaagtggtgagaatatttttgaaatgcccagattgcccccgcacgtcaccacacacagacaaaaaaaacaattctccattaggatggccgaaggggcgcagctagctgcggccggaggggcggcgcgagcggcggggcacggcctggtggcggcagcgccggtgcgacgggggcgcagccgagcggaggaagagttcgaccctggcgttggcactgggcacggcagaccgaggatggcacgacgatgccagcggctgggcggaggtagcgcggcgttcacggcgtggacccgaaggcgacgacatcgacattgagggcatggtgctgctacagcctgcttctggggcgcgcggtggctgccgtcggaggaggaggaggaggccagctggcgcgacgagccgctgatggtcgcgccggacaggctggacgcgctcgggccgtacatgacgggcggcaccgctggcaacgacgccccgcggatcgaccctcccgccaaggacgtgtcgttgcttccacgctgcagtgcgctggttgccgtcgccgagaaggaagtactgagtgaacgcggccgctagtactgagtgaacgcggcgcccttggttgaacaaaaagcaacgagaaagagagagaatgggagagagagaaaagataaggaagaataaagaaaaaagaaaaaaaatgaaggatagaatcgtacttacacaggtgtttctctctccaattcctccggatataataaaattatccgacgggtgtccaacagcaaattaccggttttttgtggtgttctttagcaaatttacgttcttgcgatgtccacaggctaattatacatttttttggatgtcctgtagtaaattttgcctaaatataatgcagatcggaggaagcagcggtgcaaacatggcggttgctgtgaccaaaccgtccccaacagcgatggagtattggcagaaaaaattccctgagacacccatgcccccagccatactagacctgctgacaccactgcctacaggtctctatctttctgctgatagttattaaaccaagaaatatttaaatttatatggttaaaatttaagtacttgttgagacaaatatattgctagatataatttactgtacattaaatacaaacatttaagaagatattaatacacagttttgaaagtgtaatataacaccactttttcaaaaagactagcctttttttcccaagcctcctattacactgctagtaaaaatcgattttcgcaggtgatctaaataaagaggggacgagtgtgttgtcaaaaatggtttttttaactactatgagatcatatagttctttttcctgataacatggaaaaaagacggacacacaaacactatcatgcacatacaatatatatatgagtgtgccctcctaaaacatttaggaagtgaggaagattgggaatcagatcgatatacatatatataatgatgtttacactttattctgttagcagttaacatgccaatcaatttcctatatcaagcagaatacaagaacaataatgctattgagttatattacattgattttatcgtctgcccattagcagtttggaacattgtttgcaaggaacgaatggtactgaagttggatcctatatattattgattcatctaagaaaactaaatatttacctttcatatcggctacacgggctacaaagaaactaaaggaaagatgtatgttgtaatacgctggatatcttatatatatatcaactgaaaacaaaaagaattgggccacattagctgcagaaggactcaaggaagtttctgtgtcatatggaagtgaaggtaaagaggagcctaagaaagcattccccatgggacgatatatgttagacaaggaacgagaaatgacttcatgtatagataaaggttagaacgtttgaatttggtatattgtatttttgtatatgtcattgaaatatataaagaactaaataaattgtttctatatgggccttgaactagagacaaactcaaagaagtccaggtattagagaacattagcgtattgtatatttgtaaaagttgttaacataaaaagaaaaaatataaaaatattttctgtattgcctatgaattgtagaggacctcagagaagtctcagtgtcatatgactcaaacgtgaaactaagcaatttgttcccaacaggtatgcacatcagaaatatatactaacaagcggaggttacattagaacttgtggatgttcatgttacatgtagtgtatatatgttgcatacatgtatatttggaattataaaatgggggcatatgagttgcagcgggactaaaggaagtctccatgacatatggaagtgatggtgaagaggagccaaggaaaacattctctcaagtagggtatatgttagataaggaacgcaagaagtcttcagatgtagatgaaggtacaatatttgagagtgcattatgtgttctgtgttttctctatgttgttgacatatttggaaaaactacataaattatttctacatggaccatgaactgtaggggaactcggaatagtctgggtgtcatatggcccaaaagtgaaactacacaattagttccccacagaacataagaaataaatatacataaacgaagatgatattatttggaactaaaggagattagtgtaatgtattgcatgtctcatataaatgtctattgaaaataaaaacaaatgagccttacgagctgcagatggactaaaggaagtctcggtnnnnnnnnnnnnnnnnnnnnnnnnnnnnnnnnnnnnnnnnnnnnnnnnnnnnnnnnnnnnnnnnnnngagcgtgcaatcaaatccaggcg

SEQ ID NO: 6614 - DNA, 5440 bp, Oryza sativa
  unsure (1)..(5440): unsure at all n locations
ccgctctttganaatcgatattcgagctcggtacccatcggcgtcaactatagaggaactcaaagaagtttcagtgtcatatggccatgaagtaaaactaagcaatttgttccctacgagattcggacataagaattatcaacacacattcgaaggtgagaatatttggaaatagcaagtttgtctgttatactttcatataacttatgaatgcgtctagaaaagcaattagggtattcatactgtaagttgttttcctttgaaccttttgtgtttcccttaaaattgtctaagcacgtacattttgatagagcgatgctattacatatctcggttaccaagagacactaaattttatgttaaaaatatatttgtcacctctcaccatcatccaggactgtaaaatttctcattttgatgactttcttaatcttgtatagcctatcgatatatgcatcggcatatatatatatatatatatatatatatatatatatatatatatatatatatatatatatatatatatatatatgtatatatatatatatatatatatatatatatatgtatatatatatgtatgtatatatgtatatatatgtatatatacatatatatatagatacctatatatacatttatttatatatatatgtatatatatatatgtatatatatatatatacatatatatatatagatatgatatatatatatatatacatatatatatatatatatatatgatatatatatatatacatatatatatatatacatatatatatgtatatacatatatgtgtatatatttatataacacaagaaaaaaaaaatatatatatatatgtatatgtatatgtatatatatatacatatatacatatatatatatatatacatatatacatatatacatatatacatatatatatacatatatacatatatatatacatatatatatatatatatacatatatatacatatatatatacatatatatacatacatacatacatagatacatatatacatatatatatagatacatatacacatatatagatacatatatatatatatatacatatatatacatatacatatatatatacatatatatatatatatatacatatacatatacatatacatatacatatacatatacatatacatatatatatacatacatatacatatacatatatatacatatacatatacatatacatatacatatatatatatacatatatatatatatatacatatatacatatatatatatacatatatacatatatatatatatatatatatatatatatatatatatatatatatatattcaaacaaatgcgagattattcgggactaaaagatgttagtgtattgtattctatgtaagacatagatgtctactgaaaataaaaataaatgggccatacgagttgcagagggactaaaggaagtctcggtgtcatatggaccagaagatgaagataagaaaagcaaagtattccctgcaaaaaattggtcaaacaatgaatacgaaaagtatttacacaaaagcgaaggtcagaatatttggaactaagatgtatgttgtaatacgttggatatcttatatatatgtctactgaaaacaaaaggaaatgggtcatattagctacagagggattgaaggaagtctctgtgtcatacggaagtgaaggtaaagaggagccgaggaaagcattccccatgggacaatatatgttagacaaggaacgagaaatgacttcacacacagataaaggttagaacatttgcatttggtatattgcattttcatatatgtcattgaaatatatagagaactaaataaattgtttctatatgggccttgaactagagacaatctcaaagaagtccgcgtatcatatggcccaaaaatgaaactaagcaatttgttccctactgggtatgaacacaacatgtagtatataatacatatacacgcaacagaagctgaggatatttggaactgtagggcactagtgtaatatatttcatgtatttcttatatacatgtatattgatttttttttaaaaaatggccttatgagttgcagatggtctaagggaagtttcggtgtcatatggaagtaaaggtgaagtggtgactcggaaagcatttcccatggaacgatacgtgctagacaaagaacctaaaaggaatctgcacagaaacaaaggtcagaatatttttaagtacagttgatgtattgtattttcatatatcatattgacatatgcagaaaactaaataatttttttctaaatgggcaaccaactttagatgaacttagagaagtctcggtgttgtatggctcaaaagggaagctaaaaaatttgttccccactgggtatggacataagaaacataagcatgcaaatgaaggtgagaatatttgaaattagcggatattggtgtaatatatttggtctatatcttatatacacatgtttattgaaaatttcaaaaatgggatgaatgagctacagcagatctaaaggaggtctcagtgtcgtatggaagtaacgatgaagagaagccaaggaaagcattccttagaggagggctttttttaggcaatgaatatgaaaagtctgtacacatagacaaaggtgagaatatttggaagaacatttggcgtattgtattttcgtaaaagttgttgacatatatagataatataaaaatattttctgtattgcccgtaaattgtagaggacctcaaagaagtctcagtgtcatatggctcaaatgtgaaactaagcaatttgttcccaacagggtatgcacatcagaaatatatattaacaagcggaggtaacattagaactagtggatgctcatgttacgtatattgtgtgtatatgttatatacatgtatatttgaaattataaaatgggccatatgagttgcagctggactaaaggaagtctccgtgacatatggaagtgatggtgaagaggagccaaggaaaacattctctaaagtagggtatatgttagataaggaatgcaagaagtcttcagatgtagacgaaggtacaatattttggagtgcattatgtattttgtatttttctctaggttgttgacatattcggaaaaactaaataaattgtttctacatggaccatgaactgtagaggaactcagagaagtctcagtctcatatggcccaaaattgaaactaaacaattagttccccacagaacataagaaatatatatacacaaacgaagataagattatttcgaactaaaggatgttagtgtaatgtattgtatgtctcatataaatgtatattgtaaataaaataaattggccatatgggctgtagggggactaaaggaagtctcggtgtcatatggaagtaatggtgaagaggagaccagcaaaaccactcctatgggaggatacatggtagatatgaaaaacgaaaagtctctgcaagcagagaaaggtgagaacaggatgtgtgcacaattcatgaattaatatattgttgacataatatagaaaactaaatgaattgtttctacatggactgccaactgtagaggaactcaaagaagtttcagtgtcatacggttcagatgtaaaactaggcaatttgttccccatagaacacaagaaatatgtatacagaaatgaaagtgagattattttgaaactaaaggagatgttagtgcaatgtattgtatgtcttatataaatgtctattgaaaataaaaataaatgagccatacgagctgcagatggactaaaggaagtctcggtgtcatatggaagtaatggtgaagaggatacaagcaaaacctttgctatgggaggatacatggttgataacgaacgtgaaatgtctctacaaggacagaaaggtgagaatagaaagtatactcacaattcatgaattgtagttttgtatacattgttgacataatatagaaaaccaaataacctgtttctacatgcatgagctaccaactttagaggaactcaatgacatttcattgtcacatggtccagatgtaaaactaaacattttgttttccacataacacaagaaatatatatatgcaaacaaatgtgagattatctgggactaaaagatgttagtgtaatgtattctatgtaagacatagatgtctactgaaaataaaaataaatgggccatacaagttgcattgggactaaaagaagtctcggtgtcatatggaagtaatgatgaagaggagacaagaaaaatcattcctatgaaaggatacatggaagacagggaacacgaaaagtccctacaagcggagaaaggtgagaataggaagtatgcataaaattgaattgataagtatattgttgatataatacagaaaactaaataaattgtctctacatcggcgtcaactatagaggaactcaaagaagtttcagtgtcatatggccatgaagtaaaactaagcaatttgttccctacgagattcggacataagaattatcaacacacattcgaaggtgagaatatttggaaatagcaagtttgtctgttatactttcatataacttatgaatgcgtctagaaaagcaattagggtattcatactgtaagttgttttcctttgaaccttttgtgtttcccttaaaattgtctaagcacgtacattttgatagagcgatgctattacatatctcggttaccaagagacactaaattttatgttaaaaatatatttgtcacctctcaccatcatccaggactgtaaaatttctcattttgatgactttcttaatcttgtatagcctatcgatatatgcatcggcatatatatatatatatatatatatatatagttcactatgcttgtaactcaaagatacaaagtggataattgtaataataataaaataaacatggttcaccaatctagaaatttcaaccattggcggatcttaatatatactctttccttgtcaaaatatatatctatctttgtatttcaaatttttacctcttaaccacttaagaaatgcatttccttaagatcttattcggtttagaggggattaaagaggattggaggggattgaggaggaataattccacaccacaatatgtgtggaataaatctcccccaatccgtccctcacagggattaaccaatcaaggcctaagggagctaccaaaatttatctcacaagttatactttcaattctttttcaaactctctgagacatatacatacatgtgtgaaacattaattttctttttttttctttcttttctatatggtatataaggatagaatgatattttattcataccgnttgtcgctgcatgcgaggatgacttggcatgctcacgtagcacctttttggg

SEQ ID NO: 6615 - DNA, 754 bp, Oryza sativa
  unsure (1)..(754): unsure at all n locations
cgggttgacttcaacgtctnnnnnnnnnnnnnnnnnnnnnnnnnnnnnnnnnnnnnnnnnnnnnnnnnnnnnnnnnnnnnnnnnnnatccgtagtcaatgtttgcggaatactgaatcaatggataatatgcttcaaaataaagtcaattacctccgtatgagtcatgttcttgagcggcacggctttggcccacttggtgaagtaatccgtagcaactagcacgaacctatgcccctttgatgacgaaggataaatttgaccaatgaaatccaaaacccaacctcggaacggacatggtttgatgataggattcaacacggcggcgagcgccaactgaacattgccgaaccattgacaagcttcgcatcccctatagtattagaaacaatcttcaatcatcctcgaccaatagaaccccgctctcctaagcaaccaattcatcttgtgggccgattgatgagttccacaaattccttcatgcacttctcccatagccactttagattgatcttcatctaaacacttcaataagacttcatcaagcaatgtgtatttgaacgcctctgggcgaattttccgattaaccttacgtgtaggatcggtcatatatctaatcaaaagaattctccaatcttnctcttgttcctgggcataaatgtccgaatttacaattaattcggcctttgaatcaattacagcgtgcccccagcgctctgtccaagaccagtcagaccggccgtgcaaggcttgtn

SEQ ID NO: 6616 - DNA, 977 bp, Oryza sativa
  unsure (1)..(977): unsure at all n locations
ggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtttagttccaaagtttttcttcaaactttcaacttttccatcacatcaaaactttcttacacacacaaacttccaacttttccatcacattgttacaatttcatccaaactttcaattttagtgtgaactaaacacagcctagaagctataagctgggaaacccagcttttccagattctcataagctggctaccgaccagctacttcgcagaatcttaagctccccaaacagaccctatatttccttgcacttagctaatacttcctctgtttaatattataagatattctactattatccatatatatatatatatatatatatatatatatatatatatatatatatatatatatatatatatatgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6617 - DNA, 17251 bp, Oryza sativa
  unsure (1)..(17251): unsure at all n locations
gatgagcnttttganncctgatgtaactcgatctactattggcgaattcgagctcggtacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcaatagtggatagatgcacgttctggttgttagcttgcatgtaggtgtacatgcagccttgcatagagggttagtttgttagtgcatggcgtgagtcccggtcaagagaattggctggttgttatcctttgcatgtaatttgagtctatatataatgagaaaaatgatgaggccgtgggtggttgaatcaacagaaacttgcatcttgtgctgcttgtgtgtgtctacctgagaagcctttgtggcaaaaatacggtagagagagagagagagaggaagtgatttcccaccagagagacaaaagtgtttgtgattaacacttgtagctgtgagtgagcaatcccaacacaagggagggggagagaagcgatggaggccatcacagaggtactcctcatcgagctccactggatccgaagcccgcttcccacgctaccacgctgtactggagatggagggtaagaggggacgggggagaggataattaagcgagagttttgccactcccatcacccggcccattattttatattttgttgcgattttcgtaggcggttatgttaaaagcaccacatcttaaaaatagacctgcatgtgaaaaatcatactccctccgttttatattagaagtcgtttgactttttttagtcaaacttttaaaattttgaccaaatttatagcaaaatatggtaacatttcaatataaaacaaatattgcatcaaaatatattcaatgttaaatttaatgaaacttatctaatatagatgttgctaattccttttttctttaaacaagcacaatgcctgtgtgttgcactgggtaatgtaaggtggataaagtttaacttcaatgatttaggatatggtatgaccactatccgtccgaatccgctccattttcacccctacgggagggactcgcacacaaccagaaatgccacccttaaaaacgcctctctatgtttcattgttaaatattattaccactcccacacatcatgcttgtgtatagtatctctttagcatcattgacttaacatatgtaaaacatttattttattaaaaatgctataatatcatttattttattatttgttttattgtgattaattttatcatttaagacttctatttttgcataattgtataagatttttaaatacgataaatggttaaaacgcatataaaaattgacggcgtcaaaagaaccaatagagtagtactaactaaagcgaagtttttcttttcgaaaatgacaagaaaggagtaaaaaaattatatgcaaggattgaccctgtttgagagagcttctagctgctgcagtttcttccagaatcagaagctcccccaaacagttcagcttttggtctagattttgagaagctgtaattgtataaaccagaaaataaactagggccatgtttagttccaaagtttttcttcaaactttcaacttttccatcacatcaaaactttcttacacacacaaacttccaacttttccatcacattgttacaatttcatccaaactttcaattttagtgtgaactaaacacagcctagaagctataagctgggaaacccagcttttccagattctcataagctggctaccgaccagctacttcgcagaatcttaagctccccaaacagaccctatatttccttgcacttagctaatacttcctctgtttaatattataagatattctactattatccatatatatatatatatatatatatatatatatatatatatatatatatatatatatatatatatatatgtgtgtgtgtgtgtgttaatgaatctacacatacatatatatgtgtctagattcattaacatctatataaatatgggcaatgctagaaagttttataacctgaaatgaaacggaggtagtactggatcgaaagcaactggaacaaagcgaaacaaaagaaaggtggtctagtcagtatcttaataaataaacccacgtttaaaacaaggagaaaaaaatatcaatttggttaagtttaaaactagattctaacaaatcataaaccagtacgtacatagtgtgtgtatatatgagggctgcctgccagtagcaaccacacacaaagcaagctcgataacgtcgatcatggcggcgtcatcctccctgtctccttccctcctcctcggctgctccttcctcatcgcggccgccgtcctccttcgccgccatgacagcgccgncgccaccaccaccaccaccacccacctccacttctacatgcacgacgcctacaccggcccggctcccaccgccatgcgcgtcgtctccggccgctccttgctgcagtccaccaccgacatcgtcgacggctcgtcgccgccgcggcagttcggggacatcgtggtgctgaacaacgcgctgacggaggggccggacgccggcagcgcgcgcgtgggcacggcgcaggggttcggggtgcgggtgtcggagggcgggttggtgacggacctgagcatgcacctggtgatggaggccggcgagcaccgcggcagctcggtggcgatcaagggccggatcgacgtcggcgtcggcgtgcgcgagtcggtggtcgtcggcggcaccggccggttccggctcgcgcgcgggtacatggccagcagcagctacgactacagcctcgccgccggcggcgtcgtcgagatccacgtctacctgcagcactagctagcagcctgacacactacgtacagctagaacgcgcgcgcctctcctgcatgcctatgccttttcatttcatgtgttcttgcttaaagttgtaaccagcgtcctgtgatgtattgtactgtactgtagctcgtctattttcgattttttgcatgagcacgtctgcatgtttgcagcgtgagcgtcgtgtgttccggtcacgttcgtgcctggaacgcgtcttctcatggacaattaaaggcagcagcgcacaaactacattttacattaagatatttctaaattaattaccgctactatagaaacgattttttcggatgagaccccttgaggttgctggcaaattaaactgctcccgcctgcaaaaatcgctgccccgagagcgtggttcaaagaccacatgcgaaaaaacaattttcgtaggcaggcttcttaataggcccgcctggcaccaagccgtttacccgtcccctccctctctttattctctcctcttaaaatatctcatttcctaacttctccacactccactccactcccttatcttctcctcatatcttctcgccccctcctcaagcggccatcccctcccccctcccccttcctccaccgcggccacgatgatagtggcgatggctacgacgacaacgatggtggcaagtgggcggacgagcgggagtggccagcaccagagggatccggcggcatacaggagcagggagcggcggatccggtggtggggaggacggtggagagcttggcggcaatggatccggtggttgggtgggcagcgatggtgcatccggcggttggcggtagggatggcaatgctgatgggaggtagggagggcatcagcaacagcgaggacgaaccccgggggtgggagcgggggcggcggcaacggctgcggggcataggagttgctatgtgtcacaccccaatccggcatcgccgtacaacggcacctgataggagcgtgtcgtaggaaaaacggcgcgaaccgcttcctacgaaaccgcgatctcagtactagtcccaggacatagcgctggtacccacggtgacaaatatgaatcattgcaatccttagaataaatagaggacttatttaccttaacttaggttgcaactcaggacagcccgagattacaaccgacgacacggacgaggcaacaccaacagcggcagcagcaacggaaacaacggactaacccccaacaccacaggcgacggctggggtctaggacgaaaccctaatcttcacttcacttcaacttcatcttcagagctggcagaactatatttatatagagagcaagggtgagtacttacgtactcagcaagccaggggaacttaggtggttaatgcaagtttcaaagaataggttgttatttttcaatcagttttgttttcaaggttttcaacaatctaagtgtgtgctttccacaaccagagcgagacaagtctcagctcagtcggggtgagaagtacaaaatttatttatcaagattttcacaactcccagagttggcctcaaagcttgttttcccaaaccaaaccatttttccaaacttcccaataatagtggtccccaaacgaccaatcacttccagggacttccggtcccactgtcccccggacagctaattgcttcccaagcattaggtttcccaaaccttaacaccttttcataaaacagggtaaaacaaaaactacgctaaggaatcacctcacattcgcccatgaccgtgggcacggctgttcgaacagtttaataacctctgtagagggggtacactatacccacacgacgttactagccttggtcacccagcccgtgcagaacagccacgtctggtgactttggggctttcacgacaaggtatttcgaaagccgacacagggttaccatatgccaatgagaggagtcccagaccaacaacaggttaggtcccagaccatactgtgccaggaagcccgggggttctccccgacaccaccccgttgaatccacatgtctcttggcatcaaggctcccttgattagctatttactcagccaggggcgtcccattccacccgtgtggtcgcactattgtatgctcggatgtaattccaaaggaatcggtccttagatgcgaccgcacaagtattccgcccaggaatggccttgtgtcgcaaattttatttttaaaactcattttctttcacaaggcaccgacccaggcgtcgggttttccaaagcttttgtaaaccaagttttacccaagaagttacacagattttaagtttgaaggagaccgtcgatactcgcacagagtgcacgaatatcgaggcgcaactagatagttacaagggaacatgatataacaattaacaatggaaggatcagatgcaacaagttgggtaggcccaccggtctgccttgcagacggggcaaatagattaagtgcaatcctatcaatgcataatatttttcaagcaaattaattaagttcaaatataggctcaatatgttcaaaggtggcttgccttgctcagggtcttgatcttcacgaatcttcaagaaatccgcttgacgaaaatccggtaaccgcaactatacgcaaacaatcaaaaacctaaccaaaagactgaaagaaagatcctatttagactaattaatagtgccattaaattgatatcaattttacggaactactggaagtagaacggagtcaatcggtcgagcggttgaggagatatggattttggaagcttaattggatttctggacaaggaaatgatctattggattttttggagtacgagaaatggcttatagaatttatagaaataatattctcaagaatattattgacagtcactgacatgcaggaccaatgggttgaattattggaatccccagattaagaggaaggattttatggaatttggaatataggaaatgttttatggagcaggagatatgatttattgcatttatggaaatgaatattctcaagaatatccttttatcactcattgacatgtggggccaacatatggtgagagagaggtgaattgggagggagcagatatagacttttggtcattgtgtttggcggagggagtaaaaatggacttcctttgtttcaatgggccgaggagggggagctggtcgatgggccaggcccacgagcggggagagagaagggggggggggtggctgactaggcaggggttgacttggtctggtggggtcagcggctgaggtggcgtccaggtggacgccacgtcggacagggaagggagaggaggccgggcggctcatcggatggccaacggcgctcggtgcgctccagcgaacggcggcgaatcggagtgggcggcaggcactggaagcgagaggaggaagcggggaatcggttccacggatcggaccggagagaaggggcgcgacggcggccggcgacggtggcgaagctcgccggattgccgacgtggatacgcgatgggagggaaaagggggcgcgggctatggttcgatcgaatcggtgtggtgttgcgacgcacacgcgttgggcgcggaggctgatggtcgccggtgttgctcgtgcggcggcgcggcgcggcaacgaaaaggcggctcggcgcgagagctgaaggggaggccggtggccacggggcagcaagggggaggtcaagaggggcccgaggaaggtggtggcgagcgggttcgaagagaaggggggaaccgacggcagagcgcggccgtgtgccgcggtggtgaatcgggcggcacgacgtgggaacaagaaagaaggccggcggctagggcggcggttcggggagagtcgagggggctccaggagggtggagacgagaggatacggcgaggggatggccgacggcggcgcgcggtcatgcgtggcggcagcgaatcgggcagagcgactgtttggggtggttcaagggagctcaaggcgggtggtggcgcggggagtccccgagagggtggccaacggtggcgctcagccgagcgcggcgtcggcgggaacagagcacggcggggtggtcatagcatcgagagtggcatggccggggaaacagagagggggcgcgaggagttccgggagggcgacagcgagctggttcggcgtacggtaaggggaaggggacggggagctcaccaatcggtgaggaatggtgtcggcggcgatttgaggatgggaatgggaggaaggccgttggcgttgggcggcgaggccgacggcggcgcgcggtcatgcgcggcggcggcgaatcgggcagagcgactgtttggggtggttcaagggagctcaaggcgggtggtggcgcggggagtcgccgagagggaggccaacggcggcgctcagccgagcgcggcggcggcgggaacagagcacggcggggcggtcattgcaccgagaggggcacggccggggaaacagagagggggcgcgaggagttccgggagggcgacagcgagctggttcggcgtcctttaaggggaaggggacgaggagctcaccaatcggcgaggaatggcgtcgcgggttnccggcccgnngncgaatttttgaaaggatgggaaggggaggaaggccgttggcggcgcacggggacgaacgtgacgccgaagcgggcgcaccagggaaggaagggacgcggggtgggacggtttggtgacggcgcggcgttcttggccgtggcgacgaaggaggcggcggtgctccggggttggccgcgcgacggggtaccgaggttgaggaaggatttggggctcggtgggtaggatttataggcaagggggagatcacagacgagctggcgctcggctggcggtggggcgatggtttcgtgggggacccgaaaacggcaacggcgagaatgcgttggacggcgaggtcggtggatcaagcggtcgaatttgaacgcggagcgcgggccggcacggtcaaagtgggggcggcgggattcggcgccgggaaggaaacgagatttggaaattgaatttggatttcgaacttgaaacttggtctcaggaaaacagggaggagtcaagggaatgcatccaagcgggaattcggtatttctttgggatagatttcaaagatagataggtagacggacggaccgatggatatcgtagagatagatagatcaacagagagatcggtagacggatagttagatgggttgacaggtagagagatcgatgattagatcgagagacagataggtcgatggataggtagataggtagatcgatcgaaagagagagggacgaaatgaaccaatcaatgagtttgaattttgaggattgacgacaaatgcggatagggttttacaagaggaatccgaatacggaaattcgaactctcggattggtgtaggtagattgataggtccaaactttagggagagggagagagatgggctggaatagaaggaagaagtggaccaggaaaaaggaagaaggaatccaacctatgagggaggttaaatagactttcacagagagatttaattggaaggttttagggctggagtctggattcgaatttcgaagtcgatacttggtctcgggataataggaaggagtcaaggaagggaacaatattcggagacgagtcaaataatttagagaaggagagtgtaacttgggagtttgagttggactactcgacgagatatgtgggtaagggatttagaagagaaatctgaatagaagggttcagacgagattatttggaacggatattatcctgggatagatctatactcggggattgttctagaattacttggatggggtttcaaagagaggggaaatctcgggaattgggtttcataaaaaggaattcaatatggatctgcaccaggggattcggagcaaatactcggaaatggtttcaacgaatgacagagcgataggtggagggagattacaaatatgggagttgagatcaattattcgaaagagagtcaagggaaggtagagagagagggagagatgaaattgagaggttaagttcgaattcgagagtcggtttgaaggaaacaagggagtatttaggtctcggaggtgaatcattggactgggttagggttcgggcattcgacaaagatcacgggtggggtttcaggatggaactccgaatagaagggatcgaacttcgggattatattgggatggaaattttgaggagacgatctttgataacagggtatgcagacaagggagggatttttaattgagatctatggcacaacttagactcaaacactcaaagaacgaaattttcacaattaggatttttaataaattagcttttaacgtctcgcgaaaagtggggcgttacactatggttttggattgttcattttcattcgatttaactttttgcattatgacagcttaagcgcccgcatgcgaaaatactgtattttcacatgcagttgctcttccccatgtaaaaatactgactttttggacatctgggtgtaggcgggtcatcccctatctgggaaaatcgattttagtcgcatggaaaaatcgtttgtgaagtagtgtactacttttcaattcatccaacaaatttgtacttattgatagttgcatcattaggtaattattgatagttgcatcattgggcgtgatttttccagtcaagtagagtacataattatataaacttccaagtacatcaaagagatttacctcaatatttatttctgctatttaacacacttagaagtgcccatataatcttagatggatgtatagctatcttcgtatatatactctctgtcccataaaagaaattcaacttttagctataaatataaatgtaggctatgtacggtttgtagcagaagttagtttttatggtttagatggagtagttcaagctaccacatgaactaatattccatcttcacctcaatcacacatccctccagaaccgcgtagccagcccatccgacggacgggcccacttacacataccatcccacttatacttttgtccatacttcgtctaaaaggttaacccggagtgatatagtttgagggaagaggccttataagggcgcacccttgctaaactagaaagtggtactaaacatgcgcacacagttatcatgggttacacaggcctaatccttattgggtcgggatgtctgacacacacccccctcaaaggacccgacgtccccgtcggtccaaatcacccacatagctacacaggcatataagcaaaggtatagaaacacaccccctgttagcacatgcccgaacgtccagtgttggcatcatatgccatgccatgtgcctcacgcaaagtccacatgcgccatgtgccatgtgccctcacactgacccatacgcgcaaccgcgagggtcggctctgataccatttgtaatggtcctcccttcggtggtactaaacatgcgcatacaactctcatgggctacacatgtctaattcttattgggctaagatatcacaagacatgtgctcgggtgtctatgtacaaggaagaaaaaacatgcatatcaatccattattatacggtaagtagtacatactagtacttgtggagcaattattatacggtaagtacataccagtgcttgccgagggatgccaatcacatcttaatatggtacctggatatatgggatatataatccaagtcaaaagtgaagttatgtgaacagctttatgatggaaaacgatggaaaacaactttcatgttcggtttagtgagcacttttttggttcagaataagtccttccctttcatgtgaattccccagcggccaattaacaactcgtggggccctatctattcattctctctggccccaagacgaccccctgtcccttggactcaagcacatcgctatgagtggaacgtagaccataacataatttacagatctaagatatgatcgggcaagtaaagaggttttaatatagtgctcgaaagatggttatgaatcgattgactaacccaattttatgtttagattcataactaggacttttttttactgagggagcatatacagtctgttctaagtcaaaatgtatattttatccatcaattagatttaatagatctcatatctcaaacattctctatcgcaaacttttaactagtgtaattatggatagtttaattaactcaagatttcactcaaatggccatcgtcacatctatacctgctatatagttacagcccactaaagctaaagcttaacgtgtaaacatgtcatctcatcgtccattactaataattgcgtactaagctccaacaaacattgcagcatcatctacaattcattaaattatgcaaataaaagtgcaagtatatccaaccatcaccattcacattattttcataatattttcaacatacatatccaacatttttataatacttaacatatatattcatccatgtaatagaagcgtgggatatcatatttcatccagaatctgctacagagtctataaagtttatttctctccttacatagtttagcaaacctgttttatctgttgttaatatctaatatttttttttacacttagctcgattattgaaaaaacatattaaaaattacccccttagtaatttccgaagcaaagcgcggggaatttcctagtatctatatcatccagtaccttattatctctgtctctctcgtctcatacttattcgcttgtttctataggctgtctctctcgtctcatacttattcgcttgtttctataggcccgttagaacgttgaaaattcatatggtcccctcatctcctaattataggaggttgttgggcatactcttatcccttctttatatgcggctcccaagagtattgaaaattcgtcgaacacggtacaatcatacgtaccatatttgtcctgacagtcacttgaattcattttatatgagagctgatatatatatatatatatatatatatatatatatatatatatatatatatatatatattatatttatttattttagggtgtgtttagttccacgctaaaattggaagtttgactaaaattgaaagtttgaagaaaaaagttaaaagcttatgtgtgtacaaagttttgatgtgatggaaaagttgaaagtttgaagaaaaagttagtaacttgttatatacgatgttcgtgtgacgtaacggctctctcctagaatcacgacgcaaaagcgaagaaagaacatgacatttaccgtccgtttcccagctaaccatgcatggtggcgttcaccatacgttcccaatcgcactaggaccgtcgtataagtctataagaagaaatcgttcacatagcattttttatctctatagcgcatgtacagcaacggccggaatatttgattatttcgttgtctctcaaattgtcaattgtcttctgcttacctcgctatatacccggaccgcgaaaaaaggtcttgtatgtacactgatctaattaatgcttctttgacaaactgcaatcatttcatcacaactattcacttatttaattaccaatacccacggagcgcaaggcggctatatcatgatcatttcacttcctatggagaattttcaaatacaggaaagtttccaaaccatcagtagattggcatagcagaaaaatacacatcaacaacagaaaaatagacgggaggtggggcctcatgcttattctccctccgaaattcatctacaatagtctatttcgttagaattttaaaggggattggttaaaaattagtcctttcttcaatgggctctatagaattatttttcatatgacacaaatgctctaatatttttatgttttgcttataaagtgcaagctgctagttgctttcacaggattagtgaagcaagagtataagttttgagcaattgagatgactgtgaaatttagtgttatagctcgagtccccaagacaagtatcctgcttggtcattgccttcgagtggtttaacatgcttaggttgaagttaataactggctaactattctatcaaaggtttctcctttgcttattacttggtgttgtggttattatattgaaagatgccaatcgtggacatggacacattcagagtgagtggctatatatatatatgattgtacatatggatcctactcattcaaatatgtgtggtacttgcggttggtatcagaggtcttacaaggtgctttgggctcactgcagaacacatcgggtcatacccaatttggtctgaccgatatagtttacttttggtagttctttctttcgtataagactttggtcttaagtttcaggctttcttccaaaaagctaggtgatcagatttaacaacagcctatgattgatggaggtgaacacatggtgaaaatagatcaaatatagcaacaaatttttcttgaccgggctctcagacaccccctcaatactctagctccacccctgcactaagccataattacttcaaagcaagccataattacttcaaagcaaaatatctcatgtatgcagttggctgttggcctagcaaccaacggaagaaaatattttgttatttcttagcagcctacttgagaaacacgtactccacattatgttatcgaaaaaaacaacaactgatgagtaaaaaaaaagaaacatacaaagattaatcagcaatgtttatcagtaagaattttgaaatcccactaaacacgcggggcatcaacgagatgttcgcgcatagcgaatgcaacgtaacaaaaagaaaatcaacgtggccgctgaagcaagtccagataagcgattcacgggatctcgttcgacgcgaatattcacgcaatatctttgtgcctctgttaactattgagaccgttttttctttctccatggccacacctcagttttggcctagcttccccggtgaagatgcaggagaacgtcgtcaatgctggtgcggcgctggaagcaaacgattgtttactccccggagattgtggtactgtattacactacctctaattcaattagctagagtttttatgtcattctcaaaaacttcacattcaatgagggataccagtgattgcaattttggtccccaccggcaaatcaatatatcgaccgaaatttttgggttttctcaaatttttgttgaagttggtcaaagtttattcaaattcattcaatattttagaaaatttcgatccgaaaattgccgaaaatcctaaaatttcataaatttcagtcgtactgaaatcgaaagtgtaaaccctagggatacctaagttattttccttctctactaaattgccttttcaactctacaattaacattcttttcggatgcatctgatggagggagtatatcccatcttactataaaattgctgctcactaacttttaaatctcaactagaaaggtagtccgcgcgatgcgcgggcatatgtatttgtttgttaaaaatcggtctgacaaattaatttcaaataaaaagtaagatgttttttcatttgactttttctttcagtgagccgagtcaaatgatgtggtgttttttttttcaatttgactcagaatcgtgctctctctctcgtgcggactctctcgtgaacggatcaacatatacgcggagtatgtgcggctgactcatggatgtcatcatcaagcaatagaggacagaatcatcttgaagtttttaagtaggttaagattaagaatagatctaatgattgaggatattgaaaaaaatcaatggttagtttttttaatataatttatatgaatttttataatttattagatggtcacatgtcggtttagggggattggtattattgccacatggcgatttagcggcgttacatgatctaaatttaatatttagtatttaatatgatgcttaaaaatttgatcttaaacatttatattagaagtttgagctatgtatatggattttgacttatgtatttaattataaataacacaataattcaaaaaaaattgagaaaatatgtaacttgagttttatgatcatttagaaatccgattattaatttttgatagattgagtatcagctaaaaaatagcaattagcttaagaaataggagagaaggggagagttaggagggtagagggagaacgtaagtacgtaagtgcgcatatatggaggtggtggtgaggatgcaggtatcagattttctttttagatgaagatctaacggttaaaattaatgggtccatcaattttagaaaaataatggctaaacatttattagaatttttatgatttttataaaaatctgttagctagaaaattaaaagaaggaaggaaggaaagaggggggatgtttgtatcgtgaggagaggaggcccgggaggaagggggcagtggagatgggttttggattttttctaaagatagatctaatgatggagtataatattatgtcaaccgtattaagtgaaaattgtgggctagttgttttgttttctcgcatagtttctttgatttctaatttattagagcatcatgtgacaagctataagtgtttgtaggaaatttaatagactttagctaaataataggaagggggagagaagaggagagccctgagtttttctgagagggaagggtctatcaatttaaataaaatcgatggtcatatgtatttttttctcaaaaatatgatttttaaaaataatttattagatgtgaaatgtgaagacatagaggtgttgtaatggacatctaatagatgatgatatgtgatatattatcaatttttatataatgtttaattgatgtttagttgtcacggaaaggatatggatttatgtctgaaaatatatttatcatatatcaagaaaagcctacatggatcaaactaaaaactgaatatatttaaaaaatatactaatcatttagctatctattgtttatatataatcatttagactatgtgacaatcggccaccgtaacagaggaactcacatcctgtaactatatctctaacggcttatctttttttacctattagatgaccaatcggatgtctatttctatatcgaaaacagataaccaatcggatgtctatttttatatcgaaaacatagtaaaaagagtgaatataggacttcgctcattaattaatttaattaaacatataatcattcaagcgtatcataaaattaatgtatagatcgtccataaaaaaagttagtgcttgcatgttgcacagccagctcgatgctccatgcatggaaagatataaccatttccaatattaagttatcatttccaatattaagttatggtgcatatctcgtaataactaccttaattagaaaaagaagaaaaaagaaagagtaaatgaggggaggataggcgtacttacatacgtaagagggattttattttgatatgatgttttaaattattgggtccactattttaaatgaaaatcgactgctagatattttgttttttctcataatttctacaatttattagagcatcacatagcggctctacatcttttgtaggagtgccacatagcagattacgaacatttgtagaaagtttaatagacatttagtatataatagattaaaggtatcagttttttaattaaccgacactcatagtctattaaaggtgcctggtgttatgggtgnnncnnncannnnnnnncnnntcnnnncnccncnnnnccccncaaaaaccctccccgcaaaacctccccacaataaaccccccacccccatcactaccacaaatacccaaaanaatattcttcaacaactttctcccttctttcaaaaacacattatccttcctatttcctatcgactttttttggacaactccctctcattaataatgtaaagtctgttgcgcctggaaattccctcgggtttatttttggcttgagggaaatctctgtttgcttaaaaattttattaaaaggtctctccactcggctttggaaattgctaacgccctcgggattccaggggttcgactgtctcttttcctgggaaccgggcgggttccttaagaatttttgaccaaacactttttgaaagggcctggttttcccggtttgaaaccaaaaattggccaagcttgtgtcgattgccccn

SEQ ID NO: 6618 - DNA, 23559 bp, Oryza sativa
  unsure (1)..(23559): unsure at all n locations
ccgctctggtactagacccagtggttagcattgtcaagctcggcggactcttaattgaggcgggcatcgcactcaacacctttttgttaagaccctggactaaacacacattccttgggcggaattaatacccaagtaatgcaccctccctcggtgttatccaaggattgtcagctacacaaattggccagatccctgttccagttacattaggcactaggatgaatattcgcgcagcctataacaccaatctctaaatgtttttacataaattttgctttttattaaaagaaggaaaatatgagagataaaaagataatagaattaaaagataataattggagtaggagcatacggagtacgtacgtgtatgtacatccgcgggaatagtgagcccaagtggattaggatgggtggactatttttttttacatctaatctaatggtcaaaaataatgggtccactaatttaaataaaaatcaatagttagatgtttctttgccacgtggtaggttaggagcgtttgtagagtgccacgtgacgatccaggagcgtttgtaggaagtttagtggacttttagtactccctccgtactcataaaggaagtcgtttaggacaatgtttaagtcaaaccctaagaatataaatcatgaataactttcaaattgttgagtttgaaaatgtaaaaattatatgaatatatttgtcttgaaaaatactttcataaaagtatacatatatcacttttcaataaatatttttatagaaacaagaagtcaaagttgtgttttggagaccgtgtcgttgtcttaaacgacttcctttatgagtatggagggagtatataatagatagatagatatgcaagtgtgctacatcatcatctactagtaattattatatagattattttaaatatcatataaatatgacatatcatttataatattgttgtatttttagaacttaatatatatgtaatcaatgtcgaaccattatctccacatcatttatatattatttaaacatatatatctatcatgtataatatgcattcatctatatattccacggcaaagtgtggtgtatcgactaggattctatataagtacagcagctgtaagcattaaaggctgcctggaaccacacacaaagcaggcagccaagcatagcccacagcaagctcgaccatggcgtccctctcctccctcctcctcggctgcttcctcctcgcagccgccatcttcctccaccgcaacggcgcctccaccactaccacccacctccatttctacatgcacgacgcctacaccggcccggctcccaccgccatgcgcgtcgtctccggccgctccttgctcgacgatggcggtgacgcggtgccgcgtcagttcggcgacatcgtggcgctgaacaacgcgctgacggaggggccatccgccggcagcacgcgcgtgggcacggcgcaggggttcgcggtgcgggtgtcggagggcggcatgtgtggagattatggatacccatatctacatgacagttgtaatttagtcggatatacggtaccaaatatagatggaatatctctatgaagactcgggttaggttctaaacttgtatgtcaaggaaatacccgggatcttagtcggttacgtttgtattttatctataatcccatattccgttaggatatggattgtattttgtaaagcggactccttcccctatataaagagggtccgtgtgcctcttgggcgcgattctttttcccaatttatacaatcaataacacactcggcggaatcatccccggacaggagtagggtattacttcttgaataagaaggcccgaacttgtataaaattcttcgtctccaaacccatccactttcctagcttgatagccacccccttttattattgccgaaatcttgtttcgacagttggcgcgctaggtaggggtagcgtcaagttctcaccgactaagtgcgataggtttcgtttctggcatcgacgacttcgccttccctcccgggcaggcgttccggttcggcagcctcaacttcatcacgaacgacttcggcaagatctctcttcttgactcggattcaaaccagtcggggagagaccaggtccccgtcccgtttggtattccgaactcggccgaggcctactccaagatcatctctcccgagtcggcttcaaaccactcggacgagatccaatctactcttccgcgaccagatcaagacgacgggtcctatccttcaatcctgatgaaacttcctgatgatttgccgctgtcttcacagtcaagacatctcctactcgaagatctaggcgagctccggcttcggccccgatccgatctagatccagggaggttggcgttatagtccaacctctcgggatagtctcgacggaagagttggatggctacctcagctcccctagcgtcagttctcgaccaaccgagatcctcgactacgacgatttcggctaccactacgaccacggcgacctcgacaacttcgacgacagctatgaggataactacacgcccctcttcttcggcgtattcatggctgacaacgaaacggaggaacaacgctaagcccgagaagcggaccaagatcgcgcacggcaagaagctgaacgtcgccgactggaggaagagcgacagcgacaagagcgagaacgactacagcgtgagcaacaagatcgcgaacggattgcaaaggaggctgaagatcgatgacaacgtgccttggaatctgggcggcgagcgagagagctcattgggcaacaagacgtcgatgggacagcggtctttcgcacccccccagcagaacgcggttgcagcaatcactctcctcgacaccctcctcaaggaagacgcactcaaccaagccgatcatgtagtcaacatcttgaaccagacgaagaccatgatcgctgcctcggttccagccaactctgcaagcacccgcaccccgactggtagccgagtccctcaccagccgagcctcagcattgccggcgccgaatctagtcgtaggagcaggggacatgatgaacggtctgttcgttcgcctcccgagcgatatagggagcgccgagttgaacgaccacactccccacatcgaaggcgccccatcgatcttcgcgacaccatcaaccagcgcgcgcagcaagaggccatcattcaccggatcgctacgacgacgacgtggatggagttgctgccttcacaagcgatctgcgtcgagtggattggccagccggctttaagccgactggaattgagaaatatgacggcaccaccaaccctgagtcttggctcaccgtctatggtctcgcaatccgcgcagcaggaggagacagcaaagccatggcgaactatctacctgtggccctagcggattctgcccggtcatggcttcacgggctaccctgcggcacgatcgcatcatgggcagagctactcgaccacttcatcgccaacttccaaggcacttttgaacggcccggaacacacttcgatctttacaacattgttcagaagtctggagaatctcttcgagattacattcgacgcttcttcgagcaacgcaacaagatctccgacatcaccgacgacgtcatcatcgctgcctttactaaaggcattcgccacgaggacctagtcggcaagttcggacgcaaacctcccaagacggtcaaacagatgtttgaaaaagccaatgagtatgccaaagccgaagatgctatcacggcgtccaagcaatcgggcaccacttggaagccaaagaaggatatgccgaccgcgggagggagtggaagtaacaaccacaaggatcgcaagcgtaagcccgaagaacttgtggcgaccacctctccgtcttcccgacaacgttcccgcattaacaccttcgacaagataatgaacttccaatgtccgcatcatcccaactccaaccacgtggccaaagattgcttcgtctacaaacagttcgcggagcaatacgtcaagaacgcatgtaaaccctcagacggagatcaaggcacatcaaagaagaaagatgatgaagacgatgccatgactggttttcaagatcatcgcaaagaacttaatcacatcttcggcggacccctggcttatgaatctaagagaaaacagaagctaacagaacgggagatcaatgcggttcagcctaacacgccccaatatcttcggtggtcagagatagcaattaagttcaaccgctcggatcatcccgaccgagtggtccactcggggcggtaccccctggtactagacccagtggttcgcaatgtcaagctccgacggactctcatcgatggtggcagcgcactcaacatccttttcgctaagaccctggacgatatgcagattccttgcacggaattaaaaccgagtaatgcacccttccacggtgttatcccaggattgtcagctacaccactcggccagatcactgttccagttaccttaggcactcgggagaattttcgcacagaaaatgtttgtttcgaaattgctgatttcgagacagcatattatgctatacttggacgaccggctttagctaaatttatggccgtcccacactacacctacatgatgatgaagatgcctggtcctcgaggagtcatatcactacggagcgtcatcaagcaggccgtcacatgtgacaaagaaagttgtgagatggcccaaacccacgagactactctcgcccgcgaagagatccgactggctgcgaccacggcaagcgagggagaagcgcctgcaaccaagctgacgaagaccgaagaaagtgatgccaagacgaaaaagattcccttagatccctccgatcctgataagactgctgtaataggcgctgagttagattgtaaataggaaagtgcgctcatcacctttcttcagaataataaagatatttttgcgtggaaaccatccaatatgcctggtatccccagagaggtgattgagcactctttacatgttaaggaagacgccaaacccatcaagcaacgactccgccgttttgcacaggacaggaaggatggatcaaggaggaattaaccaagctgttagcagcaggcttcattaaggaagtccttcatctcgattggctggctaacccagtcctggttcggaaaaagacggggcaatggcgcatgtgtgtcgattataccaacctcaacaaatcttgtcccaaagaccctttcaggttacctcgcattgaccaggtggttgactcaacggccggctgtgagttactcagcttcttggactgttactcgggatatcatcagatccggctaaaagaatccgactgcttgaagacctcgtttattacgccctttggggcctactgctacatcaccatgccctttagattgaagaatgcaggagcaaccaatcaacgcatgattcaaagatgtttttcaactcagatcggtcgcaatattgaagcttatgttgatgatgtagtcgtcaagaccaagcagaaggatgacctgattgcggatttagaagaaacttttacaagcattcgtgctttcaagatgaaactaaacccggaaaagtgcatcttcggagtaccgtcagggaagttgctcggatttatggtatctcaaagaggcatacaggccaacccggagaaaatcaacgccatcctcaacatgaaaccgccaagctcccaaaaagacgtccaaaagctgactggttgcatggcggcgctcagccagttcgtctcacgactcggcgagcgggggatgcccttcttcaagctgctgaagaagattgacaatttccagtggggacccgaagcacagaaagcctttgaagatttcaagaaacttctcaccactctaccagttttggcctcgccacatccgcaagagccgctactgttatatgtgtcggcgacctcccaggttgtgagtacggtcctggttgtcgagcgtgaagaggaaggccatattcaaaaagtccaacgtccaatttatttcgttagcgaggttttagctgactccaagacaagatattctcaggttcaaaagttactatatggtgtcttaattaccgtcagaaaattatctcactactttcaaagtcactcggtcacggtagtcacatcgtttccactcggggatatacttcataaccgcgaagtaaacggacggattgcgaagtgggccttagaattgatgtctttggacatatcgttcaagccacgaacttcaatcaagtcacaagctttagctgatttccttaccgagtggaccgagtgccaaaaagacatgccagaggaaaagatggaatattggactatgcattctgatgggtcgaagaggcttacaggcactagagctggggttgttttaatctccccgactagagaaagattgagctacgtattgtggatacatttttctgcgtcccataatgtggcggaatacgaggcgctactccatggactaaggattgcaatatctctaggtattcgccgactaatcgtccgtggagactctcagttggttgttaatcaagtcatgaaagagtggtcatgtctagatgataatatgaccacttatcgacaagaggtacgcaagttggaaaataaattcgatggactcgagctcacccatgtcctccgacataacaatgaggcatccgacaaactggccaattttggttcaaaacgggaagcagctccttcagatgtgttcgtcgaacatctttacgaaccgaccgtgcccagaaaagagacagtcgaagccatggatactcaaggcgtaagcatgatcaaagccgactggagagaacattttataaaatttttgagcaaacaagaactccctcaagacaaaaatgaagccgagcggatttccaggcgcagcagactttacattattcatgagaccgagctgtacaagaaaagtccatcaggaatactgcagcactatgtgtctttggaagaagggagacagttgttgaaggatatacattctggtatttgtggtaatcatgccgctgcacggaccattgtcggcaaagcttaccggcaaggttttttctggcctacagctgtgtctgatgctgacaagattgtgcggacatgtgaaggttgtcaattttcttgccagacaaattcatttgccagcccaagagttgcaaaccatcccgttatcctggccatttgtggtctgggggcttgacatggtcagcccgtttaaaagggcagtcggcggttacacgcatctctttatggctatcgacaaattctccaagtggattgaggctaaacaggtcatcatgatcacagcagataaggctagagattttttcatcaacattgtgcatcggtttggggtacctaatcggatcatcactgataatggcactcaattcactggcggagcatttaaagacttttgtgaagacttcggcattaaaatttgttacgcctccgtggcacaacctatgagtactggacaagtcgagcgtgctaacgacatgatacttcaagggatcaaagcacgagtttttgaccgactatgtccctatgctggcaagtgggtagatcagctgccgtccatactttggtctttacgcactactcctaatcgggctaccggccagtcgccgttctttttggtttatggcgcagaagcaatgttgccgagtgaagtggaatttgaatcactacgatttcggaaattcaacgaggagggctatgaagagggccaagtagacgacatcaatcgactagaagaagcccgagaaacagctttgattcagtcgactcgatatttgcaagggttgcgccgttatcataatcggaatattcgatcgcgagcctttttagtcgacgacctggttctgaggaaaattcaaacaacacaggatcggcataaaatatctcccttatgggaaggaccgttcataattgctgaagtcactcggccaggttcttatcgactcaagcacgaagacggtactctcatcaacaattcttggaatattgaacaccttcgtcgattttatgcttaggcatttcgtttgtatctttcctctttgactgctaacttcaaggttttccttgaagttttcagtcagggggctactatgataataatggagtgtgatttttatcaattcaatttgcttacttgatttatcattgccctgtttggtctttcgtcttagccaatgaggactgaaggtttttaatagcttttgtgggttttaggctcaataaggtttgacaaaggcttttaagaaatcagaagctaagtatggaacaccaagcatagcataaattcatcagtattgtacaaattgagcctccaccgtcattgatcatcaaaatcattgttatatcaatcagtatcagttttttcatcatcagacttatcagacccagttggccgaaggtcgaaatcttggaatctctcaactacatcagcagcaatcttgtcagcggctttctgctcatcattgatgaggtcaagagcagcttcttcgctcgtcccgtctgcaaagccatcaatggcatcaatgtcaactcttggataaagggatttggtcatcgccaatgccagacttgctcccatacttccagcttctttgatgttcttgaagtaagtatctggtgcgactctcagcttgtcgaagatttcggcagcatcaagtgtactcgaaccggcgttattgaagaacatggcctagataagtggagtagcggcattagcgactttatccctggctccttcaaacttgttgatcttgtcaactaagacatcaaattgtgcttgagacttgatcttgcggtttgcgtcaacagattcacattaatgaatcagcatatagaagataatggcttttgaggtattgattattggtaccttcaacctcctttaaagccgaatccctctatcttgccagctctgccttgtcattttccagagtttggatctgtttctctagttgagatatcttggcagcttgcactacattaacttcggttaatcaagattacagagataacagcacaaatcagttgggcagagtttgcgcgaaccttttgatgagccactcagttcgaaattggactcctggagctcagcaatccgatcccacagatcatgttcattcttcttggcaagttctctggcctcgtgcaattgactcctagtggcttcgagggttccaaaatgaggaactagtctctctagggttgcggttttcgcctcgttcctaagatgaatcctctgcggagcagtttaatcagcgctcgagccagacggcaaacaagatggctgaggtcaggcgtcaagggacttacatttacaatgcgagtcgcttggttgagtgcctttttcagtaggcatacctcttcatcttctttttgccggtttattacaattccttgaggttgcaagttgtcatcccaccacttgaccagaatgggagggcacgaatcttcggctgcttgtatacggggaatttcttcttcatcaccgatcattggtcctaatgtatccattgacaaaggttagacaatcgatcagagttatttgggtcaacatggtttcagacaaagtgtttacccgtaatgatttctggacgaggacgagtggattcggatgcctttaaaggggatccagatctctggtcattgctggcgtcttgtccgtgagggttgtctgcttgggtttcgacttctggaacctcttggcttggccctgcgtccgactggtttccagtcgggggctcctgattaactccggcttcggcttcggccgactggtttccagtcgggggttgatcaccggattctacattatcggttgccggctgattgtcactcggatgatcctcagcagttggcccggtttctttggaagaacttgtgtccatgttagtcgggtcagagtcttttccagacggatctatatcagatggtttcctgcaaatttgattatcagtattattgccacaatgggtgcgcatcaatgcaagagagatcgttatgtaagttgcacctagaagacttcctgatctttggcacagggcgactggatgttttcttccttggtgtagcctgttttgatagtttcttggttgtctctcggtctccaggcctcctggcggtatcatcggcttcgtcgtcacttaaaaccagcttcctctttcgagaatctggctggctgattggatcagaagcacttggttgagttcagaccgaattcgtggtcctccgctcccttgcccagtttggtggcggggagatcggcgttgagcgattgggggatccgacttcatcaaagcaaattcctgggtgtaatatccttcattgttaactaattcaacaagaaaataagatcatattttgagaaaggttgaagtgtatgaatacgtaccggtggaggaggattgaatgcattgaacggtacgactggcagcaagtgtgagtagctgacaacgatggcgtttgagaagatcttatacatcctttccttcatgaccttgaagtcaagagaatctggatcttcacggtttgggtcatgcttgccgtcaaattcgaaggctgtgcgagatctttctttgattggagctaactgacacttgataaagtgccgggtgatctgttctccttgaaggccctgttctttcagctttatcattctctccatcagttctactgcttgtgcagcttcatctcccattggcagtgagttccaagtatcccgataaactggaggaaggcaggagtactcgggaagaacaggctcggggttttgaacataaaaccaatttgcgtgccagcctttatttgaggtcttgaagggcatggagaagtatttttggcttagtgttcccctgagttggaaaccagcacccccaacgacgcatggtttgctcttatttagctggggcttgaggaagaagatgcggcggaacaaggcgaaatgaggcctaatgcccagaaaagcttcgcaggcatgaataaaattggcaatatgcactatagagtttggattcagatgatgcaagctaatcccgtagaagttcagaattccccggaaaaatcttgaggttggaagagaaaatccgccatagaagaaatgagcaaataccacgatttcgtgtgtatcgggggtcgggaatgcctcaccaaatgccggtcgccacccgatgatctcttttgctggaagaacgccgtgcgccaccatctccttcagattgtcttccgtcacatcggagggcgcccactgactctcgaagctttctctttcttccgccatgaatgtgaactggatggtctgatttagttcgagatacggctggaaagggatggggaatcggagcggtggatgcgaggagaaatttcgtgaagtttttgagggtggattggagcggattgatgaaccctagtttgcccggcgcagttttgcactgtagcaggaaatggggaaagtggcgagagtctcggcggggaagacgaagagacgtttttcacttcggtattattggggtatcgggagtactaatgggcctgggcctgtacagtacttcagcccaatactataatcagcgtggcctgttgtgatccctagggacttagtcaatttttgctttggcaatttgtgttcacaatggtgtggcccaatgctgttaaaatcctttttaacgcgattcaataattctttggaattattatgatgcatataaaaaggtgcccgacagaaaggtgttataccattttttgtaagctttattaggctgcaaaagctgtttgggttgatttgagatgactggtttattaataatcattcttttagcatgttatatgcttattttggttatggtaagggtcacagcctaggctattagacttattaattaccatgattttctatcatgtttggtgggtcattttatgagatttttactcggattcctatcaaacatgtctatttttggacctttgagtgtttatcactcggcccttcttgtattttttgtccttggtatgttcaagttgagaagcagtcggctgggtatcttactaagtaccatgcgtgcttcgctataaaaccactcggttcttgactatatgtttagtttttcaactaatcacatagtcgggggctacacctaattaggtacatctactcgatgcaccatgttttattttcgcccttcacagtttttgatctttagcactcggcaagctggagcaagttgaattgaagcactcggactactgttttttgtttcgagaaggctattttgtcaactgcgaacgtctcgggggctactgtggagattatagataccccatatctacatgacagttgtaatttagtcggatatacggtaccaaatatagatggaatatctctatgaagactcgggttaggttctaaacttgtatgtcaaggaaatacccgggatcttagtcggttacgtttgtattttatctataatcccatattccgttaggatatggattgtattttgtaaagcggactccttcccctatataaggagggtccgtgtgcctcttgggacgcgattctttttcccaatttatacaatcaataacacactcggcggaatcatccccggacaggagtagggtattacttcttgaataagaaggcccgaacctttataaaattcttcgtctccaaacccatccacttttctagcttgatagccacccattttattattgccgaaatcttttttcgacagcgtggtgtcggacctgagcctgcacatggtgctggaggccggcgagcaccgcggcagctcggtgacggcgaagggccgcatcgacatggacgccggggagcgcgagtcggtggtgatcggcggcacggggcggtttcggctcgcgcgcgggtacatggtcaccaagaactacgactacagcctcgccaccggcggcgtcgtccagatcgacgtctgcctgcagcactagctagccatggacagaaaacgcacgcgactgctgcatatatgcatggctgcatcatctgtgcgaggagttgtgcagcggtggattcaggaagtaatatctgaacaaactgaaaaaattagtacttctttctatctgtatatgttaaaaaaatttgatggggtttcgtgcgggctcctattgtcctcatgttcaagatcccgatgcctgcatgatagatctgccataaagttgtgtgtatattatccgtgtggaatgaaaatccatctcctatatacgtagaaactcctcaaagtatcgagaagttgtaactacactactatatattgtccagttgatgtattgtatcgagaagattgagtaacattaatcatatatttatttatggtttatgtagcccttgatagttgtttgttttgataaaaaataattagcacgagctagcccttgatagtttctttgctctaagtataataatttttgaatctgaaattaataattaagaagatgtatatgtattggcattgtctttatcgtacaggtgatgtggtgatatgagctgatgctatcagctgaatatttgaacatgtgcttaataatatttagacaagtgtttggatctgtacgacaccactatggtttgggcgtcaggtatttagcttaaaaatcggacgcccacctcagcgtccatcacatgcaggcgcaccacacaaagcttgtaaaatcttgcgtagccatgtagctaagtctatattcatgcatgcatctaataaaaaaccatggttagttgggtggtattagtttttctttagcaatctataaactaccttttctcttaatttacttcttcaatctacgatccatggcactattaaattcgctgcaattaaatctttataataagaccacatatggttatattttaatgaaaaaatatttagcatttttacatttcttttaaatgatgcacaaattttatttaaatgtttcaactagaatacatatgatgttgcactagttaacttgcaaatgttgcacctggtttttctggaatgtttcaggaagtattttataatgtttcaatatttacaatttaatattaatatgtgatataaatatgactttttttcgttctttgggacttaatgtttcatataggtggttactattgttgcaatcggtatttttaatttttgcatttctctgaaactctttatgcagtgaacaattttctttaaagggtgaaacaatatttgattttttatcaaaatataattgtgtgatatattgttataaagatttaattgtaatacaacagtgtaatcaaatgatagaatggataattattttgaaagaaaaacatttgaaaatgggagaaaacgtgcaaatgagcaagcaaaaacttatgtggacatgcgcgaatgacatgacatgatatgcatgtgtagacatacactatggatgagaaaaggagagtagtagtgagagagagagcgcgtaaaatatacaacagtactctgtctgtgccatcaaaaaccaacctagacaggatgtgtgacatttttttagtataatgaacccggacatacccttatcaagattaattgtataaagaaatgtcatatctcatcctaggttggttttttataggacggatgttgtctttcctagaacatgaattaatcagttaccctcatctcaatcacatcaggcaatgtcttcattataccaatggtatggctgatgcctggcttaatatatattctgacatgtgcagttgtgcaccgatttttatgtacgagaggaagaaattaaaatatactccatccgtcccaaaatataagggattttagaggaataggatactttctaggactatggacaagcttttttttttgtctaaattcgtagtactataaagtgtcacatccctctaaaatcccttatattatagaacagagggagtatatatcgttagaaattaaaaggtaagaaaaacagaactaacatgtgggctccatcgcttttaaggtagtagaagtaactcttttcagaagtagaagtaactacattctctgggaaagaaactcttcgtggtatttgaaataactatactattacaggagctatgaaaaaaaataaaaaattaaaataattggaaatttttaatattggacttgttttgttatatattttgagtgaagtacgatcgttcaaatatgtagatgtttaaaataatattgtcgatgttttaggtcacaactacatggtaaggggattgtcggtaccaaggtttatgcaagattgaggtaaaagagatagagacaaggatttttatacaaggatttttatacaggttcgggccccttatttggcaagtaatatccctactcctgttggccgaagccggtgttgctatttattcatcataatcacaccagtacaaaatttgggataatctatcaaccgttgtcgacttggcggcctagaataccatgatgtagtcgacaacgggatagtcttcctccttgaatccgcactcggcgagattagagatagcgctagatcccttgttagcctctacaggcactatattgggtttgtctaggcttatttttgatgttgatatctggcagcttgtcttggcgtgtgtttgcttgtattggtctgtgtctatcttgattgtccccctctcctcctagggggtctatttatacccataggtgtccccttgaccaaatagaactatagggaccaatatggatacaatccgagtagtccctatagtttccatatagaactctacttgtccttccttattcaaaatacctttcataagtgaggcctaattccatataagacttgatatgtggtgggtcccgccgtgcttaattaactactattaggtacgtataagacttgatatgtgttgggtcccgccgtgcttaattaactactattaggtatgtggtatttataaccatgacaaatatatataccgttgaaaagatataagtgattaaaaaaatactactccctccgtcctaaaatataagcatttttagcatagtgtcaagtcaaacttttaacattgactattaatagaaaaaataaaaaatatccatcatgtaaaattgatgttactagatttatcattaagcaaactatcataatatgtattttttttatttacaacatcctatttttatatatcatcttgaagactgtgtcgaagtctaaaaaatgattatattttacgacggagagagtacatcaatggtactgtttctcatagcatgtgaatagcatgctacattctttttgaaaatatgagtatgaccagataagatactttactatttttgataaggccaagtttatatgggactaaaacttttgataaggcccagtttacatgggactaaaactttttagttcctctccatcgaatgtttgacgctaatttggtctattaaacattaactaataataaaactaattgtataaatgagagctaattcgcgagatgaattttttaagcctaattaatccataattagcaaaagttgactgtagcaaaagttttgctaattatggattcgactcgccaattagctctcattcatacaattagttttattattagtctatgtttaatactctaaattagggtttaaacatccgatgtgacagcaccttaaagtatgcatagtgtgtagatatgtttttttaaaactttcacacgaggaggagcccagttcgtttttttttaaaaaagaaacgtttcgcttgcgctagcactcgctatcttgtcacgtccataagtacatgccattgccagctgcaacaacacactgcaagcagctgcatgccatagccccacatcaagctcgacaatggcgtccctctcctccgtcctcgtcggctgcttcctcctcgcagccgccgtcttcctccaccggaacggcgccttcaccaccaccaccaccacccaccttcacttttacatgcacgacgcctacaccggcccggctcccaccgccatgcgcgtcgtctccggccgctccctgctcgacggcgacaacggcaacggcaacggcaacggcgacgacggctcgccgccgcggcagttcggcgacatcgtggcgctgaacaacgcgctgacggaggggccatccgccggcagcgcgcgcgtgggcacggcgcaggggttcgcggtgcgggtgtcggagggcggcgtgttgtcggacctgagcctgcacatggtgctggaggccggcgagcaccgcggcagctcggtgacggcgaagggccgcatcgacatggacgccggcgagcgcgagtcggtggtgatcggcggcacggggcggttccggctcgcgcgcgggtacatggtcaccaagaactacgactacagcctcgccaccggtggcatcgtcgagatcgacctctacctgaagcactagctagaagtagcacggagctagccatggacagaaaacgcacgcgaccactgcatatatgcatgtctggccgctgcatcgtctgtgcgacgagttgtgcagcggtggatttaagaagaaataaaaatttgatgggtttcatagggctcctattgtcctcgtattagtacgtaccccctccgtttcgtaagtcattttagtattacccacatttatattaatgttaatgaatttagatactatctagattcattaacatcaatataaatatgaaaagtgctagaatgacttacattgtgaaacggagaaagtagtaaaggctcaagatccggatgcccctatgatagattcaccctaaagttgtgtgtatagtttccttgtggaatgaaaatccatctcctatatatgcatatagttcaaagtgtcgagaagtagtaactacactactatatattgtccagttgatgtattgtatcgagaagattaagtaacattaattatatatttatttatggtttatgtagcccttgatagttgtttgctttaaatataataatttttgaatctgaaattaataaataagaagatgcatatgtattggcattgtctttatggtataggtgatatgagctcacgctatcagctgaatatttgaacatgcactcagtaatatttagacaagtgcttggatcggtacgatatttagcttaaaaatccgacacccacctcagcatccatcacacatgcaggtgcaccacacaaagcctcaaaaaccttgcatagccatgtagcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggacctgtcaggcccccccgggatctttagtcccggttggtagcaccaaccgggactaaagatcttaactttagtcccggttggtaataccaaccgggactaaagatcccggtgatctttagccccggttggtgctactaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccagttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatgaggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccatgtgggacgaggacaaacaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccatctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcttcgatccggatagattagaagcccttcagaatgaagtggtgcaatgtctcgtcagttttgagttgatatttccaccttcatttttcaatataatgacgcatctgctttgtcaccttttgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcaaggagcacttggctctagttcgcgctaggaacattggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcttaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacatgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaattnnnnnnnnnnnnnnnnnnnnnnnnnnnnnnnnnnnnnnnnttcaancaaccgg

SEQ ID NO: 6619 - DNA, 2433 bp, Oryza sativa
  unsure (1)..(2433): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacgtcaacgtacgttcccgcgacaacgtgaacgagaacgagaacgatcgaacgaacgtgaacgagctaggaaacgtgaacgagcgaacgaacgaggacgaacgttaacgtgaaatgcaatatatatatatatatatatatatatatatatatatatatatatatatacatgtatatatatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcatgtaaggttgtgtagggttctaatgtacgacatttacacttagcatacatgacttagattgttaaaacataaatgtctcatgacttagcagatgtttcttgtatcaacagatggctgaccgcgatgaggaacagatattgtacgatacaatcgcggagggaagcagccagtactgaaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggctcgggtgttggntggggagaggttataagtccttcaagagcggatacggttttccacaatcgtgggttaacgccgaaagacctgtggccaaggcctaaaagagccggaccctaaaaggggcccttgtggtttttataagcctccccccggagaggttaaaaatatgctttaatagggggggaaccccgggttattaaaa

SEQ ID NO: 6620 - DNA, 5103 bp, Oryza sativa
  unsure (1)..(5103): unsure at all n locations
cgcgttgtattatcctcacctcnnnnnnnnnnnnnnnnnnnnnnnnnnnnnnnnattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaacctcattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaactggaaatgaatagtcctggatgcagaatactccttctgattcttacacttattgcatggacaacaaataaaacccctttgcctgttagcttcggccactctcaaaaaatagtgcacgccctaatccgtcattagcaaatgtttactgtagcaccacattgtcaaatcatggagcaattaggcttaaaagattcgtctcgcaaattaatcgcaatctgtgtaattagttattttttaagcctatatttaatacttcatccaagtgttcaaacgttcgatatgacagggtaaaaaattttgaggtaggatctaaacaaggggtaagtctacattcannnnnnnnnnnnnnnnnnnnnnnnnnnnnnnnnnnaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgtactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcatcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcatagtcaagggcccccctagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatgcagattcaaagggcccgacggcggagggttttcgttactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgctactgccttgcagaccaaatcatcaccacaagagagctcgatgtacgtacaaataaattcaaaatttcattacgtagtgatttcttgtttaattactaatcaatttcatacattcatatagtttattcgcatgagggataacctgaccacacacaaggaatttatcgcggcggttcaaaaacaactcatgggattcatcaacgaagaaatccttgatcccaagggtgaattctactacgacggaaacacaattcaccggtccttagcttctgagctagcagcgagtactactacgtcgaaaccgtagctagctaggacatataatggattgtaattaatacatgactacatatgtttctatatgcatgtgtacacattttctataatgtaaatatattttgttcatatatatatctatatacatatgcatttgcataacatatatatgtatgcatatatatgtattgaaacatatatatgcatggtctatatatatatatatatatatataaaccatgcagcaacaggggcatgcaaaaaaaaaaaggtcagctctatctttagtcccggttggtgttaccaaccgggactaaagatcgatctttactcccggttatttcacccgggactaaagataacgatctttcgtcccggattggtactcccggtttggaaaccgggactaaaggggggttacgaaccgggactacaaagggtttctccaccagtgtagctaagggggttgtttagatccatgcgtgtaaaattttggtgtgtcacaacgaatattatatagggtgtcgtatgtagcgttcaagcactaataaaaaaactaattacagaatccgtcaataaactgcaagatgaatttattaagcctaactaatccgtcattagcaaatgtttactgtagcaccacattgtcaaatcatggagcaattaggcttaaaagattcgtctcgcaaattaatcgcaatctgtgtaattagttattttttaagcctatatttaatacttnnnnnnnnnnnnnnnnnnnnnnnnnnnnnnnnnnngagcagcaatgcaaccaaggtg

SEQ ID NO: 6621 - DNA, 766 bp, Oryza sativa
  unsure (1)..(766): unsure at all n locations
ctgtagtgagactccattactatagggcgaattcgagctcggtacccaaaatctctagccttatctgctgtgatcatgatgacctgtttagcctcaatccacttggagaatttgtcgatagccataaagagatgcgtgtaaccgccgactgcccttttaaacgggctgaccatgtcaagcccccagaccacaaatggccaggataacgggatggtttgcaactcttgggctggcaaatgaatttgtctggcaagaaaattgacaaccttcacatgtccgcacaatcttgtcagcatcagacacagctgtaggccagaaaaaaccttgccggtaagctttgccgacaatggtccgtgcagcggcatgattaccacaaataccagaatgtatatccttcaacaactgtctcccttcttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntn

SEQ ID NO: 6622 - DNA, 1182 bp, Oryza sativa
  unsure (1)..(1182): unsure at all n locations
ctgtgagtangtacaccatgattatagggcgaattcgagctcggtaccctgaccgcgatgaggaacagatattgtacgatacaatcgcggagggaagcagccagtactgaaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcgcggtggaacgctcaacccagctgatggctcagtggtcttcggctatcagatacaagaggctgcgcgacgactaacagatgcagtggaagcctcctctcagggcacgttccgaccagacagagatagggacgagctgactctcgccctgcagactccagagcatccaggacgtactcgagggaaaggggtgattccttggaagattggtttcaaggaggacatnnnnnnnnnnnnnnnnnnnnnnnnnnnnnnnnnnnnnnncgtcactcaaancctcatg

SEQ ID NO: 6623 - DNA, 1116 bp, Oryza sativa
  unsure (1)..(1116): unsure at all n locations
gctgctcnggtagacattcaagatcnatcgcgaanncgagctcggtaccctttgagagcttggaggctacatgttgaggatggcgctgattttttccgtgatggcctgtatgcctctttgagataccataaatacgagcgacttccctgtcggaactccgaacagcacttttccggacccagtttcatcttgaaagcacgaatgcttgtaaaagtttcttctaaatccgcaatcaggtcatccttctgcttggtcttgacgactacatcatcaacataagcttcaatattgcgaccgatctgagttgaaaaacatctttgaatcatgcgttgattggttgctcctgcattcttcaatctaaagggcatggtgatgtagcagtaggccccaaagggcgtaataaacgaggtcttcaagcagtcggattcttttagccggatctgatgatatcccgagtaacagtccaagaagctgagtaactcacagccggccgttgagtcaaccacctggtcaatgcgaggtaacctgaaagggtctttgggacaagatttgttgaggttggtataatcgacacacatgcgccattgccccgtctttttccgaaccaggactgggttagccagccaatcgagatgaaggacttccttaatgaagcctgctgctaacagcttggttaattcctccttgatccatccttcctgtcctgtgcaaaacggcggagtcgttgcttgatgggtttggcgtcttccttaacatgtaaagagtgctcaatcacctctctggggataccaggcatattggatggtttccacgcaaaaatatctttattattctgaagaaaggtgatgagcgcactttcctatttacaatctaactcagcgcctattacagcagtcttatcaggatcggagggatctaagggaatctttttcgtcttggcatcactttcttcggtcttcgtcagcttggttgcaggcgcttctccctcgcttgccgtggtcgcagccagtcggatctcttcgcgggcgagagtagtctcgtgggtttgggccannnnnnnnnnnnnnnnnnnnnnnnnnnnnnnnnnnnnnnnncatgaataagtaatcaacccct

SEQ ID NO: 6624 - DNA, 1214 bp, Oryza sativa
  unsure (1)..(1214): unsure at all n locations
tatgccgacgcgggaaggaggtgaaagtaccaaccacaaggatcgcaagcgtaagccgaaagaacttgtgccgaccacttctcngtcttnccgacaacgttnccgcattacaccttcgacaagataatgaacttccaatgtccgcatcatccaaacttccaaccacgtggccaaagattgcttcgtctacaaccagttcgcggagcaatacgtcaagaacgcatgtaaaccctcagacggagatcaaggcacatcaaagaagaaagatgatgaagacgatgccatgactggttttcaagatcatcgcaaagaacttaatcacatcttcggcggacccctggcttatgaatctaagagaaaccagaagctaccagaacgggagatcaatgcggttcagcctaacacgccccaatatcttcggtggtcagagatagcaattaagttcaaccgctcggatcatcccgaccgagtggtccactcggggcggtaccccctggtactagacccagtggttcgcaatgtcaagctccgacggactctcatcgatggtggcagcgcactcaacatccttttcgctaagaccctggacgatatgcagattccttgcacggaattaaaaccgagtaatgcacccttccacggtgttatcccaggattgtcagctacaccactcggccagatcactgttccagttaccttaggcactcgggagaattttcgcacagaaaatgtttgtttcgaaattgctgatttcgagacagcatattatgctatacttggacgaccggctttagctaaatttatggccgtcccacactacacctacatgatgatgaagatgcctggtcctcgaggagtcatatcactacggagcgtcatcaagcaggccgtcacatgtgacaaagaaagttgtgagatggcccaaacccacgagactactctcgcccgcgaagagatccgactggctgcgaccacggcaagcgagggagaagcgcctgcaaccaagctgacgaagaccgaagaaagtgatgccaagacgaaaaagattcccttagatccctccgatcctgataagactgctgtaataggcgctgagttagattgtaaataggaaagtgcgctcatcacctttcttcagaataataaagatannnnnnnnnnnnnnnnnnnnnnnnnnnnnnnnnnnnnnnnnnnnnagatcaatcaatnccagg

SEQ ID NO: 6625 - DNA, 1052 bp, Oryza sativa
  unsure (1)..(1052): unsure at all n locations
cgcgcgagtgagagcacnnnnnnnnnnnnnnnnnnnnnnnnnnnnnnnnnnnnnttactatatggtgtcttaattaccgtcagaaaattatctcactactttcaaagtcactcggtcacggtagtcacatcgtttccactcggggatatacttcataaccgcgaagtaaacggacggattgcgaagtgggccttagaattgatgtctttggacatatcgttcaagccacgaacttcaatcaagtcacaagctttagctgatttccttaccgagtggaccgagtgccaaaaagacatgccagaggaaaagatggaatattggactatgcattctgatgggtcgaagaggcttacaggcactagagctggggttgttttaatctccccgactagagaaagattgagctacgtattgtggatacatttttctgcgtcccataatgtggcggaatacgaggcgctactccatggactaaggattgcaatatctctaggtattcgccgactaatcgtccgtggagactctcagttggttgttaatcaagtcatgaaagagtggtcatgtctagatgataatatgaccacttatcgacaagaggtacgcaagttggaaaataaattcgatggactcgagctcacccatgtcctccgacataacaatgaggcatccgacaaactggccaattttggttcaaaacgggaagcagctccttcagatgtgttcgtcgaacatctttacgaaccgaccgtgcccagaaaagagacagtcgaagccatggatactcaaggcgtaagcatgatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6626 - DNA, 827 bp, Oryza sativa
  unsure (1)..(827): unsure at all n locations
gcgcgtttgggtgacgcaacnnnnnnnnnnnnnnnnnnnnnnnnnnnnnnnnnnnnccccgcgccaccacccgccttgagctcccttgaaccaccccaaacagtcgctctgcccgattcgctgccgccacgcatgaccgcgcgccgccgtcggccatcccctcgccgtatcctctcgtctccaccctcctggagccccctcgactctccccttaccgtacgccgaaccagctcgctgtcgccctcccggaactcctcgcgccccctctctgtttccccggccatgccactctcgatgctatgaccaccccgccgtgctctgttcccgccgacgccgcgctcggctgagcgccaccgttggccaccctctcggcgactccccgcgccaccacccgccttgagctcccttgaaccaccccaaacagtcgctctgcccgattcgctgccgccacgcatgaccgcgcgccgccgtcggccatcccctcgccgtatcctctcgtctccaccctcctggagccccctcgactcttcccgaaccgccgccctagccgccggccttctttctttttcccacgtcgtgccgcccgattcaccaccgcggcacacgggcgcgctctgccgtcggttccccccttctcttcgaacccgctcgccaccaccttcctcgggcccctcttgacctcccccttgctgccccgtggccaccgggctcccttcagntttcgcgccgcgccgcccttttcgttgccgngccgcgccgncgaacgagcaacacccgggaccatcaggctncgcgcccaacgcgtgtgcgtcgcaancaccacaccc

SEQ ID NO: 6627 - DNA, 987 bp, Oryza sativa
  unsure (1)..(987): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6628 - DNA, 982 bp, Oryza sativa
  unsure (1)..(982): unsure at all n locations
nggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcttcgatccggatagattagaagcccttcagaatgaagtggtgcaatgtctcgtcagttttgagttgatatttccaccttcatttttcaatataatgacgcatctgctttgtcaccttttgaaagagatccgtattctcgggcctatgtacctacacaacatgtttcctttcgagaggtacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6629 - DNA, 853 bp, Oryza sativa
cgcgcttgagtacactactactatagggcgaattcgagctcggtacccaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtaacgaaaaccctccgccgtcgggccctttgaatctgcattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgcgggtaca

SEQ ID NO: 6630 - DNA, 1239 bp, Oryza sativa
  unsure (1)..(1239): unsure at all n locations
aagggccatccaaattttagccaataaccggcttaacaaaaagaagttattttgtggaaaccattttacaaaaatgtagcctgtttccctgtatgaaaccgggccctgatgacttctccgtcgaaaaaaaatccattttagcttcacccagtttccaggttaattaaaaatgagttgtgtaataaaaacaagcatataagaaagttgcctaaatataaatcaagtancatcattttacatgagggaaatttttattttttctattataagccattgtaaaaggttgacttgacactatgctaaaaatgcttatattttagacgaagggagtagtattttttaaatcacttatatcttttcaancggtatatatatntgtcatggttataataccacatacntatnagtagttaatttggcacggcgggacccaacacatatcaagtcttatacgtacctaatagtagttaattaagcacggcgggacccaccacatatcaagtcttatatgaaattaggcctcacttatgaaaggtattttgaataaggaaggacaagtagagttctatatggaaactatagggactactcggattgtatccatattggtccctatagttctatttggtcaaggggacacctatgggtataaatagaccccctaggaggagagggggacaatcaagatagacacagaccaatacaagcaaacacacgccaagacaagctgccagatatcaacatcaaaaataagcctagacaaacccaatatagtgcctgtagaggctaacaagggatctagcgctatctctaatctcgccgagtgcggattcaaggaggaagactatcccgttgtcgactacatcatggtattctaggccgccaagtcgacaacggttgatagattatcccaaattttgtactggtgtgattatgatgaataaatagcaacaccggcttcggccaacaggagtagggatattacttgccaaataaggggcccgaacctgtataaaaatccttgtataaaaatccttgtctctatctcttttacctcaatcttgcataaactttggtaccgacaatccccttaccatgtagttgtgacctaaaacatcgccaatattattttaaacatctacatatttgaacgatcgtacttcactcaaaatatataacaaaacaagtccagggtaccgagctcgaattcgccctatagtagtgtgtcatacctctgcc

SEQ ID NO: 6631 - DNA, 2346 bp, Oryza sativa
  unsure (1)..(2346): unsure at all n locations
atgcgccntttgatgatttgtanatcnnnnnnnnnnnnnnnnnnnnnnnnnnnnnnnnnnnnnnnnnatttatatagagagcaagggtgagtacttacgtactcagcaagccaggggaacttaggtggttaatgcaagtttcaaagaataggttgttatttttcaatcagttttgttttcaaggttttcaacaatctaagtgtgtgctttccacaaccagagcgagacaagtctcagctcagtcggggtgagaagtaacaaatttatttatcaagattttcacaactcccagagttggcctcaaagctggttttcccaaaccaaaccatttttccaaacttcccaataatagtggtccccaaacgaccaatcacttccagggacttccggtcccactgtcccccggacagctaattgcttcccaagcattaggtttcccaaaccttaacaccttttcataaaacagggtaaaacaaaaactacgctaaggaatcacctcacattcgcccatgaccgtgggcacggctgttcgaacagtttaataacctctgtagagggggtacactatacccacacgacgttactagccttggtcacccagcccgtgcagaacagccacgtctggtgactttggggctttcacgacaaggtatttcgaaagccgacacagggttaccatatgccaatgagaggagtcccagaccaacaacaggttaggtcccagaccatactgtgccaggaagcccgggggttctccccgacaccaccccgttgaatccacatgtctcttggcatcaaggctcccttgattagctatttactcagccaggggcgtcccattccacccgtgtggtcgcactattgtatgctcggatgtaattccaaaggaatcggtccttagatgcgaccgcacaagtattccgcccaggaatggccttgtgtcgcaaattttatttttaaaactcattttctttcacaaggcaccgacccaggcgtcgggttttccaaagcttttgtaaaccaagttttacccaagaagttacacagattttaagtttgaaggagaccgtcgatactcgcacagagtgcacgaatatcgaggcgcaactagatagttacaagggaacatgatataacaattaacaatggaaggatcagatgcaacaagttgggtaggcccaccggtctgccttgcagacggggcaaatagattaagtgcaatcctatcaatgcataatatttttcaagcaaattaattaagttcaaatataggctcaatatgttcaaaggtggcttgccttgctcagggtcttgatcttcacgaatcttcaagaaatccgcttgacgaaaatccggtaaccgcaactatacgcaaacaatcaaaaacctaaccaaaagactgaaagaaagatcctatttagactaattaatagtgccattaaattgatatcaattttacggaactactggaagtagaacggagtcaatcggtcgagcggttgaggagatatggattttggaagcttaattggatttctggacaaggaaatgatctattggattttttggagtacgagaaatggcttatagaatttatagaaataatattctcaagaatattattgacagtcactgacatgcaggaccaatgggttgaattattggaatccccagattaagaggaaggattttatggaatttggaatataggaaatgttttatggagcaggagatatgatttattgcatttatggaaatgaatattctcaagaatatccttttatcactcattgacatgtggggccaacatatggtgagagagaggtgaattgggagggagcagatatagacttttggtcattgtgtttggcggagggagtaaaaatggacttcctttgtttcaatgggccgaggagggggagctggtcgatgggccaggcccacgagcggggagagagaagggggggggggtggctgactaggcaggggttgacttggtctggtggggtcagcggctgaggtggcgtccaggtggacgccacgtcggacagggaagggagaggaggccgggcggctcatcggatggccaacggcgctcggtgcgctccagcgaacggtggcgaatcggagtgggcggcaggcactgaaagcgagaggaggaagcggggaatcggttccacggatcggaccggagagaaggggcgccacggcggccggcgacggtggcgaagctcgccggattgccgacgtggatacgcgatgggagggaaaagggggcgcgggctatggttcgatnnnnnnnnnnnnnnnnnnnnnnnnnnnnnnnatggagtcatcaaagagccg

SEQ ID NO: 6632 - DNA, 1930 bp, Oryza sativa
  unsure (1)..(1930): unsure at all n locations
ccagcccttgaaacatagagtgtaaacggggactttttcccgggttcggcccgaaataaaggggcgcacggcgcccgaccggggtgncaaatctcccggtattcccaacgtggataccctttgggaggaaaaagggggcgcggcatatgtttcgatcaatcggttggggtgttgccacgcacacgcgttgggcgcgaggtttattgttcgccggtgttgctcgtgcggcggcgcggcgcggcaacgaaaagggcgtctcggcgcgagagctggaggggaggccggtggccacggggcagcaagggggaggtcaagaggggcccgaggaaggtggtggcgagcgggttcgaagagaaggggggaaccgacggcagagcgcggccgtgtgccgcggtggtgaatcgggcggcacgacgtgggaacaagaaagaaggccggcggctagggcggcggttcggggagagtcaagggggctccaggagggtggtgacgagaggatacggcgaggggatggccgacggcggcgcgcggtcatgcgtggcggcagcgaatcgggcagagcgactgtttggggtggttcaagggagctcaaggcgggtggtggcgcggacagtccccgagagggtggccaacggtggcgctcagccgagcgcggcgtcggcgggaacagagcacggcggggtggtcatagcatcgagagtggcatggccggggaaacagagagggggcgcgaggagttccgggagggcgacagcgagctggttcggcgtacggtaaggggaaggggacggggagctcaccaatcggtgaggaatggtgtcggcggcgatttgaggatgggaatgggaggaaggccgttggcgttgggcggcgaggccgacggcggcgcgcggtcatgcgcggcggcggcgaatcgggcagagcgactgtttggggtggttcaagggagctcaaggcgggtggtggcgcgggaactcccaaaaaggaagcccaccgccggcgttcacccgagcgcggcgccggcgggaccaagagcacgccgggcggtcatgcaccgagaggggcacggccggggaaccagagagggggcgcaagagttccggaaggccgacagcgagctggttcggcgtcctttaaggggaaggggacgagaagctcaccaatcggcgaggaatggcgtcgccgccgatttgagtatggaaagggaagaaagcccgttgncggcgcacggggacgaacgtgacgccgaagcgggcgcaccagggaaggaagggacgcggggtggaacggtttggtgacggcgcggcgttcttgcccgtggcgacgaagaaggcggcggtgctccggggttggccgcgcgacggcgaccgaggttgagggaggatttggggctcggtgggtaggatttataggcaagggggagatcacagacgagctggcgctcggctggcggtggggcgatggtttcgtgggcgacccgaaaacggcaacggcgaggatgcgttgggcggcgaggtcggtggatcaagcggtcgaatttgaacgcggagcgcgggccggcacggtcaaagtgggggcggcgggattcggcgccggggaggaaacgagatttggaaattgaatttggatttcgaacttgaaacttggtctcaggaaaacagggaggagtcaagggaatgcatccaagcgggaattcgggtatttctttgggatagatttcaaagatagataggtagacggacggaccgatggatatcgtagagatacatagatcaacagagagatcggtagacggatagttagatgggttgacaggtagagagatcgatgattagatcgagagacagataggtcgatggataggtagataggtagatcgatcgnaagggtccagtcagtnntntcagtnngnnnnttcaatccacactcn

SEQ ID NO: 6633 - DNA, 731 bp, Oryza sativa
aggcgcttgatattataatcctgtatgcccgcacgtcgactctagatgatccccggcgaggacgacgagctcgagacgacggcgagatacggcggcgtcggcgcggggatttgccctaggcagtggcggcgaaggagagaggccgagagagatcgatcggccgaaaacttttaagtgttggcgaagaagacgagggcgcaccgggaatatatatacccctggatctttactcccggttgatcaaagcacgctggagagaacatttttataaactatttagcaaatgtggtactcaccccttattaattatgacccacttacccctcctatcgcgctgcattttacattgttcttgcaaaccgagcttgtcaaagacaagttcaccgcgaaatactgctatttttaggactaacagtgagaacggtttcatctgttcattgatgtctgttgtgatatttgtggttgtcatgaccgtgctccgaccattgtcgacttatcttacagccaaggttctatctgtcatacatcttagcttgactatgaaggaatttttgatatgggttaaagctttgaatatactatttgagtcgattcatgtgccatcccaagagtatgaaaccatcccgctattctggcccttatggggcgggggatattgaaatggatagctcaaatctttagggcaagatatggatacgccccatgcctttatgaatactttttacaatttg

SEQ ID NO: 6634 - DNA, 918 bp, Oryza sativa
  unsure (1)..(918): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttcgcctcggtatctctcttgctcctcatccgactcctgtacgtgtggatgtcctccttgaaaccaatcttccaaggaatcacccctttccctcgagtacgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6635 - DNA, 704 bp, Oryza sativa
  unsure (1)..(704): unsure at all n locations
nagcgttctncaaacanngtgaaaaaccannnnagaaggaggaaggaggtccccatggtgataatcaactttttgttcagatttatgtggatgatatcatctttagttgttcgactcacgctttggttgtggaggttgctgagattatgcgcagggagtttgagatgagcatgatgggtgagttatcgtactttttgggattgcaaattaagcaaacacctcaaggtacttttgtacatcaaacgaagtatacgaaggatcttttgagacggttaaagatgaagaattgcaagccaatttcaacaccaattggttctacagctatgttggatcctgatgaacatggtgaagctgttgatcaaaaggaatatagaagtatgattggatttttgttgtatctaactgcttctaggccagacatacaatttgctgtgtgtttgtgtgcacgctttcaagcttctcctcgtgcttcacatcgtcaagcggtcaagcgaataatgaggtatttgaatcatacacttgagtttggaatttggtattctacttcatcttctatatgcttaagtggatattctgatgctgattttggaggttgtagaattgatacgaaaagtactagtggaacatgttattttcttggtacatcattgattgcatggtcttctaagaaacaatctagtgttgctcagtcaactgcttaaatn

SEQ ID NO: 6636 - DNA, 900 bp, Oryza sativa
  unsure (1)..(900): unsure at all n locations
ntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccgc

SEQ ID NO: 6637 - DNA, 3242 bp, Oryza sativa
  unsure (1)..(3242): unsure at all n locations
ncacttgtaaacacagagagaatcaataaagttgtcatctactgtaagagttcttcgatttgtgtttcacggggtttcgncggtctaaccggcgacacaccgactgtcagaccgacggcatcgcggtggttagatcgcggggtacacggcggtcagaccggcgtcggtgacaggcgtcaggagcagatcttggaggtcataccggagattcaacaccggtcagaccggcggctacgcttcagtcagaccggctaatctactccggtcagaccgatctcatcgaaattgagggtaacttttatttccgctaaaagttttcggtttttgggtatagcaaccattcagccccctctggttggcttagttcttgtgattcgatcctacaagtggtatcagagccttgttttcttctttggatttttatcgatctagagtttttgccatggctactcccgctaggttttcaactaagcctcatgttttcgatggaacggatttttctcattggtatagtaggatgcaatcttatattatggctgaagattatgatatttggagaaaagtttctcatccttatgtgattcctgaaactattaatactgctgctgaaaaaactgcttttgaacaaaattgcaaagctcgcaatattcttttgagtggtatttctcgtttggattataatcgtgttgctcatcttcaaactgctcatgagatttggactgctttgagtaattttcatcaaggaacaaataatattaaagaacttcgtcgtgatcttttcaaaaaggagtatattaaatttgagatgaaacctagagaagctttggatgactatctttctcggtttaataaaattttgagtgatcttagatctgttgattcttcttatgatgctaattatccacaatctgagatttctcaccactttttgaatggtcttgacatgtctatttgggagataaaagttacatctattcaggaatctgttaacatgtctactttgactttggattcactttatacaaaattgaaaacacatgagatgaatgttctttctcgaaaagttgattctaagtcgagtgctttggtttcctctttggatgttgatgcttcttcatctaagtcttcttttcttgctatttttaatgccacatccgatgatcaactcgaacaaattgaggaggaggatttggctttggttgctaacagaattgctcgagctatgaataatgccaggaagaacctcaacatgattttggatcaatcaaagattagcacacataaccgtggtttaggttttaatccttatgctcataattcttgacatccacctgttgtgttaggtgttggtgctagaagtggtgagattttggttaaacctgatactaataaaactgtgtttaaatctgctggtatcatatctactatgaatgcatcttcttcaaaatccaatgttgtgcatgcaaaatctcctgttgtggctcatgttgctaaatctactagtgctaccaatgtgtctaatcatcgtgaaaaatatacttgttcttttttggggcaaagatggacatattgttggtttttgtttcagattagctcataaacagaaaaaggagagagagattgcctttacaaaatcaaagtggcaaaaatctggttttccctcgaggaaaccggtcagaccgcagtgggtcccgcggtcggaccggcgacctatcagaccggctgaacagcctcggtcagaccgaccaccagtcagactagcggtgatgcctcggtcataccggcccccggttagaccggctgcacaccctcggtcagaccggcctcggaggaatttttccataaattctaaaattgattttgcacgtggatatatgcctattggatcttctggtcgtgtgtctcagtactggattcctaaatttttattatcatctaacccaagtactgaggcttcgacttctgcttgtgtgtaggctttggtgacaaagaaggagaacgtgtggatcgtggattccggttgttcgcagcacatgaccggtgataaaaattggttctcctccctaaagaaggcatctaagactgaatcgattatctttggtgatgctgctacaagtgtcgttctcgctacaggtttggttaaggtaaatgaaaaatttgaattgaagaatgtagcttttgttgaggacttaaagtacaatttgctttcagtttcacaaattgttgatgaaaattttgaggttcactttaagaaaactgaaagtaaagtttttgattcttgtggtgattctttgttgaatatttctcgctatggaagagtgtttaaacctgattttgaaaatcctgtttcacctgtgataacatgtttggttgctaagtttgataaagatgtgatgttttgtcatcgtagacttggacatgttggttttgatcatctcactaggttaagtggtttggatcttgttcgtggtttgcctaaacttaagaaagatcttgatttggtttgtaccccgtgtcgtcatgctaagatggtttctacttcacatgctcctattgtttctgtgatgacgcatgcaccgggacagctattacatatggacactgttggtccagctagagtgcaatctgttgcaggaaagtggtatgtgttggttattgttgacgatttttctcgatattcttgggttttctttatggcaactaaggacgaagcttttcaacactttcatggtttgtttcttcgattggagcttgaatttcctggttctttgaaaagaattcgaagtgataatggtggtgagtttaaaaatgcttcttttgaacaattttgcaatgaaagaggtcttgaacatgaattttcttctcctcgtgtttctcaacaaaatggtgttgttgaaaggaaaaaccgtgttttggttgagatggctagaacgatgttggatgaatataaaactcatagaaaattttgggctgaggtgattaacactgcttgttatatttcaaatcgggttttcttgagatcaaaacttggaaaaacttcttatgaacttcgatttggacatcaacccaaagtttcacatttgcgtgtttttggttgcaagtgctttgtcttgaaatctggaaattttgataagtttgaggcacgttctaccgatggattgtttcttgnnnnnnnnnnnnnnnnnnnnnnnnnnnnnnnnnnnnnnnnnnnnngagatggaaccaaaagattacatgcgcgn

SEQ ID NO: 6638 - DNA, 4699 bp, Oryza sativa
  unsure (1)..(4699): unsure at all n locations
ncgcgccgtgaancgcccacgagatgcgnctgtagacnagccgaattngagacccccgacagccggccgagctattgacctcgtggccgccgccgacaccggcgccggtgccgaaacttcgccggcggcggcggcgtccgcctggatccgctcgatgaggcgcggcatccagacgtggcggacgacgtcgcggaactccttgctgttgacgtcgcacctcagctgcttcgcgtgcttttgcactctggtcctccaataattctttatttcgttatcagtcctccccggcaaatactgcgcgatcttagaccacctggcacacagaagtattcgcatttaggtccctggaaaggactgaagtgtaattaattaaggtaattaaattaattaccggttgccccagcgagagtggaggtcgaggatgaggagctgctcgtcggccgtgatgttgccgcggcggacgtcggggcggaggtagttcagccaccggagacggcagctcttgccggtgcgcctcagccctacacgtgtccacactctaagtccatcagctagtgcaaaattaaccgatcgactaatcactgaagattaattttatatctttgattttttgcatgcagagattaattgatgaggatggagagagagctcgcgcaatgaagcttaactagctaaactagataagcttctagaatattccagattaagacgtgcactagctagcttatcgtgctcagtggagcaagccaaataggcaacacaacagtattggctatttggcacacagagatcgttaactatttaattaatctcaatctctgatcgatcgatcgaatgatcaactgattaatcaattgactgaataattaattaatcacctgcacagcgagcaagcgagttccagcgaccctcgccgtggttggcgatgtagtcgacgagcagcatgtcctcctccaccgtccatggccccctcctcaggtcgccctcgtcctcgctcgccgccgccgccgtcgccgacgacatcgccgggctcatcgccatcctcatcatctccatctccaaatccatcgatcgatctcagtagctagctagtgatcagctgtagctgtggggtgtgtttgagaatggaggagatgtcgagagggaggcagggtttatataggaggggggacatgtggggttgggaggaggacgaccacgacgatggctaatgatgatgcggatggatgctgctaatgactgtggttagagccgcaattagctggctggctgttaattgtatagagacagttttaaaagcctaaagtggaggaggggggtgtcgcgggaataaacaattcaagcggcttaagaaaacaacgtgtctgtctagctgctccgaccagtcaaccgttgaacgttgactccccatgtaatggtgtcatggccagcactattagctgtaaaaaccgtttagctattctactcgtttctctaacctaaacaccgtacccttaatttgttttgcctatttagggtttattatttcaaacgtataaatatttcagaatcatataaattagattattttatcaatcacgcccataaaatttggacgcaactagtggctgatatatacgctaggaaaaacatatcggattgtactccatcacttgtcaagaattattttagatgtttcatcgctcgatgaaaaatatttcaatcagatgcaacattcaaaaatattaattgcaaacctaattgaccaatatgcacataaacagtaaaagaaaacgataaagaaaaacaaatgttgccatgcaagaaccttcgagatggtgaagggtgcaacacggctttgatgagatcacgtgtgagcaaggatttaaatctccggctatagcagtagaagcaaccgctaagatatgtctaatttacagctacacgttctaaggcgctattagctgcctttagctggagatagccgctaaatgggctctcaagtagcggcagctaactcgttggtgggctgaaatcctgaaattggcgaacggcccatatcacctaacgaaaccctaactctctccatcttccactcagtcactctccgtcctctcctgtcgacggcggcttgcaggcttgcagcggctgctcaaggaggcagcagcagccgcgacggcggttgatcccgaaggcggtggctatgacctgcagtggcggcagctgctccccaaggtggtggctgcgacctgctgcggcaacggtggcggcggcggtggtgactctcgaagacaacggatccaccaatctcggccccaagcgacgactgtgacaggtggcggcggcagctattggtgttgcaagcggtgggcggcggtgcttgttctgtcagtattctttttcttgtgctcgagccaaccttgtgttgtttcttggttcaaagatgggttggtggcttggctgctcatgaattgtttcttcttggtttgttggtggcttggctgctcatgaattgtttcttcttggtttggttggttgcagtagcctcagggtgaggagtatggaggttcttgaattgttttttttgttcaagttcaggaattcacgggggaggaattcatgggcatgttcctcctgtaatttagcaagatggttgaggaagtggtgaggatttgatcctactgattatcaagcaattcctctctccctagtcttctctgctttccccaagttaaatagctttctcttccatataactgattatcaagttatttatgtctaatttttgcaaaaaccgcttaatagcttagctgcagctatagccagctatagctgatcatagatgatagagaacctagcagctaaatgtcttagccggagatttaaattcttgcgtgtgagtgcaaccttcaatcaatcagagtgaaacacttgaagacaacaaaatgcaacatgaaaagcaataaattcaaataaaaatccttaaacttcgacaaatagccttctatccgctttcttcctctactctagtggccgaatctgccttcttcctccactctggttgaggtcgatcaggagtgtatggcagtagccaccgcgaccccagtgatagaggaaatgagggccacattctccacggagaggttgttgtgtgagtaaacgattcaagcgccttaagaaaacagcatgtctgtctagatgcttcgaccgctcaaccgttgaatgtttaccccccacttttctaatcaaacaataataacactacaattttttgagtaaattttagagcccttatattatggttcaagttgcacaaaactaccacaaaaattttaacaagtggtacataatcaagattatgtattatggctttagtgtttataaaagcacactattgatcaatctgcttaatattgtagcagataaaaaataatactaatgaacttatatggctgcagctttcttgaattaaagtactcataaatttcagacataactttataactcatatgtaggggagatcaaagaaaaactaactataatgtatatatgggttaactcttgtgttttatgtaactacttgagcatagtatgtggggttttatgaaattattttttaataatagaaattgccacacagcccgttaataacactgtcggatgacaactcgatctaaagaataaaagatcagcagatggcaagaattaaaaatttaaaagtaagcagaatatctgctttgtcgacagaggaagcctactagtaattatactggatactgtggaatggtttcaaagatgcagcaagacttgaatggcattaattagtttgttaatctaatccatggaaggaataatgcaaaggccagaattattgcatatgattcctcttgaaccgcaaagtagaaatactttttctgtttttccagccgtagtagtgataaagagatcattagctgtttattttaagggtgagggatcgatcaattaccaatagctgcttagctaagttcgaattgatccggattgttaagagtaagaggagcgggcatctttgaacaccaaggaacttgtgctatatgcgatatgaattcaaaaggtcgaatttggtgtattcctagatatatccaagtagctgtcactactagaaaaagtattttcgcaggcggccaaaagtgatttttgcaggcggagggcaggaccgcctgcatcccaacgttttcgcagtcggggcaatggcccgcctgcgaaaatccgttgagcgagcaaaaaaaattgcaggcgccttgccgccgcccccatgcgccttgagtcgccgccgccaccacgcgcctcaccgtggtcgtcgccgtccacgccgccgccgtcccgcaccgtcgtcgcaccgccgcccctgtcggcctcccccctccctcctccggccagatctgggagggagggggaggggagcctctgcgccgcaccacgccgtcgtcactgccgccgcccccgccggcctcccccctccctcctccggccagatctgggagggaggggggaggggagccgccgccgccacccctgccgtcctccggtccgtgtttcgctgccggccgccggccaccccccctctggccagatctggaggggagggagggaggggagccgccgccggccgcctcgccggggtacgaattcctcagtctanggnggtnnntgcancgccagtcctctataagcaccg

SEQ ID NO: 6639 - DNA, 14152 bp, Oryza sativa
  unsure (1)..(14152): unsure at all n locations
accggccaccggtccacccttccaagccggcggggggcctcccccctccccctttggccagatctgaagggaagggagaaggggaacctcccccgcccgccccgccacgcccggtcgccgaaggccccgccgcgcccggccgccgtccgcccttcgccgccggcggggaggtgaaggggaggagaggagagtgaggggagggaagaggagagtgaggggagaggtgaagggagaggaaaagacacttagaaaatatcagcccatgtgcctcatatatatacctcgctaattttcgcaggcgcaccttgtgtgtcgcaggcggacggcaaacttcacgcctatttgcatttctgtagacggctatttggctctaagggctatgtccgcctgcgaaaataaatacccaatgttgacgaaaatgctttttctagccgcgtgtcaaaagttgtagttcaatatataattcaattaatttgccattcattatattgatcaggctcctactttgattaacttgtctacataacggatgacatgcctccatagtttgggactaattaagcagctctctatccactgaagagtgtgctgggaagtggcatattagcataggtagcatattagcatagctagctagttaactaattaattgagatggagtttcttgcctaacttgtatgtaccaaagcgtaagctgtgaatcgaatgaaatatctgtttttttaataataacagtaatacgaaatttgttaagagagaaaaccatacaggtgaaaaaagagttaacgattatgttatctcgatcttaatttggtcgctatggtatcaccacctttgtactcgagttgtgatttcgaagaaactgattatttttgctgaaaatatccgtggtacaataatcctgtggtgagaagttgacaagagtttatacacaaaagaacctagatcgaccatgcaatacacatggcaagaaagacgctttttttgggggagatgaagaagattcttctaactaattaaccaaaatggatagctagccatggtcactgtaagagttctttcaatgctacatatatgtgcaagagttggcaggttttgttgcacttaattaattttcaaaggcttcatcgtcactagctgacttcttagcattctatgagcaaaagaataaaacaatatagctctgtagaaaattagcaattgcatgaaggtcttaattagtcttggcctagtctctgggattcaatttatcttggatacattcatgcaccttctcctcctttgcgacactaacaacaaatagctagtacttgtctacaagctgagtccaaaccaaatgatcctgcaaaaacaaaataataagtggcggcaattgaacttctagattagtactcttgttctttcttggctgcatgtgtgctgcattcctttattaaactaacaaccacgtttgagaattgatctctcctggtcaaagaggctgcaactactcccttcatcccataatataagagattttgacatttaatttgcttgcactgtttaaccactcgtcttttttaaaaataattgtaattattaattatttttttgtcttactttattatctaaagtattttaagtacaactttttgttttttatatttgcacaattttttttaataaaacgagtagtcaaacagtaccagcaaaatatcaaaatcttttatattatgggacagagagagtagtacataagtacattgatagtacgagatatgataatcgatgaaatatcaggtaaaaaccattaaattagtgaaaatccataaaaaagtagatatataagttttctaaatttatttaaaaaatactactagagattggtacagccatgaactgcattggtacaaaatctaagtctaaattagactcgacttcatgctgagagagaaaaaacaaattttagctgaatatacaatatttatgggatttaacttttttaattattttcaatggatattgcctcatgataataatccaagctgcctacatatatttgatatatatgtcagtgaaaagtacacacaagtttatttgctaatatttgctatagtttgtatatagctgcttgttgcagacacatgcacttttcaatgtcaggcatgattaatatccaaaacacagaggagatacagaggaggacaagctatgaaaccaaattttgtttctatctaaaataaataagaaacagaaaagacttaattactttgtgatattttatctgaatattttacttaattttaggattctgaattatataatacatgtcataatttaaataacaagaattcaatctcactcctatttcacttctaataataaccgaggaaaaactaatccacgtgggggtgcagtgttgaagtataaatgatttgtcttatcatttcctcaaggattaaactagttagttaatgaagctaattattatttcatctgtttcatattatgagatataatttgactttttcctaatcaaaattctttaagtttggccaaattgatataaaaatttagcaacatccagtcatccacaacaccatactggtttcatcaaatctaagattgaatatatttcgatagtatgtttattttgtgttaaaatattactatatttttaataaactaagtcatttttttttaaaaaaaaagaaaaagtcaaaatgtctggtaatatgaactagatggaataaaaaaagataatcatatatatgaattctatgctagtttggcacttatgaattttctatgatccgagtggagagaatatatggtgcgaaagaaacatgtgtgaacaatgaaatcgatttgtcaccttttacatgctcagtttttccttgactaatctcacatcaagtctacctctaaacaaactaattatgagcatagaaggagagacataaaagtagaaaaattcaatctttcaacatcaaaagacaaaagaatgcagcacacatgctgccaagaaagaagaagagtactaatctagaagttccattgctgctgccacttattattttgtttttaggggattatttggtttggactcagcttgtagacaagtactaactatttgttgttagtgtcgcaaggaggagaaggtgcatgaatgtatccaagattgattgaatccccagagactaggccaagactaattaagagactttcaattgttaattttctacggagctatattgttttattcttttgctcatacaatgctaataagtcagctagtgatgaagccattatctaaaaaaaaaaagctagtgatgaagcctttgaaaattaagtgcaacagaacctgccaactcttgcacatatacatgacattgaaaagtgcatgtgtctgcaagcagctatatacaaactatagcaaatattggcaaataaacttgtgtgtacttttcactgtcatacatatatatatatatatgtgtgtgtgtgtgtgtgtgtgtgtgtgtgtgtgtgtgtgtgtgtaggcggcttggcttattaccatgaggcaatatccattgaaaataattaaataagttaaatcccataaatattgtctattcacctaaaatttgttttttccctctcagaatgaagttgagtctaatttagacttacatttgcgcaaatgcagttcatgcctatatcaatccaataccacatgataaattttcttggacgccgcccctttttgtttctatgcggttcgtaagtggaaccgcacggaaaaatagggggaccggcgccggattgtcacccgcacgggaaaatgcattttcccatgcgggcgtcttaatccgaccgcacgggataatcctcattatcccgtgcagtcgacttaagaggaccgcacggaaaaatcgattttcgcgtgcaggcttttcaatggaccgcacaggaaaatacctccctcctttccctcccacccacttcaaatttttgacatcctctctcttccttttttttcccttttattctcgctcaaccactaccctctctctaccttatctctattctctacctcctcctcccctcattcgtcaacagcgggcatcagcggtggcctcgtcggcggtggccccttccgcgcgcgcggccaggcggcgagcagcgaggcggaggcgtcaaggcagtggcggcgagcgggcggaaccttctcctgatcgtcatcctcgtcgtgcacgtcgtcgctcggctcccttgacgacgacgccgtctgcgtcgtcaaggcaacgacggcgagcgggcggcgaggcagccgggtctggcagcggcggcctcgcccggatctggtggcggcggcggccggcgcgactgtggtggcagcgggcgggctcggcagcgggcggtggtgattttcgcatttttgtttatttttggttttctttttggttccgtgcgggcggtataatttgaccgcacgggataatcgattatcccgtgcggttaggtcacccgcacacgaaaatattcatttttccaaacgcctggttccagacggggaaaacctcccacggaaaaatcaatttgaccgcatggaaaaataggttatgtagagtgatctctagtatttttttaataaaaatttagaaaatttttatatctaatttttacggatttttactaattaatggtttttaccggatatttcgtcgattatcatatcccgtgctattaatgtacttatgtaagtactaagcacgtgagctgcagcctctttgaccaccaggagatatcaattctcaaacgtggttgttagtttaataatccactttgtctccatcttattctttacaatattttgaccagtgtagtagtgcaatggattcaatgccctgcatgttgtcattgccctgctactttagagtttagaccaactttatgccatgttaactcgtttactaacgtcggatggtaggacccaattagcataaattcaactattccatcgaacaattggttgctcgaatgttcttaagtcaactcactgtttgacttgagaattaatctaacattttttgttcttcatagaactaatgcatgacagatacaaacaaatatatatgttaattggttgaccatgcacgcatgttggtgttaggattgtgaggacttagcagaggcttagctacaggtttagtctgactttggtttcatgatctattcttataaaattgtcatgttaggcgactcacattaacactatatgcaaagttttgattgtgccattcttgacctggttatacacttgggaaacatgaagtagggtcaccaattataagatgaaacaagatgccaaatgatgatgatacatcaagcatattgagaattaattggtttttcaacattgcagtgttaacaataatatctgttgtcaaagctagaaatggctgctatagctggggtaatgcaacatgcatgagtcaaagcagttgtctgccaagctagcttgttgagacatcagattaatcaacataattaaaatggtattagcttaggaagtggattgttatcactctctctactttatgttttagaccaaacaaaattggtggattgttctctctctagttatctacaatgttagctaggtgcatagctaggtagactaatccacaacaaatatctccctagtagctagtctaatcctcagcattagagggtaggattattcagggatgttacacatcaataaagtgtgtgtagaagctagcatgttcctgtatattcggtttggtgatatagaaaaaatgtaactaacattctcatctaatctatatattttgtggcgaataattggaggactgatctgcagtgaagttggtagaaagtggctggcgaccaaactgaatatgtcaatttcctaattgaacagtgtaaatatgcatcatatatatctatgccaacacacgtgcaaacagattctctagctaattagctaattaattaacatcgtaaactaccaagataattttaagcgactgattaacaacaaataagaaaaaagaaacaagacaactgacaaatacctctgtgatttgatttatcaccaaaagaactgacaaatatttttttatgtttgtaaaaaagaataatacaaatggtcaaacatgtcaaaaagtcaacaacgatatattaaaaatagaggtagttccaaattggagctgatatcctatcaggttaacggctgaacatgcgcagcaggaggatttctttgctagggtgtgaaaaccagctgaaaacatcttgtctaaaggatgcaaccaaaagcacatttttcgaacttataagtggtacgattttcgtaaatactttttatatgtgatttttttaagaaaactgttttaaattcacttttcaactttgcgatagttaatatattcatttgtctcaaatagctatcacaaaattattcagccattcagttattcagagagaaaaaaaagccctagtactaattaggattacgtgctatgagttaagaggcttaggttgttgctgtcatcagtcactgcacaaaatcaaatcaacacggctcattcgatcaatcggttcaaaaagcagctgctgccacgattaagtagtcgacaattcaaagaccttttaccagcccaaaaaaagatctagctaagagctaattaaactgtatatgcttctttagtggtgcatgccggccgttgcaattgcaaagcccggttttaatcattattcttctagcctagttagcaagatgaacaagcatacgactttgtctgatgagttgcaaaaggaagaatttttcagctagaaagtagagaagaggagacccaaaaaggtgaagctgaattgcacatcatcagtctctctcatgctcccctaccaacagggtgtgtgctatgtgtgatccctaattatttttttcgtttttttttcttgccactattgatcactgctgttcaaattttgattgatgttttaacagtaattcataaatacctaaaattgtacaacgggaaatatatgggatgcatgacagctatataatcatatcttacaaattccattaattaagccggctatatatgctagattgtgttgtgtgtgaatactagcaaggccatgtatggaaatgtgcatgcgtgcatgagtgcatctgaggttgaaattgtacatttgtgtagctatcacaaagttgaaaaatgtagtacatgtgttaaagctctttgaaaaatgtagtacacatgtgttaccatcaatatgacaataggcaggttaattttgattagaaatgaggactcaagaggtaattatatgatgtttcattggtctcattatttcccgccttaatttcaggggtttggagttctggaaggcgcatgagctcgtcagaatttcagaataacgcacttgataaattgtgctttttgatgaaaaatacagttaattatatttggcttcatatcaatgaaaaaaactgctatatccttctgatggttttcataatacgcatatatttcaagatttaaactttatttttactaaacatttagtccctctggctctatagttcttaagttttgaagaagtttgatgttacacaatttgaactttaactatcaatgccttttaaaatttttgttttgaagacactaaaacatgatatgtagattggtctaaaaaatacttaaataaaattaaacacttttttacatattataatatagaaaatcatagtcagtggtaaattttagagaccatgccattgttcaaaatatcaagaattataacactagagggagtagccgaattgtatgtaaattttgtgaaaaaacatagaaccattgggctatcactagaattcacttacatttagagaaacctatggcttatgcacatagcatccaattgtcgatattaggatttaaaccttagtagattggagtcacgtccatagttccattcacttccttatatatatatagttccgtcatcttaataaagctgcttccccgaattcacttttatttattccgacattgctacccacggtacattataagacaacttaacagttaaagttttcagatcgcaatgactcaaaactatccttacaaaaatcaaccgagagatcagaaagcaccattacttgatcaaggagacaaaaaatatctcacacaaatgatcgatgtcaaactgtcaaaaagtcaaatgcacagtggcagatagaaaggtaaaaaggcagaagaaaaactgtgattaattatacaaacaaaatcgactcaaccgtgttcttgtcattaccgcagatgctttgctacaacactaaaaaaaattattcacagcctattggtcatatagctgtgaacttgtagctatgaacttgtagctgctttatatagttaattgactggattaattaagagaaattaacgcgtattaagatcgagatctcgcctgccaagcttatcctatacatgtcaccatcaaactcgtgtacacgatcgatcaaatcgaacatgcatggcgatcgatcgatcatcgatggatttgcagatcgagcagattgttgttgactcgttgcaaaaaaagttgtttcaactcgagaaattaaaggcatgcaagcacgcatggactggatttttcacattttggtccttttgaaaaacttatttcgcaagtagatccctagaaaaacttatcccaaaaacggtcctttttggggcgccagagtggctggcgccgtcgttcaacaggacggcgccagcctctttggcgccgtcccaccgccgacgtggcggggcgatgctgaggtggctagggggagtgcgccagagtggctggcgcccccccccccgaaattttttatttttgttttatttgtttgatatttttttcacgcttagggacacacaagaaccaaccatagaaaaattgaactcaaatggacgtaatatgtgacatgtagaatttttcctctcctctcctctctccgaactagtgtagaggagagagatgtgcaacttttttatttttattttttttaatattttttcacacttaggaactcacaggaaccaaccacgtaaaaaataaactcaaacggacgaaatatgtggcatgtggaattttccaaagctccaccgaaaaacttctctcctcgaaaacataatcttgcaagcggaatttggaggttttaatatcgccaaacccggcaaagcgggggagaatcggatgtaactttttctgtagatgtccgttcatatattatttgcctgattccgagtccgtatgagaaagttacgcctattttaatagatggcatattttgtccgtttcggtagagttttggaaaattctacatgtcacatattttgtccgtttgagtttattttttatacggttggttcctatgttctcctaagtgtgaaaaaaatatcaaaaaaatgaaataaaaaaaattgcatctctatgtactgtttaacttatatgtcatttcatgtggttatattttgaattagattaagtaatttatatagtggtagagtacattatgtttaacatgctgatcaaagggttttactaaaggagttatggtctaatttgagtgaaggtgcaaagtagactaagtggtatgctagatattttcagacttagctaagtggtagttcgagtttaattttttttttgtggttggttgtatcgtgatcctgagtgtgaaaaaacatccaaaaaaataaaataaaaatgacaccgttgcaactctatacaaagaaacaggaatggaggtggcggcaccagccatgctggcgccctcctccctggggcggcgccagcatggctggcgccctcctcttgccacgtcagttcgcgtgcgccacggtggcaggaggacggcgccagagaggctggcgccgtcccgttggatgacggcgacagccactctggcgcccaaaaaggaccatttctgggataagttttttcaggggtctatttatgaaataagttttttaaaaggatcaaaatgtgaaaaatccagcacgcatggatgcaattggcaaatgtgcgagttttgctgaatttgcttgcttgactggaggactctttagacttcagtcttcgtttggctaggttagcttattaggtaggtagatggatagcttatagtgtatagcttagtccaaagctagcaagctagccacttgttgtgtttacatcagccatgatccatgattttgagcttaattagttagcgagttaattttacattgatgtaccagagaaaaaaaatctaaattcattagtatgtaagagaatattactacatccgttccaaaatataacaacttatatctttgtatccggatattctaggatggagtagtaggatttgataaacaaaaatatttttttaggaaaaatgatattagtatagttgacctagaaaatacttcctatgtagttgaaaaaagtaatgataaagtatatgtgcatggtcctattagaaattatgttgatatcaaaacgtcaaacaaaaaaacgaagatgatacaagctaaatgtgaatacatagatctcaaattcttttataatttatttctttccctttttatcatctatagataaatctaataaagtatgcaaatgccactcattggatcaatatacaaaatatacaatgatcgctctaaatatttttattttcaatgaaccggaattgttttgtttttgctaggacttagtttttgaccccttgattttcgccgctaaagctatcactctaaacaaatccatttagctgctaaaataagttgcttagatctctgggtgatgctgtgagtcacccaaagaaaaaatgacgcaagctaagaaccgtgtattatccactacagtcgtactagcataccctagcgagaagccgcatcgtatcgaacattcgaacccgtagtacgtgtggccacgtcaggaattgacacgtcaccgtgccaaaaaaaatcgcacgcttgtatatgtacacgtggcaggctgtagcaagtacgtggtgacgacgacacgtacgatacgataccagctgcggctaaaattgcacctgtacctaccttgatcaattctggccggtcaaccgtgtacttgcacaagtggcatcgtgcagcaatgtaccagtatctgtcacgtacggctcatgtagtcaaacatgttttttatttcttcttctttttttgagaggagtcaaacggtcaaaccttgttggatgtttctcgatgcttccagtaactagtgtcttctagcatttccgtggtttgggccttgttgaagtgggccacatcaagcccaaaagcccagcccaatctagaattacttctgcccatcacccatcaaattctggcagaattcacatgaatttcccccatctttgttcataatgaaatccagttcatgagtttgtttctggcaacaacattttcagtgtaagatgcctggagccctggactggaggggcattacgttccagctttattattgctgctggagttcacacaggcatgatcatcatcatcactaatcaacaggggagtgcagtagtggtacctacaggaaacatgctctctcatgagatcggcattgctgaggacagcttgtccgccagccctccggccatcctctccgctcgctcccctcgttcgccggtgcgtattctgatcacgtccgacacgggtatcactgagaaaatgtaacaccatacaagtcaggcgtaatagcagagaaacattacatgatatatgcaaaagaatgcgacgtttggttgcacggaacattagtgcctttaggattgaaagggcgtttatgttggcatgtcgataaattcgttatagtagctgcctctgttgaaaaatcaattttaaataattttttttccagaatggtatggtgaaagcctgattagattactctatgctctagtgcaattgatactcaatatttttaagttacatatattttctttatgtcagagataaaatacatagagcacatgaagagaaacaacagaactcgatagatgcctgctcagggcaatagaagctcactttgatacaaaggtgaacagtgggaaactgggaaatgatctgaacgtaacaacagagcaataaaaggtcatcagaaacagcatgcacttacaaaatatttttccatcaccaatttctcctgttcttgccttttcaattatcttgtcaacaacagcttcaacctagagaatgccaaaagggaaaaagaaagaaagaagaataggctgtttaagctgttgtttttaaattgtcacaaaaacatgcagaacaggcagtaataatatcacggagggacagcaaaacatgtttagaaatgtagtagtagtgatcgtacccacatagtcaatgatctcggatgaatactgggaaagtttaggtatatgttttttcaaatttcaacattacaaaatagtcatgaagaaatcacctgatccttggacaccactatttccatcttaactttatcaataaatgtatcttctgcaaattctgaccctgcacgacaacaaaaaaaaaggagcaccatcagtacagattaatctagccttcacacaataatacaagcatacatgcatgctcagttgtgcagagaccaaaacttctttgaaccataattaacatgccaatgttgctattgatacaaatgcttaaactaccctcccttatcacagtaatcttcttattcctaacatttcccaaatccatgcttcttttccaatcatataaccgcagcaaactatttggataaaaatagtgatagtagttgattcaagtatgtgcacagatagtttatgccagtgcccagttgctccttgcaccagtggcatttaaagcatattgaagataatgaggatattgtgtgcatctttggctgtaacccgtctttgaagctctcaggagcgagactatggaaggtatgattagaacaggcatcattttaagtgcagtctgcctgtgctatcaacttcttggatacatcagcagccctttagtttgctactttactgcactctgcacgtggagaccttcaagatttctggcaagctcgataatacctaggtgttgtaacagagtacaacacaagatgctgctgctagaatgcctctttgagacaagagcacaactttaccaatcgtaagggctagcagggtgctctcagttcatctaggctccaacaggcgaaccttatctttttaactggaagcatacaatggtacaaaccatgcgaggaattttatgagttgagcaatccccattctggacagaagtcgtctgtcattgcacagacatagcaatatcctattccaaactacggtagaaatcaaagtacaatatacaaaatggaacacatcgcatcaacaatttttgatcagtttattcagtggaaaccggtgagcagattcaggtatatccattctatcgcattgctagccctacgaaacgtatccgtaactacaaatctaggctcacaatcaacaggatgaaatttctacacactacaaacaaccaccaacactaaaaaaaataggcaatgataaaaccatgagcagagccagcatgtataccttcatgcctctcagttgacccgccctgtgcgccgaaaccccgcacgtcggacaccgtcacgcctctgatccccatttgcagcaaaccctgcaaaccccaattgaccaacctaacagctcgagtgcaggaagaacacgatttacagcagtaacacacactatactcaccgatgacacataaggcaccctccatggcctgcaagaatcaacccggcacatttcatcagcaaccaaaaaatgtaatcacaatcaacacggatcacgatactaatcggtcacaaacgaatttcacctcaggattgcctccaccttgtagaactcggactcgcgctggtaccctgaaaaatgaacagacaacgacgaccaccacgacgatgacccaatcagcgataaccaatccaacaaaccgatctcgatggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6640 - DNA, 2531 bp, Oryza sativa
  unsure (1)..(2531): unsure at all n locations
gcggcggtggccggcgacgacatgattgaaccgtcggcgatgaagaagaatgtggagcgtgaagactagtgagtcgtcgtcggctaggagttgacttgatctgaacaagtcagtgcgaaggcgtattattcgttgttacgtaaacgttctcagaaagcggaggcatgcttgttcgtgtcgtgtgcatgaaaagcgtgctttccgtatcaaagagtgggtatcatttactagtccgtttcatgattagtgctaataaaccatggatttttatactttgttctatcttaagcttcttgttgcaaatctttgccaacaacataatatttcatctacaatcacttatgaagtctcctaaactttttttatctccaaatatagtttggcaaaccagttttatttgttgttaataactaaaattttgttaacttaaaagacatatttaagattacttagggcccctttgaatcaaaggaattatgaaggattttcataggattgaaatcctacaggaaattttcctacgtagccctttgattcaaaggattgaagttttccaaatcctacaaaattcctatggaatggcttgttgcatataggttttggaggaaacttagggcccctttgaatcgtaggaatgaaaaaacagaggaataggaaaaacacaggattctgacatgaatacaattgtaaaccagaggattgcaaaacacaggaaaaacacaggaatgaccgtttgattggaccacaggaaaaacgtaggaataagatgagagagatagactcagaggaaatgttctaagaggttagacctcttgctaactttcctccaaaatgtgcataggattacctattccataagaattttaaaggattgaataggattcaatcctttgtttcaaaggccttcacaggattttttttcataggattaaaatcctccaaaattcctacatttttcctacaaatcaaaggggcctttagcaagaggtccaacctcttggtaaaaattctttgactctatctctctcatccgattcctgtgtttttcctgtggtccaatcaaacgatcattcctgtgtttttcctatattttgcaatcctctgttttacacttacattcctgtcagattcctatgtttttcctattcctccgttttttcattcctacgattcaaaggggcccttagtaattcccgtaggaaagtgtggggaaccacctaatattatttacaacaagtgccataatagaggtgactactaccttcaattttatccatatcactcactcataaataaattaagagacaacatatatgatgtgtcacttctaatacataaatatcgataactttaatattttcacactatttttggagtttgtgtggaggtaacatgtgtaaaagaggtatattgtaggtgtatgttaatgtgagtgtggtatgaatgggttgtacgtactccctccatcccaaaataagccaacctcatactaggatgtccaaatttattgtattagaatatgtcatattttaatatgaggttggtttattttgggatgatgagagtatctaattgtaactaactaaatatatagaccctatatcatatatgggtttaaaacaaggggcaaagtttgttacatgacattgaaaaaatgtgtaattagctggtagataccgcaagaacgtgaatttgctgttgggcacaaaaactggtaattagctatccgacactcacggcaccaaaataggagagataaacactcattaaagacaagtttgcccttagtcgaacttgctccctggtcgacgttgcaatggaggaggtggctagaggaggagcagagcgaagccgaccggcggagcgatggtgggtagagtaggccggcgaagcttctggagttaggcggcggacgcactcgcacttctcctcctcgaattcgtcaggggacctcggcaacggcttggctctatcgctccttggccgtgcgctaaagcgcctccatctcctcggcctccttgagccgccgcgccatctccgcctcccacttcctctgcgcctcgtcctccgacggctctccagtctcctcgctgccttcctctgaagcagaggccacgaacctagccacatggccatggccacggcggcacccacgtgcacgagagaggagacaacaagaggccgcgtcggcaccaagcaaccgccactgcgtcctggggggctagttgtagaggcgaaactacggcccgtggacggtgaggtcacccttaggctggtggtgtcaccgaggaggaggccagcagcccgcgttgcgcgcgggggaggagaaccaccatcgctcgccgctgctccgctagtcgccgccccgcccagcgcgtcggcaccgagcagccgccaccgaggcctgggggcctagttgcagaggcgaagctatggcgcacagatggtgtcaccgaggaggcactactagaaaataattttnnnnnnnnnnnnnnnnnnnnnnnnnnnnnngagcatgagacaggactcac

SEQ ID NO: 6641 - DNA, 9795 bp, Oryza sativa
  unsure (1)..(9795): unsure at all n locations
taaaggcgggaccttttataatgtcccccaagcaaaaatcggcggttttcgcctggggggctacttaaagaatccgctaagttaaaaaccagaacccccgcaaaaaattttgcccggttttaaaaccccccggccgccatttaaaccccacccaccccaaggccttntggtgttcccctttccctgcgcccctactggcgacggcgacgacggcgaccacaacgggccgagccatgggcggcggatgtgtggcaacgggagggggcagatgaaccccgactggagggcntcctcctcctcccctccctcccccagatctagctggagggagggggcagcagccgcagcggcggtgacagcaggcgggcggcgcggagctgacgacaatgacgatgctgtcggatggtgcgatgcgggcggcggtgcttgagcacgggtagggagggcggatccgccaccgccgggccacggggagagcagatctaccgccgctggaccacggggaggctctctcccgtcgcggtggctcggcgacggcggcgacgaggcggaggcggtggcagggcttggcagcggtggcatcgagatggaggtggtggaggccgacgaaactcggcagcggcggcgtcgaggcggatccgacggccacttcaaggacgacgacggcaacctcgagtgcgacgacgctggcgatgggtttgcttgggccaacggtggccgtaggatttttgtgatgacgatgtcttgtaatgctgctgctgttgatagttgtaatgcttgaatgatgttcaaatttttgttaatgtgttgatattgtgatgcttgaatgctatgttaatgtccattttcaattttttttcaactttctggatgagatggtagaaagggatttatttttttatggaaaattatttttactggcggttagcataacacaaccgccagcaaaaactattttcactggctgccttgataaggcaaccattagcgaagataactttcactggcggctgtctccagcgaaaatttgtttttgctggcggctgacttaagatgccagtgaaaatatttctttgctgaccgtcgataaccgctagcgaagatcttgatcttcactgccctttgctttgtggcggctctaaattccgctagtgaagacccaaaatggccaccgcgaaagatggttttcatagtagtgagaaggccatcggccctcgccacaccgggggggaggggggggagaccaccaccggtcaagaaccaccttcgcccgccgccgtcccgaccagcgtctacccactctatatggcgccctctgccgcgttcgctcgctgataaagagaagagaagaaaagagagctgaagcaggaagaagaacaatgtccaggggcatttcggtactttcaacgctctttctctctctatcttcatcgaaaataataaaataatgcattgggtgtccagctgctaattaccacatttttatagtgtccacgagaagatatatattttttgagtgtctcacaacaaagactaaaactttgagtgtccttaacagattttgccaaaacaaaatgaccctacaccatatagtaacttagggtgcgtttgttcctgggggattgggtaagaaagcctatcgtattccgcgcgcacgcttcccaaactactaaacggtgtattttttacaaaaattttctataggaaagttgctttaaaaaatcatattaatccatttttgaaatttaaaatagttaatactcaattaatcatacgctaatggttcacctcattttgcgtatcttcccaatccccttctccactcttatagtactccgttaaattcatgggtgcaactgagtatgtaagtcatcgctacgagcctgagcctacgatcacatgggcggtcaaattaaatgcacatgttctccgttgcagacagtaaaatgtcaactcccccgtatataggaataattatttttagttacttaggcgacttgcaagcaaattaaattgctgaagtcaagtcaattgcttgctcatctcaccctcactctagatcttcaggttataaaatgccaaatgctccaatcgatcgatcagagctccaaatcagtaagagacagctaggtaggtaccagcaaaattaccactaatataactacgagaattagcaaaatttgattagcaatgagaatgagaggcagtaggattgctctcctgctgctgatgctcctgcagtgcggcggcttgccggggatcgccgtcggcaggtgcgtcgtcttcaacttcggcgactccaactccgacacgggctccctccccgccgccttcggcttctacctcggccctcccgccggccgccgcttcttccaccgccaaaccggccgctggtccgacggccgcctctacatcgactttatcggtaagtactactccatccgtttcgaaatgtttaacgccgttgactttttagcacatatttaaccgttcgtcttatttaaaaaatttaagtaattattaatcattttcctatcatttgattcattgttaaatatatttttatgtaggcatataattttacatattttataaaagtttttgaataagacgaacggtcaaacatgtgctaaaaagtcaatggtgtcaaacatttcaaaatagatggagtacaaatcaatcaaactatcaaagccaggtttcaaatctccagcatatatagctgccgctatattcgaagataattgtttgagcaaggtctagctaatttatctagtatactatatgacgtcattgactttttaaatacaattgatcattcatgttgtttaaaatatttatataatcattatttattttattatgatttgatttattattaaatattcgacttaatttttttatatttacacaaaactttttgactaaaacgaatgttcgagcatttattaaaaatcaacggtgtcatatattaaaaaaataaatatagtacaatttagtttattattaactgtttgaaagagtatacctctaattaaatatcttaacccgttatttaaaacacggatcaaagctaccaacatcatgaattcatgatcaactctgatcattcgatcatctgaatgtgtgtagctgagaagctcaagatcagctacctgagcccgtacatggagtcgtcgggctccgacttcacctccggcgtcaacttcgcggtggccggagcggcggtgacgcaaaagagcgccatcccgctcggcctcgacacgcaggtcaaccagttcctccacttcaagaaccgcacccgcgagctccggccgcgcggcgccggctccatgatcgccgagagcgagttccgcgacgccgtctacgccatcgacatcggccagaacgacatcacgctcgcgttcctcgccaacctcacgctgcccgaggtcgagcgggagctcgccgcctccgccgccatggtcgccgacgccgtccgcgcgctgcgcgcgagcggcgcccgcaagttctgggtgtacaacacggggcccatcggctgcctcccccaaacgctggcgctgcggcagaagcccggcgacgagctcgacgccgccggctgcctcgccgagtacaacgccgcggcgaggtcgttcaacgccgagctcgccgccgcgtgccgacgcctcgccgcggagctcgncggcgccgaggacggcgccacggtggtgtgcaccgacatgtacgcgatcaagtacgagctgttcgccaaccacagcaggtacggcttcgagcggccgctgatggcgtgctgcggccatggcgggccgccgtacaactacgccaacctcaagacgtgcgggcagccgacggcgacggcgtgcccggagggggagaggcacgtcatctgggacggcgtgcactacacggaggacgccaacgccatcgtcgcccgcaagatactctccggcgacttctcctcgccgcgcaccaagctcaaggcgctctgcaagtgatgaagaagacttctgcaccgacgaccaaattaattaagttgataattaaccgaggttgcatgttaacctgtgattaattaagaaattaattagatgaataaaatgactggaatttgctttcggtcacaataaaatgcgaacaatctcgattcatatcttacagtgcatcttatgtattgccgtataaaaagggcacatgtcatagttccatgctgggttcacaccctctgctactattaggggtaaatggtagagacaaacagtaaaatgtgaggagcgaaacagtgaagagtactgtttaattattttattgaaattaccgcagcaatttgatctcgtgtatccaaacttgatccaacggctataaatagctaatggcatggatcactgtagttctatgcgatatgatcccttccatgcttggtattcataactactagtagaattttattttgttgctagaatatttttaacaaacatttttaacgagttcgaattgtaaaaagtgctccattatatgattggaaaactaacagtactaatgcgacacacttcccagaactggacgatttctacgcagctttctttatatactaatttctttgaaaatgctttaaatccattttatatttcataacagttaattaattcgtttatatcctcaaacgctaatcacaaaatcatccagctagttttcggtctcctcatcatctttaaaaaattatagtttaagtttgataatatacgttatatattaatttagtgattaaatatcggttaatatgtcttaatggacaatttaatatgttcctcttcttctatcttcccccttcttcctcattaccttcattattttttctctacgtctatcatagtggacaacggtaagaaaacagacggctagtagttgccaatcataacccatttcccattccttgtacccttaagtgcgccgttggctatgtctctctcattctaccaaaggtcgtcaccttccaagaaacctctaccgcctacataggctctcccatacttggtagtcactaacgatgttaagtattactcggtttgtgcttgttgttggcttagggcatgtctattgcaggtgatgctaaatttgccacatcattacaatatcaaacaagtattggatttcatttttcttatctagtgtgctcgcaccgatgctaacatccgatgatgctaatattaggtggactcattggtgcaaggatgagttgagcttgggagaaagaaaacggataaaccaaatgggaaaaattattcataagatttattgtgtctacatttcacaaagtagatggtattttgtatagggaataaaattttcagaaaacttgatccttttgcaagtgtcctaagttacaatctaattctctctatcaaaactacagtagaaaaaaaacaaatgccacaccactatagtgatctctatatccaaacacaaaaaagaaaaaccacaagaccatggccctatttggaagattagcccatggctaattttgagagctaatgtttactcttgaattggtaggctaaacattagtctatggtgatatgtatggattcatgagctaatttagggctaaaaggtggagagaaagtagagaggagagagagagggtgatagggttgccttttgatggtcctcacagaaaattagccccattagcatcccttgtaggggctaatgttttgaggtggggctaattcactttagccacaaattagtctacctgtttggatccttggaggctaattcaggactaaaagatggggggggctaataattagcccatggaaccaaacagggcccatctcgcatctatctctttccacccaactaaacgtgcactaacatcccatgtgagttcacggtggatgaaggttaaagttgggcgcgaaaaaacataagtgcatgattaattgagttttaactattacaaatttagaaaaaacatatctgttttatatttttaagtaatttctatatataaaactgtttacacgaaaaatatcgttgaatccttggaatgaaaaaatgaaggaatagaaaaaacacatgattataataggaatggaaatgtaaaacaaaagattgtaaaacacataaatgatcatttgattggacagtaggaaaaacacaggaattagatgagagatatagactcaaaagaaaatttccctcttgctaagtttcctgcaaagtctctataagattgtcaatttcttaggaattttaaaggattagatatgattcaatcctttgattcaaaggcttttataaatatcctctaaaatcctatatacctatacaaatcatccccactactacaattctctgcttcctggtgcttccacgtcaccctttttatccccaccgttggataagcatcgagcgcttccttctttccgcatcgctcctctcctcccctctcccgcatcgctacacgccggccccaccttctctcccgcatcgctcccctcctcccatctcccgcatcgctactcgccggccccacctcctctcccgcatcgctcccctcctctcctctcccacatcgcgctgctccgccggcccacgcgcatcgactcccttctcctgcatcgctcctcccctctcccacatatcgcgcagccgcccccccccccaccgaatacacgccgcaccgcatccacgctgcattccactttaccttctcctcttgcgccactttttagcctccccctttcccccttaaggccacccagcccttggtttgtgcgacccacaccgcccccaacgacggttgcctgtccttctcccgcgccgttccgattccatatccgagagaagcgaaacgaccgccgcccactaaaaccagacttcatcaccgtcatcaagacattaattttgtttgctcataacgccatggcgatatcattgtggcccttcgcttatattgccaatgaaattctgcaatccacctccaccaactgcttcgtttcatctgaatctcattgcatagttattcggagtacaatgatcttctgataggttttttcatcagtttgaatctttcatgtctacagaagggtatttgtttatgtggtaccgatggccttccttttgaatttgttttgtggctcctgtggattttcattcaggaaagataaatctggtatgtgcctcttctcccttatgctttcacccggcttttgtttctttctactcttgatgatgaatgctcaatttgacctattatctttttgtaagttcaacaattgtttacaagataagttcagtttgattttattcagtaatagtacacctatttatttcgacttataggattcgttggtttatgctctcgggtagaatggataatacggcaggttcttctcaaccaattatacgtcgtcgtggtcgaccacgccggcagccttctaatatcccgatcccacgtcctaatcaacctgttgctgctgaatctcgacgtaggcgtaggcaagttatcgatacaaataggaacagaggtttgttagaagattaacattcctacaagttgtcagtattttatgcagacaaaaaaaatgactcacattatcaatttcatcatttttccctagcatcaacctctgcagatcaacgaatattacgcccacggttaattggtgaatcttctaattctaatcatatagcacaaaatgaaccccatattcgtattggttcatctacatccaatcaattattcaatcacaggcgtaagttgtcttttttactcctaggatctaaccactttaaggtatccatttgctgtaaagattccttcacatatacccatgacacacctttcaggcactatatttgaaccattgaatcttggtggtccacatcattcttgcagccactgtggtgcttttttttggtatgaggagcgaatacgtagagagagacatacttcaaatccatcatataatttgtgttgcaaaggtgggagaatatggctgccaccctaccaacctcctccacagccattgttggatttattgacctcacaaaacagcactctttctaaccacttctttgatcatattcggcaatacaatagcatgtttgcaattacttcaatgggagctaaaattaatgagtccataaatgatggaagagcaccatatgttttcaaaattagtggtcaagtctgtcatcgaattggttctttgctcccaccacaaggtcatcgtccagaatatgcacaattatatatttttgatacagaacatgagatctcaaaccggatcaatgttgcttcatctccccatgtcactttccatgctaatgaacaaattgttgcatccttgatagaaatgttgaatacaaataatcccattgttcaactattcagaacagcacatgaaagaatatccctagacgcatctgatcaattttgcataaggttatttggtaagccggatgcacatggagatatttatagtgctccagtcgcttctgaagttgttggcctgattgttggtgatgttggatcagctgatgtagggcgagatattataatccaagatcgtgcatcacgtttgcagcgaatcaatgaaaatcaccgcaagtttatggccatgcaatatccactgttgttcccatatggagaggatggttatcatgaaaacctcacatatcgtacaatagcacgcactcaatccatgcaacggaataaagttacaatgctagagtgctatgcatataggttgcatgataggccaggagacttcaatacaccgttacggtgtaaaaggctaacacaatcttatgaagtagattcttattgttgtgtcgaggggagccggatagcacattattgcacaccagccttccaaagtaaatatagatcatcaccattcaactcattgattaattctgtctcaagaggtattacatctggatcttctattgggcaaaggataatattgccagcttcatttaccggaggacctcggtatttgtatcaaaattatcaagattctattgctatttgtagaaaatatggttgccctgatctttttttgacattcacatcgaattctgcttggcctgaaattagagaagctttagcattaattcctggccaacaaccttccgatcgtccagatattgtcaatagggttttcaaaatgaagctcaatattttaatggatgatataaagaagcacaaattttttggccctataaatgcaggtatcaaattttacattggtttccaaaatataaattttcctttctcttccttttgtaggtttaaacatgcatgttaccaccatgcaacccttaaaacatatcttttttcatgcagttatctatacaatcgaattttagaaacgtggtttacctcatgttcacatcatcatatggttggccaaaacagaacccttagattccaagaagattgatcattatatttcagctcaattaccagatcctgcaattgaccaaataggatttgaggctgtatcttcttttatggtgcatggaccttgcggtcctcacaacacttcttcaatctgcatgtctgaaggaaaatgcacaaaattctaccctaaggaattctgtgaagaaacaactatattagaaaatggttttacacagtatgcacgtccaaacaatggaagaactgttacaaaaaatggagttgacgttgataacagatttgnggntcctcataaatgttgattggntgtgaagnttcacgccccatataaatctagagaaaggtattatgatggcatgccn

SEQ ID NO: 6642 - DNA, 6496 bp, Oryza sativa
  unsure (1)..(6496): unsure at all n locations
nncgcgcgctgggttgaanactgaatatcntcttcccnnnnnnnnnnnnnnnnnnnnnnnnnnnnnnnnnnnnnnnnnnnnnnnnnnnnnncaatcatcaagtgaaactatcaatgaaatagataattatctagaatgtcgttgtgtcactccaaatgatgctgcttggcgattgcaacaatttgacatccaccacacagatccctccgtagaacgccttcttgtccatctcccatttgagaataatgttattttcacagaagatgataatcttgaagaggtcattgaagatccaaacagctctacaaccaaactaactgcatggttagaagctaatagggagaacccttctgctaggcaacttacatatatagaattccctgaacattggacatggcacaatcaaggcaaatattgggatggtcgtcgtggttctcaatgtagaattggccgcattgcttatgtaaacccttcacaaggagaagcttactatctgcgaatgctactgcacatcgttaagggccctagatcctttgctgaaatcagaactatatcaggtcatgaatatcctacatttcgggcagcatgtgaagcattaggtctccttggtgatgaccaagagtggtcaaatgctttgaaagatgcagctcaatgagccttaccatcccaactgcgacaactttttgttacaatgttactcttttgtgaggtaacaaatcctacaagacttttcagtgaacatgaatcatatatgagcgaagatatatcatatagaatgccccgcaacacttctcaggccagcagctccaccaatccttatgttagatctgttcttctcattaagttagataaactgctaagagatgctggctatgacttatcccattttagtttgccactaccagatgatattggaagtgttttagcacagaatagacttatactagatgagctcagctacgatgtttataacatgccatccactatagatgaagctatttcaggtttgaataacagccagaaggaagtttttaatgctatttataattctgccatcaataatgaaggacggactttctttgtttatggatatggaggaaccagaaaaacattcttatggacaactttgcttaattctataagaagccagggaaagatagcattagttgttgcatcatcgggaattgcatccttgctgcttcctggtggaagaacacctcattcccgtttcaaaatcccattggaaatctctcaaaattcaatgtgcagtataaagaaaaatacaaatttagctgaactgatccaaaaaacatctctcattgtgtgggatgaagctcctgttaatcataaatattgctttgagtcattggatcgaactctacgagatatattgtctgaaacaaacccaaattcattagacaaacaatttggtggtataacagtagttcttggtggagatttcaggcagacactgccagtcatccaaaatgctacaaagcaacagattttgagatcatgcattgttaactcttatttgtggaataagtgcatacttattgagttaactgaaaatatgaggcttacctctgcatctatttccgcacaagatagagaagagttaagaaatttttctaattggcttttgaaaataggaaatggcacagaaccttttgttgatgtcccagagcaactaacgaacatgttcatagagatgcctcagtcccttcttctatcaccagactgtaggaatctagatggattgatttcttttgtctacaacttaggatgtcaaccatcaaatcttacatcatatctgtgtgagcgtgcaattttagcacctacaaatgaggtggtttcagaaataaacaatagaatgattgctcagttagaagcgagtgagatgtcatattatagctcagattcaattgatgacagttctactaactgtactgctatagaggcactatatccaacagagtttctaaacacaatttctataaatggacttccagaacatgtgctgcacttgaaaattggtgttcctataatgcttttgcgtaatctagatccatcaataggactctgcaatgggactaggctcattgtcacacaactaacaagccgtgtgatagagggagaaataaacacaggaaaagcgaaaggtacaaaagcatatattcctcgcattgttacaacattaactcaatccaagtggcctttcaaattgcggcgtcgacaatttccaatacatctttcatatgctatgacaataaataagagccaaggacagaccttgagcagagttggagtctatctaccttcacctgtgttctcccatggtcaattatatgttgcattctcgagagtgacttcacctaatggtttgaaagttctaatagagaacagccctgcttcttatgaaaattgcacacacaatgtagtatattccgaggtattcaacctaataaatagaaacaggaactgataaggtatattgtgatgcataggttggtttcgttattagttttgtaaatataatgttttactgtacttcaatttccatattttgctcagtacgtatgacggagcgtggggctcctcaccaggagactgcgcaggcccccctttgccggttcggccgggggcactaagtgaggttcctcgccctcgatctgaggaacgtcagcgagagaagaagtgcacaagacacgggcgacgtagacaggttcgggccgctgagaagcgtaacaccctacttctgtgttatggtggatctgtgcgtgaaggaataccgagagccggagagcgagagagagttcagactctagaacccccccttcctcccttttttcttttcttcccttttttcctccttttttttcctccttttttttttctctccctcctaggcctgggcctcctttttatctggtcaggggtcaccacaagggcctctagctgcctaagaagggaaacatgctttttacaatgagggctagtctacagccggaagtgacctctgatgtcacagcctgaatttccgttttaggatttataaattatttaataaattattaatagaatttatattaaatgttcattaatttacaagtgaagttaaatgtgggaaataaaatttcctaaatgtaaagcatggttggatttaatttttattaaattctccatgattaattatactctctgaaattttctcggaattttcggagctcaattcctaatgttaataatataaagaacagtttagcaattatttaaataataaattaatcattaaatgatctggatattattatattaaatactttgagtgtccaagtatgttcaagatttttcttggaattatttgagcattggaagtatttttaacaattgaaagatcatctggttggttaatttatttggaaaagtaaataaaagtcctcctcctcagcttgggccgaatccagcccattccctcctttcccctctcccttcctctcagcccagataaagtctgtttgacctccctgtcgctacagtactccatcttcctcctccagacagagccgagccagccgtgctcgtgcacagtgccgccgcctcctcccaccaatccgaccccccgttgctcctctttccaaattagttgcgggaatggaatcccctcaatctcctcttccttttccccaagaaatccccaaaattttctatggaaattctttccaatttcgcggatcaaatccttcctttttccggcgagaaccctagactttcccgagtttttcccgtcgttgtgggcttgatcccgagctcccgtgcctatataaaggaccccctagtcgtcctctacccatcccctcaagtcccgtccgccgccgtcgccggaaacgctctccccgggctctccttctctctccaaacgccggcgccgctccagccgtccctagacgccgcctcatctgcctccttcgtgcgccgccacctccatcggctccgcaaggtcgagctccaccccggccgccgttccccttgcgcggaaacttcgccggaagccgtcctcgccatgaaccattgggttgctgtcatgttccgatctccagccgcagctagcagccgccttagccgcggcatttggtcgccgctgccgccgttgggttcgcaagaaggagagggagcccggcagccatctccccgaagcggaaatccaccagagttccatcgtcgccgtcaacccgaagctcgccgtcgcgttttgatctccggcgaagccctgctgctcctccggtcatcgccaagcttcgccgctgcctccattggattcgcagctgcgaagtgaagcccggccacccctccgttgtcgccgcacatcgccggaaagtcgtcgcctccgtggacagtacctcgccgcccttcgaagctcgtcgccggttatcttccgttgccgttcgtcgtcgcataaatggtggtaagagtcactttgatcccctctcgctcccggtgccctccgtttgcgttattgtgccgtggttcgcttgcaagattaatcttagccgtccaaaattgatataaatccgttctttattttcaatgacatattattcctttttaatatatgtcatctaccaaatatgatctaatctttttccggaggatgttttaatcttctgtctcagctataaatcatttgtaaattgtttgattaatttggaatagtcttttctttaataggtttaattggaatttaatcttgtaaaatttgtaactaattcatatgaaatcagaatgaggccgttcaagtctcataattcatctaaaattatagtctacatgtttgtttactttttatgtattgtttatttggtttttattagtcttttttcctcgttttgcgtgttagcttgtcgtttccgtcgttgcgaaggttcgcgagtgcgccggaagtattcaagaagattaattgaagaccgattattgcaaggcaagtcacatagatcctaaacacaatcctttgagcatgttgatcctatatttaaattctctatttatttcaactgtgcatttattttcgaatgtcaccgggtggtgtgaacctattcctttgttatggcctgtttgcattgattactctattccttgataccttgggatattataacttgactagttgagctttatatattggttcagctagatattagatatgattgcttagccatgcttagaaacattagcacactattggaataacttatgacttactattatttaatgatggcttaatgatagttcatgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatggttcattgcagagcaccaggttgagaaatggcggagataagcccacgggggtcgctggggagtccataccttgtttataagggggtgactatgatccgggaatggtgcactgtggtgagttgtgttgtgcagagagtattgtcacagcctctattcgggtactttccagtatcgcgacgcatggtacacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttagagttagatctgtacagccgggtatggttgttcagaatggttgggcctgtgcagcatgggtgtgttgttcagtgttgattaaaatttctgattaattactccactgttttacatctcttaaatgttttgctaagtgctgcttttgcaaatgagcctatattatgccatcctttggtatccttgtgcacttgcatatttgctgtgtggcttgctgagtatgtcatatgctcaccttgcaataatcaatcaacctcagttgaagaataaggatccagaaggagaagacgtttggcttataccccagttgagctgcctgtgggagtggagccggagcttcgctagattttattttccgctgcagttttcttcatggtgaggactaagagcctcttaagtaagtacttatcgttttagttaatttgatgaatctatatattaaattgtcagtttgtgtacctcggctgattcctggacgaggattttatgcacaaataagttcggaaatcactagtgaatttccgggcgtgacatctgacaagcagagcccatgcctcctgccccgctnnnnnnnnnnnnnnnnnnnnnnnnnnnnnnnnnnnnnnnnnnnnnnnnnnnnnnnnnnnnnnngagcttctaatngnaacacg

SEQ ID NO: 6643 - DNA, 698 bp, Oryza sativa
  unsure (1)..(698): unsure at all n locations
gggcccgaggactacatgaggacccaccaggggcgcaaatgggactgggaccctgaggacttcaggatggtggtccaacgggtgctgaatctcagctccgtgnaggcatccctcatcccccaaggggtcctccccctctgctgcgatctagagcgcgccaagatcctggccatcatgcaggtagtcggggcgtcgggggagcgggccccccgaggccacgatggcgcgggcgggagccgcaggggggaacaatctaccccgggagggggtcgtgcttctgggccccgcgacaggggcccggggggcagcccccctgccgacgcccgggggaagaggaagcaggagggtacccctcccccttctcctccccaagggggcggggcggtgcgtgccagcagcaggcgcccggagggtgccgtgccgacgccgcagcccgagggggagcgaaagaagaaacggctccgcaagatggggggaccgagacatgccgggggaacctcatctcgcccccgaggtggtcgtttagccgacctccccgcaggttcgtccccgcgcccaccgcggccatattcactcttccatctcccaaggcgagttttcactcacccgtttccttttgtcttctggtttttcttctgnnnnnnnnnnnnnnnnnnnnnnnnnnnnnnnnnnnnnnncaggtgtctacgcagcggcgn

SEQ ID NO: 6644 - DNA, 722 bp, Oryza sativa
  unsure (1)..(722): unsure at all n locations
acgcaggnctgaaatgcctattctcnnnnnnnnnnnnnnnnnnnnnnnnnnnnnnnnnnnnnnnnnnnnnnnnnnnnnctcctcattcaccagtacaattaattttgtcattacggccagcatatgtcgagattacgaagttacacacaacgcaatcgcccagaccgacttatgttaggagaagggagaaaaagcaaaagaaacttagagaaactacggcggctaaaaacagactccaagcgggggaaggcaccgagccatgctacactcccaacaaatccccagaaacagcgacgccagctaaatgccacatatggctctatgaatggatggactccagaaccactgagactaaagagagagtggatcaaggaagcacccgtgtcaaatatattgacgtgcaatccttttgcgcattcgtgaaaaaaatattatgaagttatcaaggaagcacccgtgttaaatttataatttaaatccaagtagattgattccaccacaaggaatctaaccagttgagatacgctcacttcattaaaaaaaaactgtacaatttacaagacaagtgtaaatattaagaacaaagggagtatgatttatttatgtacaacaataattatcgaattacttgtatacatgtgcgccgactggtttcgatataatcctaccatctccaacataaatatttaatgtttatgataatgtttggtcaagcttttaat

SEQ ID NO: 6645 - DNA, 712 bp, Oryza sativa
  unsure (1)..(712): unsure at all n locations
ncgcgggtgaangcccaactgaatcgcctcgttgcgnnnnnnnnnnnnnnnnnnnnnnnnnnnnnnnnnatgccgctgacgatttgttaaacacccccgtttaagaggctatcatggcaattactgaagttttcacacataaccagccgctcggtaacagcgacccggcgcacactgcgtatggtcctggcgaactgacggcttccactccagccatgacgccgctcatgctggatgccacttctggcaagctgaccgtctgggatggtgctcatgctggcgcggcaatgggcatcctggctgtaaccgcagaccagaacagcgcggaactnnnnnnnnnnnnnnnnnnnnctttccgtattgaagatgtcctctggccatctgccgtcaccgacgacaacattaaacgtaacgcgttcgccggtactgcaatcagcatcgtttaatccgcatttctacaaccatcatcattcataaaagccgcttgcgcggctttttttacgggaaaaatctatgtccgtttacaccactgcccaactgctggcggtcaatgagaagaaattcaaattcgatccgcttttcctgcgtatctttttccgcgaaacctatcccttcagtacagagaagggttacctgtcgcaaattcctggcctggtcaatatggcgctttacgtctcgccgattgtctnccgcaaagtgatccgctcccgtg

SEQ ID NO: 6646 - DNA, 709 bp, Oryza sativa
  unsure (1)..(709): unsure at all n locations
ttaggccacgcaaagattactgaangtantacgtacagcgncttnnnnnnnnnnnnnnnnnnnnnnnnnnnnnnnnnnnncagggaccctgacttctccccgtgggcagcgctggaagagttccttcccggaaccggggacggcccccgcccccaggtccggacgcccgccaacccattgncacaagtttgaagggtccggcccttaagttggggttggggtcttaaagctggaattttttttggttttcgggttttgggatttctttacaaacaagatccaccaaaacacaggagtagggggtacgctttttaggggcccgaactgtctacggtgccggggtttgtgcactttttctctcgctgacgntcttaaatggaaggcgaggaacctcacttaacgcccccgggccgacccggaaaagggggcctgcgccggtctccggtgaggagccccacgctccgtcatctggcgcgccacagtagggtgcgcgtgtctttctaagccctcgtcctctttcgtgtgcgccaaagctctccccgctaagccaaatgccgaacgggcaggggcgcacagnctctctccgaacgctagcggtgacgacggggagcagaacccgcgccgtnggctctcaccccaccgtnccctctttgcgaaattttggcgggggaggcgctccgngaggtccgaggatccgcgacttcgtcgc

SEQ ID NO: 6647 - DNA, 726 bp, Oryza sativa
  unsure (1)..(726): unsure at all n locations
cacgtgcactgatagaacctcttcctnnnnnnnnnnnnnnnnnnnnnnnnnnnnnnnnnnnnnnnnnnnnnnnnnnnnnttgtctctatgtcttgggagaatcttttcgttgattgaacaaaagttctctaagggatgaggcgacgccctgggtggatagagatcatgccggatacttatgcttaagtggatgcacgtagataatggagattccatatggcataccaaggagttattgtgtgcctatggtatgcggtttcaaatttggaaagagaaccaaattaggtacgattgggtatgttaagtttctttctcgtactacagggtttactaaggtgtcgaagactattaatatgagtgtgtaaaagaggatttaggctcactaccttatgtattaatagatggggagcggaaagatctccggattcgcttatgagagcaggtgagttgagacaaaaggaaggatcttgagtttcatctgaatctctataaggagtgctgttggcggacttaggtgacacagagaggaacggtaactgtgacatctactgttggagttattaaatatgtgtttgatcatttatctgatgcctaaccggaggcatacctgcggacatatcagctggaatctgggtcgtaagacctgatgctgtcatgaccgtcagaccgggtccaagtacggcttcatgagccgattttccatgttattaccaacaatttatatag

SEQ ID NO: 6648 - DNA, 14182 bp, Oryza sativa
  unsure (1)..(14182): unsure at all n locations
cggtgccacgtaaagcggctcnnnnnnnnnnnnnnnnnnnnnnnnnnnnnnnnnnnnnnncaccgcgaccggtcacggaccggataagcgcgcgctgcgccgcattaaatacggcgtggcgcgctcgtccaacctgctataaatgcggttaggtgagccccgctgtgctcacctaacccacacacgtggcaccaaaaccacagggggtcggggcgccccagccctcggggccgaaacgggagcggcccgacccctcggggagacagagggaggggtggccacgtcaccctcgggcccgacccccccgagggggtcaggccacgtgggtgaccgcggctacccaagcctctagtcacgatacccccggccccatgtcaccgacaacgtatattcacttatgtttcattttttctttattatgtttttttcagatttacctcaatggctaacccagctatatcattaaaagatatatctgttggacagcaaaactgcaaggtttttggacgtctaataagattatgggatgctataaacatgagatcaaaatctgcagatcccctcatcagcattgacgtcatcctattggatgaacttgtatgtcattctcttatgtgttccaccaaatattaatactagattctacttctttgctatacttaatactagccatatcaattgttgcacaataatttttcagggctcaatagcacagatcactgtgccaaaaaggtttgcaaagcaattccgccccttgctaaataaaggatctgtctacctaattagtaatactgttgccattgatgcaaaaagaaagacctatatctaccagtgccagaactatattctctagtttaaacatgacacaagaattcaacccctggaatctagaggattaaccataccaaagttcctttttgacttctgcccatttgatgaagttctagggaaaagtatcagttccaaacctctcataggtaatgctatctttaattccacattgaatcatacttattacacttcacattcttttggcttattcctctagattttttttgaatgaatattcctccagatttgattggagtaatcagtcatattggtccatatgattttgcgagcccaacatcagacaaaaaactcaggagaattaaaattcaaaacctagagtacgtaccttttccaaacctgatcgttaaaatcaatgctctcattaattacttttgtgtaatctcagcaattgtttatatgcaacattttttgtagggaacagactcaagatgtcctactctggggacaatatggagaatcattcaacgaagatgcaacactccataaatcaaaggatggaattgtagtagccatctttgctggccttactgcaggaaaattttcaggttcattctttgacccaaacaaatgccctcccatacaaagaatgcaaaacatttaaacttcactttcacctgcagctataacaaaagcatcttcaagctctgctactgaaatatatattgacctggacacacctcaagttagagagtttcgcactaggtaattctctttaaccccttcaaaccatttgcacttgaatattcctgttcaatatgtattatatttcacgtcaaaagatgccaacctatctctttgcaatttgaagctacaaatgggaacgtccaactcttgagcaacaactccctaaggttatacgtttaaccccgatccaagcagcaggaaaaatgtacaccttaagtgagatatcagctatgcctatttcagcctttcaggtacaactcaatacaaaagaaaaaaaaactatattgttattaccatgccatggattcctttcgccaagatttaatactttttattacataagggtggagctacatacagtgctactgcgaaaataactgccatactgtcatcaattaaatggtattacataggatgccatcgttgtgataaagggtacatcaacaattctgattcaccaagatgtgcttgcgaagtttcattccgcaaaccaatgtacaatctcctactcttatacattcattcgaagaactaaaatagtttactgtaatgctaaccactctagatgtatctaactaatgtacaatgcttcaggtacaaactccctgtcacgattacagatgaatcagggagtttagatgcagtagcattttcttttgttgctgaagatttggtagagcttgatgcagcccaagcttcccaaaacatgaagatagacccggctgatcatccaacaacactcaataatgccattggtaaaacaaaaatttttgctatagggatgaatactgatacatcttctaagttccctatcagctatgtgcttaagaagagtttcacaattgagcctactatgtcggtccctatgctcacagatggagaggttagtaaatactactgttccatattacttcagatatcctattccatattacttcaaatatttcaaactaattaaattaaaatataaaactaatcaagcctttgaagaacaaagaggtactacagcttccaccacctgcaccacatacagataacccaaggtttgttattctatcaaatgttctattcattacatttgtacaacaccataattttttttagataaaggattttcattaaaacccagcctctacatcacattggatatatagtactaactgctgatgccaaataaatttcagcacaactattcataatacaggagcatcaagcaaaagtacacctcctgaaatatctttggctgataaaactccaactgaaaaaaccaggtaaatatacaaaaaaaattatgcttaataaaatcattcatatgattattatccattactgcagctcaactacaaaaagagccattgatttcactaaagactccattgaggaaaccagaaggtatattttataaccccatttatattgccttttctgattaacaaatatcaactcacaaccaaccttggaacatttttccttttacactaccaaaaaactagatctccctgttctcaaacattacaaagaagggcatgtactactttggaaaatacatagaataacataactcaactataatactgactacaatatttttggaactatttcatgcaacaaaaaactacagcatacagagggaaaggctgattttcctgaagactccattgagggaaccaaagggtatacattattttataacaccacacatttcattatttttatattgatttttgtgatagataaatccactcatgatttgcaatacttttgcctttaacactaactgcaatatcttatgaaccactccaaacaacatagagctacaaactgcattgcataccaatctgcctgaccaatctacataataaaattggtacttattcttcacattcctaacgatttactctattatcttacaagcacatccctgttgtactactaatatattctccaacacaaaatacaggtgaacacatgctgtctgacctacggtgatttcactatgcggaagacttattatattttccttccatatgaagacttcattatgtcatatgcataagacctgctatattttattagggtcccattctgttctccatcttgcagctatagcattatctctactacaattctataatatcagtactcctcgattacaaaaacatataagagatttcccatattttcagaatgtgtttgttcatattatcacccttttcaaaattacatagttcggtattactttttatactcatatccctaatcaacgcgcggggtatcttctagtttatatgtttttcctctccaaatcgaagtgttctcgtagcttaaaaaacacgctaacaaaaaccgtgataaaatctgtataagtcagtcttgtcctgtacagtcaatgtgcgcatcttcccccttttggaatcgcccggtccccatctccacttcgaaccaaacccggaggcgcgccgcgcgcctccccgccgccgccgtcgagcgggaggggatcggagcgcgcggccgccgccgtcgccgagtccgtccgaccttcgtnccccgcgccaacgcagcagcagagcagcagtgtgggaaggaaagagtggagccgctgccgcaagccgcnaagcggggttggggtttctccattgttaccatttcaggccaaccgccgtcgacgccgaggcggggtgggccccacctgtcactggccatgttcgcctctatatatatacaccgcgccgccccccttccgccgccaacctgagccgagcgggaagaggggttttcctcctcctcctcttccattgctgctccccctcccccttcctcctacaggttcgttcgtcttccccctctcctcctcgttgtccagcccgcgatttctctactcggattgctcgatcccctaccgcccatgggttttctcgcgatttttttttttaattttttggggatggaaatggttagctcatgcgaggaacaaccgattagggtttagtttaacgcctcgctatcctctcgaaatgcgaggaacaaccatttcatcttgccctctcttccttgcttgttccgctcgcgatttctctactcggattgctcgatcccctaccgcccatgggttttctcgcgattttggtttttggtttttttaataaatttttgggaatgaaaatggtaagctcatgcgagaaccacccgattagggtttagtttaacgaatccttatcctctcgaaatcgatttagattattaggattgtggccgttttgtttgcgctcctctccggttgtagtgttgtctccatttctatgggtttagtcgccatgtgagagatgattcaaagtttcaagctatgtggtatgggaatccaaacttctgttgggatcttcttccaaactttgtggtatggcgatttttgctttttttttttgggtgctggaaatggttagctcatgcgaggaacaaccgattagggtttagtttaaggcctcattatcctcttgaaatcgatttagatgattaggattgtagccgttttgtttgcgctcctctccagttgtagtggtgtctccatttctatgggtttagttgccatgtgagatgattcaaagtttcaaactatgtggtatgggaatccaaacttctgttgggatcttcttccaaactatgtggtgtggccatttttgccttttttttttgggtgctggaaatggttagctcatgcgaggaacaaccgattagggtttagtttaacgcctccttatcctctctaaatcgttttggatgattaggattgcgggcgtttagtttgcgccgctctccggttgtattgttgtctccatttctatgggtttagtcgccctgtgagaggtggtggattcagactatgtgtggtatgggaatccaaactttttgttgggatcttcttccattatatgttgagatagataggatttttaccattacgcaatatggggcacccttcttgggttgtgttttttttgtctccatttctatgggtttaatcgcacccttgagttgatccaaacctgtgggggatggaaatccaagtttatgctgctataagatactcatcgcgctatcgtctttgtttcttgcaggggcatgcgattttggaagcggagttgatacttgatcgagatggtaatggagggcatctgtgctccctctattatttagctctctctattattttgtgttttttgattttgttccgtctctcactatatgctggcttttattggtacacaaaggttaaagtagaagatgatgtggagggcagtggcatcaacgcttctgttggtgatctcagggatgctgctgtcaatccacagcctgccctgctgcgtgctactgttaaggaggaggtggtgattttgcttccaaaccttctggtgtattaatctttgcttggagtagtgttttgcatggcatgctaaactatttggatgaatcgattatgtatattacattattaaaacaagggtgaaaaggagtcaccgtattttgctttccatgcctagaagttatcatgttattcacagaaaaaaaaagtatctatgctgttgactgtggtgtggggtccatattattatagttgaggttaaaacaaagtctccatgtcaaatacgattaatgagtaatggccattacgcgggaaatttgggcagttattattttagggccaggcgggttgagcgcttctcatttaccacttgtagagtgtggttttattatggcggcaatgtgctgtctgttatgtcgtgcttgaagtggaaagcaaagctataattttgtgcacaggcttccagttgctaatcgctatatgcacctgagttgtttgcattgtaccaagaagttatttcttgaaacaacaatagaatcatctgtgtctttgggcactagacccaaattcaatataattctagattgcaccccccctctcccctaccctgtgagctactttctaactgagcctctttttttggtattgtgctttgatttgaggcgaacacatctgccaaacaccaaatcaggatgacttacaaatacaaccaattttaatagacttgacgtttgttttggatgtaatctatattgacagtagtacatctaagatgcagttgattgatggtgttaagtatttgaaagtaactgggtgttgacctaaccataggtatattgctaacaaccagaggtccacaactttaaatagttaatactccttttgacatgttaacttttcctttggttccttttaatattttattttatttatttttgcgggggttccttttaataaagttgtgataccaacaaaatgttcttcacatatattgtaggaaggacagccaagctcttcctccagtcatgtaagatcacaatttattggcatggggttttcaccaatgttggttgacagggtgcttcagaaacacggtaatatcctatgacatgccttttcaaatgcatgtagtgatataaaacttttgcaccagttaaaacacagttaaatccaaacattttatacaccttagagtttacgaactgattacatttatctctctcatgcaggtgacagagattcagatactatactggaggctcttttgtcacagtctgtaagtgattccccagctgcatgtcaacatttgtcccgttaatctcaatattctggttttctttctttaggaaatggtttcctctcctaaccttgatgttacctatttatatttttctgtgttattgttttatgactcgaatagtttaccattaaagctcccattatgatcctccatttactttaatgttgctagtgtaattttatcttaagtacaccttcatgtagttggattgatgtttacttaaatgactgatattcaatttggtatcaggaattttagtttccatctaattttgttggcattgctacagtagtcaataattgtgttgtaatgagttgtggaattcacaatacttgaatttatttttcaattttcatatgttataggctcttcaaaaatctgggtctgaatcaggttcattgggagatctctttgattctgataatgaagaaaatagttctcattttgcgcctaggaaagaagttatccaagacattaaggtgatgttctggttcaaaatgttaatcatggtactattcattttgaactccttagaccaatctgcacaacatttctatttttaggttgaagctgattcatcctcagaaaagagatcatatctactgagtacaatgaacttctcgcagcgagaagttgatttggcactcaaccagctaggtaggtgatgctgcattgacttgtgcaattagcaatttatctttttaattgtctagatcttgtactgttgccttttctttttttttttggtgttgatatcagttcaaccaattgtactacacaatttttaagacactgttgaacaagaatgtgttcaggacacattttagatctgtttgatagtcattctattctttgtcatatccagcatactgtaaacttccagacctgcttggtttcaggtgaggaagcatcattggaacagcttgtagatttcattgttactggtcaagtgtcaggttgctctggaggaaacgaaaatggagatgcttcaaatgaggttttcgccagttcttttgttttctgtttcttacatctgactaacattgtctgagtacatgaagtaaatattgagctcgctgctccaagaatctttactcctttatgaaatgtaaaacacacttttctttttgacattaaatgtaaaacacacttaataacttttaataatatgtagctttgtgaaagactcattattcagtgaactggtgttactgctatgagactagtagaacattgtacattatccaactctggaaaagttgttccagagtctattccgtacttatccaatcacaaaaattggtgctccaaatctctctagtttattatgtgttgcgtccagttacagaatatccttgttcataccagattgtcacttggacattctgcttcatactatcccagctatgaaatcgcagcccaattttctacttatatttcgcatcaaccaccattgagaattctccctttaattctgtgtttttacttggtagtcgataatgtaacaacatgtaaaccacaggatcacattattttgtgcctgttggtactcacattgtgttgtcagccatgctttgtaagtttcccattgtgtaccccagaaactctcttacacaggactgagtatagatgtttaattccttttgatactacaatgacatgaaccatacttagcctggagcatgcatcatgttttttctcagtcatgcttatagntatatgtggtccttctttgacattcaatttttgatagatgggatctgtatcatggttatcaatcatgtttatgatatttttgtgttctttctttaacactaattttgataaatgatatttgtaattggctacaaatgagcaacaacagaactgtatatttaaaatcacatttgtttcaggtaaaggatgaatcactgtttggagtaatggataaaacactacatttactccagatgggttttacggaggaagaagtgtcatctgtcattgacaaagctggtaagtgaaaataaaaatgctttaaaaaattactcagatctgtgagcttcatgaccacagtccacagcatatggtgaagtactctctccggtcaaatttatttgacgctgggtgtactaagtttagtactcccagcatcaaataaatgtgactagagggagtttcacaaagtgaaatccttaaaatctaataccacagcatgcaccagtacattggcacctgatctctgataatactgtacctgtcaacaaacacttgtcattcttgaacctttaccattgcaaagcttttccaagcaatcttttggttttattcaattggactagatcgataaatctttgtcgcatcaaatagatgattggggagcatgcaaaaaggaaattaacaaggaaaaagttatgaaaaatatgctttggaaaagcatgagtaacaaaatatatgaacgattgaaacgatcagttctgacaaatatttgtaacaaagggtgtttttattcatgttaacagtatacttaattttacttattttaccgaatcctaaccttgctcatagattttgtcaaggacgaacctttcagactttctatgtatgattcatgcctgctttgtacataaggtggctccccatggatacatatatgccattttaagctaaaaggactgtaaattcaatctcatgtctcatccagagcatctgattgcacgcacatggcatccgcaggtgcctcactcatgtacatggataaaacgttgcatgcaagtggtaaaagggaattcatatttcacattgtagttatagttttagcccccaaatttttggtattaaaaatttcaatcttccttgtaatacatttgattattttctatatcaatattccattctctcattagttaccagtttctatgttgtatgtactagaatatactgttttaatgagttcctacctctagcaaacttaatgccatatttccttgttcctaccttttcaggtccagaagcaacagttttggagctggctgacaccatttttgcacgtagaattgccagtagcattgagcagaaagaggtaatttcgtcaacattttattcttacagctataagcttgtattgtgaatttacagtcatctgttgcttggtagcattgtccatgacaactgtgcagagcgcacagcagattagtaggaacctttttatataaacaatttgcttgaattacaaaatatccctctaaccaaacacttataccgttctcagcaaaccaatgtttttctttaaatgctgctcatatggctgtacagcatattgttatacacaagtcacaactgttatgatttctaatttgtctgcatttgcattcttgtgcacaggtgaaagttgagcctgactttctagatgagacagaaaccagctattcagcataccatccctcaaattctggtctaaggtactatgatgacgaccatgacaacataaggattaaaagggctaagcatatgtttatagatgacagtgcgggttccagtagtcgtgctggaaatcaacctaacttagatccatggcttaaggatcaccgtgccacaactagtgatgggtctgtcaaggaagaatttgatgcaatgacaccaggcatccgtagaaatgttcgcagtgatgtcgccaatcccccatatttcttatatggaaatgttgtagaaattcccaaagctacatggcgtcagctgtcagagttcttatataatgtggagccagagtttgtaaatagccagtttttctcggctctctcacgaaaggagggttacattcataaccttccaacagagggaaggcgtaacctggttcctaggtcaccaatgactatcgaagaagcattcccattcacaaggcagtgctggccatcgtgggacacaagaaaacaacttaacagtgttgctacagaagttgcaggaatagagcagctgtgtgagagactgggaaagatggtaagagactcaggaggttatctttcacaagaaaagaaaacgcacatcatgcaccagtgcaagctggctaacctcatctgggttggcccagataggttaagtcctttggatccacaacaagtggaacggatacttggctacccacggaaacacacaaacctgtttggcctgaatccacaagatagaatagaagccatgaggtacagtttccagactgacacactcggctatcttttgtcagtcctgaaggacctgtatccagatgggctaagggtgctatcaatctacagtggaattggaggtgcagcaattgccctccatcgcctagggataccactacagtgtgtagtatctgttgaccaatctgatacgaacaggaaaattttgagaaggtggtggagtaatactgaacaaaaggggcaactgaggcagataaataccatttggaagctgaagattaatgtacttgaggacctggtgaaagaatttggtggttttgacataattattggtggaaacttcagttcctgtaaaggtggtacaacagtaaactcatccatgggcatggattccaaccagttttttgagtatgttcgtgttgttcaaagagtgaagcatataatgggtcggctccaggtgagggcgcatgaatctgctcgacatcgacatcgctctccatcaaattgacttgtctggccttgtaggatggtgtagcattagcatagcatcatgtggatctgtaggtgatgtgtcatggagcagttgctctcagacaactttaaatgttatgttgatctccgcagaaacattgcgatggctgttagcattcgttacattgcattaattaccctttcatgttcctggtattcgtagcattatgctccattctttgattataattgctttctatgctgcttctagagttgttttatgtttgcctggttgtaatcgctcagtagattgggactaagcgatcagtttgctgggtaaccttacagcaaaattacattcgtttttcagcttctaaatgctcagttacaattgaaattgcttctccatccttgcacaatatcacagattgatcagtttgcatgctgtacttgtgttgtcctggcaaaagtttgttcatagtagcaaagattcatcatacctttgctgatactggtgcatagacagcaacacatcacctacttgctttctttcacaagcttctcagaagattactgatatgtaagaacatgtagcagcaagtacaattaaatgaatagcctctcgatccatgtccaaatatttggaccgaacgaacattgccatacaaagtgtgcaacatccttccttgcatgttgctacaatcttgacaaaccgatcgaattcagttttcaacctgattttacactcttcttcatcaactttacagaaccgtggatgattttttggttacaccggcagcagcaaagtgggaggggggaaaagaatacgcggcgtcagaatctcggacaaaaaaatgtagttccacttccatatgcaccagctttcccaaatggctgcacacagggttcatctctgctttctaatggaggacggtgaagaaattctgaactagttttcatgctgacctcagaaatcaccatcctacaaacgcgcattgctttcgagcatgttcggggataagcttcaccaggaattccattggcatacccttcagttctgttcaaatcggccagattagtagataattataagttgatcggtggttcagaaattttcgtctacgcatgtcatatgtcagccggtgttgcaagcttaccatggggcttgaagttgaagagaggaggaaggaaacggccgttcggtaagcgggtgtttggatcacggagttcatcgaagaagggatggatcaatgcttccgactgtaatggcaaataaagaaatgcacaatctgtaactactagtacttggcaaggcagtgcatgtttgtatgatgaagtaattagaaaaatgtaacacaatagtgatgccaagaactaaaactttctctaaaaaatggtgttggctcaaatagtgcaacgacaacactcacagcagtggaccggaggtatggtgaatactgcaaaagcctggagacgagatcgactgcttcagcaggcattcttttatggaagatctggtggtaaaaaaaaaggaaagctacattaggtttcaaccctaaaataaaaaataaacagtccaacataagattattttcttctaccttgtgccatgggtgagctttgatttgcggaaatttaaactcggtgtaatttgggttcatgcacttaatctcctctcgtgtaggggtacccagaacctgagagaatagtcagttaagtaggaggtaaacaacaaaaagggagtgatttcgatggaagcaagatataatttaccttgatgatttcaacaagctgatcaacgccactgtcgccagggaatagaggcttttaaaacaaaaaaaggataaagcttaggcagacagttgcaatgagctggatggtccaaaagcctcatgtaaataatgtgatctcttacctgccccaggaggagttcagcaagcacacaaccggcagaccaaacatcaatcgctgttgtgtattcagtagcaccaaatatgagctctggagctctgtagtaccttgaacagatgtaagaaatatttggttctccttttacctataataatagaacaaaagattaggtacaacagacaatggcaatgttcgtgtgagtatctggtaatgagtgatcataccaagactttcgcgctgccgaagtcacataatttcagctgatgagtatgtgggttcacctggaagtaataatcttttagcaaccatctgactaaacaaaacttagtacttgactaactccacaaagcttcaataagtggaannnnnnnnnnnnnnnnnnnnnnnnnnnnnnnnnnnnnnnnnnnnnnnnnnnnnnnnnaaaggttgtacaggatccacnccccagccttt

SEQ ID NO: 6649 - DNA, 8040 bp, Oryza sativa
  unsure (1)..(8040): unsure at all n locations
nggtgttgtgaatgtacgccaaagctctgcatatctgtcaattataataggttttccatgttatactcaatgcataattgtgctaggatagattagaagatctaggtgtgtaacgttacctgatacatgtatagttttgcatatatcaatggcatgcgttggttcatcttgttgtaatgtttaattacacggtgagcagtctctggcacatactcaagcaccaaattgaggtaaagctcctccttctcagtctttgagaaaaaacaatgctttagtgacaccacatttgggtggtcaagaactcgcattgtttgcagctcacggttcttatatctcttgtcttgaagaaccttctttatagccacagtctcaccggtttccaggcacttggcctatacaagatcattcaagaaatgaagggttcatcaatcgccaccagaacacacaaattaacacactgaacaagtgcaacataaatcgatctgtctaaagacaaacctggaaaacagttccaaaggatccatgacctacgacacgctcggccatgtagctaatggtctgcaatgtagatagataattcagtgaacaaaaacttattgtgttcccaggcaacactaaatggacacaaaaggatcagcataatatcacttgtgcttgttttgtgaacagtacctgtttagcctgtccatttcttccatcaatgcttgtcacaataacatgaccaggttctgtcccattgccattgacaactatgtcgtcaatgtcctgcgacgtttgtgaatcaaatcagcaactgacaatacagcaaaaggcaactatgatccaccactcttaggcataataccttattatcatcccttatactcatattgctcatctcattcggaagtcggtcggcatcgccacttgtacttgtttcgttctgaaaccccaaggaagaacgcaccacacctaccgaggccatactgttgaaaggcacacaaggctaatgttcaagaggctttcctaaagatgagttgtagttgatccacctgcaaacaacagcataataatggtaagtcaaagtcacaacagtgtttttacttaagaaagatgtgatgagattaggtgccagaagcacattcacagacagtttgtgttggcaattggcaggtaggcttgaaggtacaggaaaagaaaaaaaaagaagaaatgaaactttgggaatccatgatggatgccgagttgttatcaaaactggagtgttacttttctagctcaatcgaaacacagaatctgaagatattagaatgctaatctgtaccaattaccccccgtttatcatgatattttcaaccacgatcattgggagattatcccgaggcggtagctttcaagaatcaaccagttcatccacccatgcttgctatccataacagccaagagaagggaacatttcaccgatccagagaccaccaaattttgcatcaaccaaactaaaccatctttcccccatcaactcatctccctccaatcacacgcatcatccaaatagaagaaagccaccagaatcaccgatcaaaatgcaaaatcagcaggacgaacaagtatccgatccgacctcggaaaccgccaccatcttccccacccccaagaaaatcacaagaacaaacgaacacacacaccaaaaaaaaaaaagaaaaagaaggaaaaaaaaagaaccagctttcccttccaccccttgaaaaagaaaaatccaaccaagccacgatccaagagcaaccacggccgcgtcaaccgtcgaatcgggcaagaacaagcagagagaagaaccacgggatccaagaaacagaggcgagagggatttaccacgggatcaggcggggcggagggtcgccggagagaggacggagcggggctggcggcacgatctggcgctcgctggattgccccacctccctcgctggctcgctgtccctcctcagctccggcgcggaatgcgggggaggattcggagggagagaggaaggaggagcttcgctgccttctataatacacaggaggaagaagagattgcgacacagaaaaaataaaaaaaagggaaatttttatgtttactcttagtattaattaattaattaattaattaattgattattaattgttttaagtaattaacttgtctgtttgaccgttgaaaggttccggtcccgtggcgccaatctcatctcgtgtggggcccatctctctgatttttgttttttttttcatttcatggtcatttttacctttgtactagtagtagtgtattactgaattttgtggtggggaaatttttggtcttgtaaataaatttgctgtggttggctgtaaaatttatttgtgtggtgacagtaagtagaattgtgaaatatgaatataccctggattatgtcatactgtgagttcttgatgttgaaatagtgttattgtatcactgtatgatatatgaaactctgggagcaacttctttttcgtagtttttaacttagcagtttatttcccatgtccttcgacaatggcctttctgaccgttgtgttatataactaaaactttattttctctaatataataacgtgtaattctttcacgtctgtatgatatatgaatatagttgttacatgttgacatagagttcaaccggtatgaaatagaatgtgccctgaatattgcagtgtcattaaaactggttcctaagataggctatcggcgagatgaaacctttgataggagctaaaccttaaaaaagaacttggcagatagttttcaagatatagatatttcattaagtaaataaaagcatatagtcaagacaaatcttccatgttatttttctcttatttaaggatgatctttcatgttggcgtagcagaataatgcagcatgttatcatactaatgtgaaaataggtatggttgttcgtaacgtaatgtccatcatattaaaaattggcaactctctcctttgcactttttcattgctattttatttcccaataaaagccaagtttgttatatcattgtgtgcaataatatgatcatttgtcatatttaagttgcaaatagatatcttaattaaaaaatatgcaaggttaaccacatgtcccaaatccatgaactagtgccaaaccacattgtatttgattggatgcactccaaaagccaaatctacacaaatactccatcacagaatcaaatcatacatatctggtggtttggtaacaaaaattgcgtgtatgcatgatccacaaagttgagcatacaaaaatctctaaaactgttgagaatattgatgaccttgaagaaagcaaaacaaaacaaaatgaaagcaaatgattgggggtctgggacagactgtcatggtcggagcatggaacccactctgcctcactgccagcaggcaacaaaaacaaatacacctcctgcctaattaatatatgataaccatccgcctaattagatcactattggagcttaattagctctaggtggccatctactactgctgctgctacctccatttcttaagtcgaaatttggtcgggatcacagagactatgaaattaaggggatggttcgttgatcaaagaaaacaaccatgatatgtactcccccagttagcatattgactatgattaatctaattttgattgttgcttttaatcagcacaaaagcatgcacctccaaatgtagggtattagtaaagtatttttacttataaatctaccgagcacgtttgtgctacactgttatgttttaaaaaatagtttaatcgaattttaaactgacaagtatcttcgatatacatctttgtgaaacatgagtttatgctcatataaatcaacaagagctgtgattataaatcaggagtaaagagggaaccagtaatcaaatttcacaggcacaatttacattttgaaaaaaaaaaaactgtaaagggagggttcagtgattggtatgcatgctactctagaatccaaggacatcttttgagctagctcatatcattatgagtctccccctttcctgcaattttattatatttgtaaaaatgtattttatgtatctatcttgtaaaggtagccgtcctacctatgatgatgctggccgatcatgactgtctgagaaagaagatgtagcactatagatcactatacacttagcactatagatcactatacactttcatggcatctttacaagaaaaagttgtctaacttgaccctaattttaattcaatttgcaaagatatcaatgaattatatagcattctgtttccagctgcattctcatccaatttacaaatctaccataatacttatgacaaccataatcaagatttgaagttagacatacctccctgttgcagacacattctagtttaagttttaattggtcagttgtcacatctaattttttttctagataagggagatgattacatccccatctttgcatttagaatgcacacaactataaagtttgagttatgacaagaacttcctatgtaacatatagtagtatcatattattttttttaaaaaaaattgccgtaataaacatgtccttaatcataacctatagcaaggagttggaacgcaaggattctattcataattaatgaactttgtataattaagagccttgcgtgccgtgttgtttgtcactcctcacgaatacggagtatatacacattgttttttgtacaacgaataatatacgtcaggccaatacacacatacataatacacctgtatatttgagtaaaccgtacgtcgtcttcgatctgtcagtaattgactaaaatatattgactcttttaatcatctcgataaacccatggaatcctgatatgcctgcagcctaaccaaccaacaattaatcaattaatcaaagtatactaattaacctgacatgatctaactgaagctgggcgtcaggctgcgttcgaatgagaagttgtgtgaactttttaatagcgcgcaaccgagataaacatgattaattaaacattaactattacatgcttgaaaatagatttatttattttttagaaaagttatatataaaaggtttatactccatccattccaaaatataaggcacaaccacccttaatccaaagaccaagaaataattattattatcttgtagtttggatcatcctaataaatactaatgcgtgcatccaataggattagataacatgagggtggaggatttaaaaaaagtaataatttaatagaaaagatgtcatagttaattgcatgcttgtatgtatgctttatattatggaactgtaggatcgaatcgaaagaactaagccaaccagaggggggggtgaatggttgatatacccaaaaaccgaaaacttttagcggaaataaaagttacccttaatttcgatgagatcggtctgaccggagtagattagccggtctgaccggtgttgaatctccggtctgacctccgagatctgctcctgacgcctgtcaccgacaccggtctgaccgtcgtgtaccccgccggtctgaccaccgtgatgccaccggtctgaccgtcggtgtgccaccggttagactgccgaaacccggtgaaacacaaatcgaagaactcttacagtagatgacaactttattgtttctctctgtgtttacaaagtacaccaacagcactccttataaaaatttcgactaaactcgaaaccctaactcaaaactcaactcaattgctctcaaaagcgataccgggaagcctcacgctccccctctatttatacatgaggtaggcagcctaaagccacgaaccaaactcatactaagagtcctaaacacattaggaaaccctctagtacaagaaagaaactttacataaccaatcgtaccaaatttggactccttccaaatttgactccgcatcccatacgcacacaataactccatcatatgccatatggaatctctatcaaccacgtgcatcaactctagcctaagtatcccgcatgatctctgaccaccacggacgtcgccttatccccaagccgactcctggtccatcaccgcaaatactctcccgagacatcgagtcacctacacatggaacaaacaaagaaaccatattccgagaccaagctatctccaacttgactcattagtagcaaacaccagtattacatagtatagtatccatctagaagtcataattatgaaataatcatggatatccaaacaaacaacccgaaaccgaaaccgacacagtgtcggccggtcagaccacctgaccacgcgcataccgccggtccgaccggctaccagagcccggtctgaccggtcacatgaaataatgaatcctgcgatcacctgtgaatccaatcatctccaaaaccactaatctccaatgctcaattgttcatcacagaataataatcaaaaacacatttgattttacaggaacatctaagaaaattggttgtgccttatattttggaatggagggagtataaaatacgtactcgtttatgcatccgtcgaaaatcatgttcactgaaaatgagaagtagctaagcattaagctggtaatgatgtagcctaagacaaattaatcggaagcaatggccgacatgacaggctgttggacggccggcaggacgctacggctcaacaggtccaaccgacccgatcaaaccaaaccatcttaatttaattactcagtctaatccacattttgtgtcattttttatttggtgtagcaccttaaatcggtcaaatttcagaccaaatcatgcagttctaaaaatattgaaggtttggctaaaaatacaaaagctatctttaccatggttgtctctatatgattggccatgtatagtactcacatgttcatgtgagcatacagtcaatattaatttgataaagtctgcatcatgtagtaattaattagcagtagctctagtacttactacggacgaactgatcagttccttggatttgaaattttcaactcgttggtgcaatgctcaatgaatttgtcagctgcgtgcaatcaatgtgtgtggggatgaaatgtatacacggtttgttgtttcaaactttcaaaacctattgaagtatttctgacatttgattggtgagaaatttatgcggtatgcatatatgggccagtgtgagtcggtctgattcaaactccaaaatttgaatggattagttgaatatagcagcttaattggacgactttttattcaagtacactttggtggttagactcttaatatcaaaaatacacgaaacttgacaaaaggaaacacgctcatagactttttgtgtgtttttctcaaagtagtcaattaaatggattaggttgctaaggagttactactagcaagaagctagtatgatgtaaaagtgagattggactttgtttcctcctgtttaatactatgaaatattattatgccattagataataagttgatcaatgttattatcctctaaaaagacaatgatataaaagaaatttgcagattatgcctgagcttatgctattgtactccagtggtgcacaatgtgagatagacttaaatcttgtttagggcaagttatgaatttatttttgggctgggctgtgggctgggcctggcctactgactggtacttatcattcttgatatgttgacatactcatgtgttttgcatagtattcatttattgctaatcccattgcattgcattatctttttcacaatggtagttagattgcgttgtcatatgatgtactcctgtaacgttttcagattttgcacctattgctttcaggtgtggcttgtaggatacaatgaggaatgcatacctacacccaacataaaacattaaaattggaaagaaaccaaaggaagactagaaaaaaaaacttttattagtgaaccaaaaacaataataggtttcnaaatgaataagctggaatccgaagacctcccaaccctttnnntnggggaggagatattcagngtntcagtacagccgggn

SEQ ID NO: 6650 - DNA, 28731 bp, Oryza sativa
  unsure (1)..(28731): unsure at all n locations
nagcgagacggaagtagcagnnataatncnctcaangnggtgggagntntnnggatncaagnttatngatttccaaccctattcttgtgcatatgacaataagttaattacatatatatacacaattagtataatgctgaacaagataaaacaaccacatatttcataagcttgctcatccctaaccaactactcaatcatgcatgcactggaaaataacaaaattgatttgatttcctgaccagaaactcatcaggccattttggttgtcttccatcagaccaaacatctagaagcttcctgaatttgtggctgaacaacaagaagaaaggggcccccaaaaaaatccagaatacatatatgctgcatttctctccctctttttcttacaatccacaaactagctggagtgtgattagtgccactgccacctggctttttttttcagttcttgcaaaggtgaccttaaaatgaatggtagtgatggtgatgatgaggccccaaaaaacaagaagacagtcttgcttggcaattttctcaaccaactacagacaagaaagggagctccagaggacaggagtggaagaaaggggccaactttctttgtcaccactattcttaggagatgacctgttgccctcccattggctccagcacaagaaacttcaagaaaaatgaattaactaacttaaacctgagagctggtagagtttcactttagattccaacatttttgtttcagtactataaatgctgttaatgaaattgtttgatactttgtgtatgtggttttttactattccaaatcatttctcactagtttttttttttactatcttgtgattggaagaaacaagtaatagtttcgacaaaaaatataaagttgtttcaattgaggcctgcgtgagattccaacattttctttcagtactatatatgtggtgttagtgaagttgtctgatatttgggtttttttactattccaaatcatttgtcataagtttttgtttatcttgtgactgaagaaacaagtaatattttcgataaaaaataaagagcaatcccaaattcccaattaaatttgtcaaaagaaatggagcacaatctctgactaaaaaaatattacttcacaattccttaaattatccaccattcaattgtaaaagatcttcttatgttgtctatttcttttggtcaacttgtacaaagtgaagatgcgtcaggaacaaatgaagccacaagagttcgcttcttgtaggaagaaagtgatacgaaaaggaaagggaactgcaagcaatagcattgcaattataaattatatatttggattatttagtttatccccaaatgaagcaatcttgtgtcatttatgaacttgaagtggatcggattagctcatcctgtgttagaacagtgatttggatcacaattacgtcaggctgtccggtgtgccactgctttgtcaacattatatataaatcttgcaccgtttgtgtctgttatttggaaagcaattttttcatttacttcactcctttttttctaaaaaaataatcataagctatatgtactgtagacaccaatggggatagatatcacactatcacagtcaatcttataacttaattgggtgtatgaaggaagaacaacttctcttcgccaatttagtttaaatattcagatttaacgtgtgaaaaccatatgagaagaattgtcttgaaaagtatgtttcataacattatagtgttatgaaaaatacttttcttgcaaaatttctgttggaatatgtttacttaaattttgcagacatgatcgtcctctaggcctctaactacattgaaatgtaatttattcactaatatttctagtacaatctatttattggattggccaccttcttttttaaatgatcgcaccctgttgcaggaactgtagtataaaataaactagtaactaatcatgcccataaagcatcaacttcgtaactggatttcagattgtgttatttgagaagctaagtttctaatttaaaaaggctatatatatctggttgcatgtagaggcgggataaaacataccgtactaaaaaaactcgattttcttatatccgttttgatttgatccacggtctctctttgtcatgtcatattcaggaagataatagtggctaaattttcataataagatttgattgatgcctctcagatcctctaaatctgtaattgttcttaatcatgtacttatcttgatatcttccattgtgattccactgacaggcagtagacaacaatctaatttgccatcttattcttgcccaagagataagatgacaaagggttacaaagattccttcttgctacttaagctgctctgctgttcagtgattaacagcaagttcgaacacgtggacagagattcagttgatgacgtgcaagaaacagtcactcccacctgcaagtgattgccattttttccccttaaaaaaagtagtaatctttgtaccgttagcatgtgtgattctcattatattcccttcaaaaaagtaagaataacctgccttttgttcccaaccaaaactgcctggttaaaaacaggaaaagagcaaacctgctatgcatttaccacgagttagtaattaaacactttaaaacaccagctaattaatcaatgtactgtaagtttgtaacacccctaacctcaaattaaccacccaaaaacaacgtatgcaacaaaaactgttaaccagcacaaaaaacactcaaattgaccacaccttcccaaaatcaaagctgatcaaaccaaacaagtgcatatataaacaccaccaccatcacccatatgcaaaagaaccactccctctaatccaaatatttcttgcaaaattacatttttttagcttggtcttccttgtgtcacaaacatttccatagaccatttcatttgattagcactccaaatagacacattctttttcaaaccaaagtgcatctcaccacctccaatccaaatcattcttgcaaaaaaattacatccttttttagcttggtcttccttctaacacaaacatttcaataaatcatttgattaccactcaaaaaaaaaagacacattcttcatcactcccaagcctctaactaatccagtaattaacactgtaagtagtaaatcatttgattagaactctagattagtaaaaaaaacacatcttttatcactctcccttggcctccatccaatctagaagaaagagggaggcgaggtcggcagcgcaatcacacgggcgtgagaccgccacgtgtccggtgaggccaccggcaccacccggtcacccgtccgcatcgtcgccggtcgccgccggtcaccgccaccggataaataccaaccacccctcctcctcttcccccatttcttcccccttcctcttctccttcctcctcctcagatcaagaaaccgtgtcctagaaaccatcgagatcgccctctcccccctcggatcgcggcctctcgcgcggatcgatcgctgctcggtttcttgattttttttttatttttttttctccggtgaccggagaggcggtggtgtttggatcgggaggggagagatggtggcggaggcggaggtgatgcatcagcccgtgccggtgttggaggtgccgtaccaccggtgcgtcgccaagggtgtcgaggaggtggccgccgcggcggcggtcgcgccgccgccggtggtcgaggtcgaggttgccgtccaggtgcctcacatggtgagttgctcaactttgtgttctgtagttctacgttttcagtagtatttcagttgggagatcgaagaatttcgtgggaaataacatggaatctagcaaggattactagcagtttagcagctgtttttcagtaattttaggattgtttgttaatactactcatgtgaaaaaggtgctttcagttgttgtaatcagctctgatttttagatatctctatgtaaattattgctgtcatcttgttattggattttaggtttattatggagtttactgcctttctgtttattacacgagattgttttctgttcgtggatgcaaaagactgacacagtttgtaagaaaaaaaaaagtagtccctttttagggggtatagggtggtggttgaggccaaaaggttgagaaggtgggtgctgatatttattggatccattgtgtaaatagtgctattggtagttgagttgtagtatgtatttatgcgctttcgggcaagttcaacttatcatacgaatttgcgcagatgattgtttatctagcctaaaagtgttgtcctgtttctatagctgtagctgaaacttttcagctcttgttcagtatcttatttcagtgtagagtggggtagtggggtaaatcatagtgctgcgtgagcggcaggataggattatgtttgaaacataactacgcaagtaggtcagtggcagtgctgggtatataatttagcagattaaggaagaattggttgtttatgtttgttttgtgtctgagaaataagattagtaatttttgtgtttctgttcattattaataggggttggagagtgctgctggtgcaccgagcatatcagttgatgcactacagtttgttcccagtattcgatctggtagctttgctgatattggacctaggaggtacatggaagatgagcacatccggatagatgatctctctgcccatcttggatcgctcttggtgtgtccgttgcctagtgccttctatggggtaagtgtaatcttctatgtgaatgcctaccctgatttgtgatttgtgaatgctacttcctcagcaacaatggttgaacttattgcccgtgcttcttccctttgcaattttaggtcttcgatggccatggaggcctggatgctgcagcctacatgaaaaggcatgcaatgaggttcctgtttgaggacagtgagttcccacaagcatcgcaagtagatgaaacatatgttcagtcagttgagaactctgtgcgcagagcgttcttgcaagcagatcttgccttagctgatgatttagatatcagccgctcttccggaactacagcactcaccgcattagtcttcggaaggtaaaaaaaaacatatccagtatctatagttgcacatctcatgcttcagtgtggatgctcactcgaggttctgctgaactgtcttgcaggcaattgctggttgcaaatgcgggggattgccgtgcggtcctttgccggagaggcgtagcgatggagatgtctcgagatcacagagcaaactatgccgaggagtgtgaacgggttgctgcatccggaggatacatcgaggatggctacctcaacggagtcctatccgtgacacgggccctaggggactgggacatgaaaatgcccgacggctcgatatcccctctcatcgccgagccagagttccgacagaccatgctcacggaggacgacgagttcctcatcatggggtgcgacgggatctgggacgtgatgaccagccagcacgcggtgagcatcgtccgacgggggctccggcagcacgacgaccccgagaggtgcgcgagggagcttgtcatggaggccaagaggctcgagaccgccgacaacctgacggtgatcgtcgtctgcttcgtctcggagcttgggtcgccgcggcaggagcaggtgggggggcaggcgggggtggcgaggccgaagagttgcaagagcctctctgcggaggccctgtgcaacctgaggagctggctggagactgatcgctagggcgaggcgccggtgtttggttgtggccacttcacacttgtgtacatatgctgacattagttgttttttgttcttctgatttgttgagaggctgctgaggtggagcaaggagggtgagcaaccggcagttttgtaggccattttttttcctcgttattatttttctgcgttttgttgacatgttactgctattgttcacaccattgctgttgtacatatctctgttgagttcatgtatggatggactagcttcccttgagcaatactctctctctctctctctctctctctctctctgggaaatgctcttttaccaagttgctgtgagattcttgattgtcccattcttgaaagaccaattcgttgagatagatttagaccttttttagatgggactaaaacttttaagtccttatcacatcgaatatttgacattaattataaatattaaacatagactattaataaaacctatctataatcttggactaattcgcaagatgaatctattaagcctaattaacccataattagtctatgtgatgctgcagtaaacattatctaattatggattaattaagctttaaaaaatttatttcgcgaattagctttcatttatataatgtttactaattatggattaattaagctttaaaaaatttatttcgcgaattagctttcatttatataattagttttgtaagtagtctatatttagtactttaaattaaattagtttctaaatacatggactaatccaaacaccacgtaagactatggagagcaaaacaggctcttcctggtttgtgaaccaagcagttcaagaatcaatgaaattagctaagcaggaaaatactatttccttgctaattgtagaagaatcaatgaaatgagctaagcagaaaatacgttccgttgaatttttactttcaaaatatggatatttctgaggatgggagtctttgggtaagatgagaagtttagatgaaaggtaacttgcattaaatagtgctagaaccgcttatattttaataaatatattttttaagtactaggcgtagttatatttattttggaatagatggaatatcagtgttagatgcatacacatatctccagctcaccaaaacaaaaacctaggtagtgttaaagcgtttaggctagttgttgggcgttggggctgatactgctatcatttatagagtggataatctaggcaaccggtcagacgaaatacctaaaggattgtcaaattcctatcgagacaaggagccaatcaggacatgaatccaaattagcgacgatttcacatggaaaaaagaggcacacacgctactaagtttgctgctaatcctcaagctcaggcagctctgttcacacttcacaccaagctaataatggtctaacctctccttttgggctcctcccttttaagtctcttgcgataaggcagcacctgggttttcaatgtattcgcacttcagccatcagccgccaacctttttgctcttgttcttctctctctgcaatgagatgccaacttgtagaaagttacagccactgcaagtctccgattgaccatgaatgcgagattgacaggcataaaattcagaattttatagatgctaacactgggtttactataccacttgatatctagcactcacctattaggactcacgagtgggttgttagctggtcaaattcggctgtactaacctgacaaactgcacaccggtaaaagaggtaaaaaaaaaacccaaagatgcactacaattctgaactgcgctagcaatgagagataaaagtccatagtggaccaaattgttctggaggcagttatcttttgctctcctcactaaagctaacaattcctgagaatgacaggaatcagtgcccgctccgcttgtacgtctgacgccaatgcaaaggggatagttgaagcaactgggagcaaccgatattttgcaagacgtgttccgaaacctaaacaaccagacgcaagaggcaccattatgatagtatatccgaatagactgccaagctgacgctgatatgtagaacctctctctatttactccgctgtgtaaacatgtatttagatacttgtgttgcttgaggtttaacttggcagggatgcctggctctgcgtggatcttccaaaagggaggaggagatcaatcatggagtcatactcctctcggctaacctgagccgagttcaaaagctgcagcacacaaaagggaagaaagatcagatttcttaaaaagaatatgtgcatccgtctacttgcatagcagaaaggcagggaaaggcatcatcaccttctgcaaaagcttcgaatctgacattattggagcaagagcaggaagccgatggagtgagagcgcatcaagcagcacgagaaccatcaattgccactgccttgatctcagagaaggcagtgcatcaacaaatgacatcgtgtccaacaagtatccctagtggggaggggaaaaacacattagatgcacactaattatagctctaaatgttaattactgaaactgtaatcaaactaacaaataaaattcttggtggcaacatctagcagttaagctgtcttcaatagaatcaacaaaaaagagactggccctaattcagaataactgtaacgtacagcctccacttcgtcttatctatttccagatatgcgcagctcatcacccacacttatgaatgagagagaaccccaaatgactaagaaattattgttaaactgaccaagatattagtagcttgattgatctcagtcaaaggtgtctagataccagaacaaaatgcaacgaaaagcctcttcacagccgctgctgaaaaactatatgtactagccagtaaatacatatccaggttcaactaggtcactaaccaattgcggagtccttattcttttcttttaaaaaatgttttaactttttaattagtttgttcaactagctttatccataccagagtaatctccaactttgagactggaatttgcatcctcaagtttgatacaagaactggcagggcattacacacacaagtatccaaagctcttctaatttcagatgagtggccatcatttaaaactctcttctgaggacattctcttccacctgcaatcaacaaatcttccatagaactttcatcaagcccatacacataggccaatgaggaccgggatacccatccaaataatgcagcccacatcgttgcgaaggaggacagctgaaaaggaaaaaaggcatgacatgccaaattcaaccagaaggaaaaaaaagaagaagtgctactttattttttctcaagaattcttacagttagactaaagccttctggtggtgtatcatgccaagaatcatcgacatcaaacatatctgtgtctagaagcacagtcttcttcggccacttcacaacacccctatcaatttcaaatatttcattttcccctgcatctttgtcattgtcataatcattattgtactgttgctggttaaccatgtccggcagtatgatgattcctgcctttgaaactgttaccaaaaggcacaggttaatacatatcaaaaacaaaagctgcatgtcaaagcaccacagggttaaggaataagtgttcacctgcatcttctacttccgatgtgccagatgaaatagcttctgctgcttcaataagcgcagctgcacaagcttctgcagattcacgccttactgaactgtccatgctttcttgagatttactggagtgacttacaaatgctctgcttgtctctaacacacttccattctcgtctgcccatttcacagaatgccctgcattcttggatccaacagccttcaatgaagatcttagtgtacatctaccactatcatcacttgtctcgtcttttgcaatgttaactgcattactaaataattcatctagttcttcagtgtaagcttgcactgaatctatcgctgcatattgagatgatgaaggctgctcatttgctaatatagaacttgagaaattatattgacccagagcaccatgatccatcatttctgaaccacgatcacccataataattgtacttgtaaagtccacttcatgtccatcacgcccaactggtctttttgcaggcttactcttacctaccctcgatgttcctttagctgctttatttttcttcttatcctttttctcttcgagaactacatcctccagctgcttcacaatggaatccgatatgcaagacgacaacatatcattatcttcatcctgcttgaacatcttcaatggggttttggttgcttcctttttctttgcttttgtattctcagtaagaaccatgccggattcaccagaagaagcattcctagaatccacattaatattactggactgctcagcactacaagcatcgttctgtttagcctctttttttggccctgaaatacagaacacaagctcattgtttcttcaattgttcgaaactaagacaggtcgaacaaagagcaagaatgagcatatccttttcatatatataaatgtgcctgcaagtaaaactattgttactcttgtaacattgtcacatctagttctagaacattatttgaatataagaaaaacaaacagtgcctaggaggtaggagctaagtaccaccacactcccaccaaaccaccactgccttggtggcttggtgtttaggcactagggaccagtttgccaccttgttaggcagtttaggcacctccgtgagcagtgagaaaagaggaacaacacatgatgcttacaaagacatgatttttgtatttcttcggggaaatattgaacaaaacctgagcgcttttcattgacaaagtaagcagctcatctctcacccctctaatctctcaaaaaagaagtcactacctcccattaaaatctgtaacgtacttccaaaaattaattactctctcaatctcctatcttcgttctagcgtcccttatcaacaacaatatgtaggtctaaacaaaatgagtgaattgcctagttgtcctcttgtaatttgaatgactgcaaccaaaaaatatggcaccacggttatgtctattcttcagctgtcccttaccatatttgatagctctcaattattacctagttgattgtttctagtcatacacaaatgctactaatttgctaatcaggtagggagattttacacaaggagtttataactagttcaccaaaatgttgtagttgtacatgttacagagaattttcctaactgctactagcaacaacaattgttgatactcaaagtaatttactacgaacactacaaattcctccattttctatcttccaaagttttttctctacctaatttgagcacaaaggataacagagaatgccaccgccataaacctcactcatcgtactactaacctatggcagcacaatcaaaccaaacgagtaaataatttgaacagaaaaaccaatcaatgctcaatgcaaatagaaatagaagaggtcagcaaaaggcgattcacctccaacgacgcgatcacggcgaggcacatagccctcgatggcgtccgacggcccaatccactcctgcagcgtcacctcccccgtcccagccgcctccttctccatgatctccaccttcctcccctcttccacctccttcccatcgccgctcgccccaaaccctagcgccaacccaccgtcatcaccaccaccaccaccggcctcgaagagcgcgacgagggcgtcgagccggtcgggcgagacgcccaaggggcggtcgggcgggagcgacgccccgaaggcggcggaggcgacgaggcagcgctcggagcagaacttgcgggcctcctcgaggtcgtacacgcggtgctcccggagcgagatgcggaaccgcggcgccgccttgccgcgggcgtcctcccgagggagcgggttggggcacggccggtacccgcaggcgtcggcgatggagcgctccgtgacgacgtcggcgtagtccggccccgagagcagcgaggcccgccgcgcggagcagcggctccctcgaccccgcggcgccgtcgtagagcgccatctggacgcggtgcaccgccgacgcgacggtcgtgggcttcatcctcgcgccggtgtcggtgcccgtggtggggcccatgtcgtcgtcgtcggcgccgncgncggcgccggcgagggattttggaaggagttgagtttttagttcagagtcgagacgaagaggaagagagagggagctaacattgtcggtagtaaggcggttttctgggttgtgtgtgggccggcggccccacgtagcccgatgtgagttggatgggccttttgggcttgggccttgtaaattcgggcaggataagtccactttacattcgttgtatttccgtcgagtttaaatcgtatccctaaacgcgataccggatacataaaatcgggttaaattagattcaatggtattatgatggctggttccactgatgtgtcagtattcagaaaaagaaaatatgactatattccgtgcaacctgatacgacgttaatatcatatcagattgcatctgttaatgaatggagagggataattcacttgtactttaatatatcattttctttttgaatctgtaatagttggcttttaaacataatatttgataatatgtcttatttaaaatattaaaatatgcaaaaaaaaagaaataaagtccatttaacgataaatctcataacaaaataaataatatatttatatagtttttttataagacagatgatcaaatgtaatgtttaaaagtcattacagttatacactcagagtgttaaatgttgatacatttagaagtcattacattatggtctatttggctgctactttcatggttgcaccgtaaccggtatgaacagtgtcacactcaccgtgtgcagccgtagccttagccgttgcagccggcttgctgaaccctccctatatttggaagtcgagagcatttcgcatatgctgatctaaccaactgatggatcccctcttatcacaggaaagtgcaaaatagtgttttgccgatgagagcaaccaatggtgggtgggccaggccaatcaagaaatggagatgtacaaccacatgctgctaccacactagccagcaacacctcaccttgttacattgtagatatatatgacacgcgtgtctcacgcacattttgtctctatttgtacttacccaaaaacagttaagctcatctcaggtacacatgttcatcatttaatcaccaccaaaactaggtatcaacactgtgaccgacaatacatttcatatcaccagttaattaagctagcatacgtgtaagacaattagcctccaaatccacaaaacctagctctctgctcttctgtaggagtgggctcactacacataatatctgattcagggttttcaatttcgattttggccgaaatttcagtactttctccgggctaataatacttatcgttttaaataagggtgaggtcaaactttataatctttgattatgaatcatttttaaaatatttatctttcacatatagtgactaatggtgactatatgtatagattagtcttaaaaagtagagaaaaccccctgtatatccttgagaattcatccactcccttatgtactcctaaattttgcctcatcccttatatacctctgagtttttattttgatctcctctatgcccattaattccgttagttgaccgtgagttgaccgttaaatgttattaaaattgactatattacccctctcttatacttatgtgctagtttaatgacaaaaacacaattattatatgaaaaaagatctgtttgtaaataaacaaagggaatataattatttgacaacattttttaaaaaaaaataaattttaaattaacttttatgatatccgtacattgttttcatcaaaatttgaacccaacaaataaataattttggttcacaatttctagctaaagctcttatatggattttgtcaaaaaaaataaatttgttcaatagtttaaattttcttttcaataaataattatgtcctatttgattttatcatgagttacaatttttcacattgtgaattatgaagtagagtatataacatgtactgtaagaatgggaaatgggcgatatggtcattttagaaaaatttaacagtcaactcacggtcaactaacggaatagggatagaggagatcaaaatgaaaactcaagggcatgtaggggatgaggcaaaactcaggggtatagaagagatcgcgaaacttttcaggggtatgtagggaattttctctaaaaagtactttaataaaatcatatatttgttaacacttttatacatattataatgaaaaataatggttaatttttggagactgtgctcttgttcaaaatgataagtattatcaacctggagggtgtattttcggcacttattggaccgaatttttttaaaaattttaacataatttaattgataatttgactatattttgatcaaatttgtaaattttttttgagaaaaaccaaaaaatttggctgagataaccgagatttcgaaccgaaattgtaatcactgaccttaattacaagttatttcttgttttatataaaagggttaatctgaaatgtgcaatggctgaaataagctggtgtaaacctgtatagtcttttcatatataaggtcaccaaacgagcacttgagtttaattaatgtgcctaaatcgaaaccagcacatatacacgggtcgaaacagaatacaaacttatatagatggatgggtataaattaaaactaattaattcatccaattacctgagcgccgtgtgtcggccgaagccctaattacaaaattaaatcatcggtttctttctaacaagctgccacttcagtacttcctactgctgtcaacaacctctctatctacctatatagcttgtcatctcctcattcaccagtacaattaattttgtcattacactaggtctatccccattaatattttggttaattaattaataattaattgaaaaattggatcttagtctggtagctactatttgctcttacattatcatagtaacccaagatggtcctaacagtgatgttctagcttacgaaaaggaaaaatggcgaaagctagaggaatggaccaaccccggcttctatgatcatctctctcataatccaaattccttgattgatttgaatggtccatattgcatcatcagcttttactaaatcatgtccaaacacgcacaaaagagttggaaagaaagaaacattgcatccaaataaacaaacgaacaaggggacattgatcagtgtcaagatgatcctgccccaaccattccagagatgtacaaatacattgcatagacacaaatctttgactaatataggaggagatgtgtatatacacacggcaccatcattactgcagattaaggtaagtatcacacttacaagttggagtataatacccataaagaatgatggctatatgaattgatgcacatgatctataaattaaaactgctattttgatctgctacatagttggagcatctctatcaaatactaatactactactaatattactggggcaaacttttttagggaagtacattaattattagtgcaagcttttttggcatggtcaaattatctatagttaagtgctcttacttaaaaaaaactaattaagtcctctactaaatatgcaatctctgttgggcctgacaacccttgaatttattttctcccatgtactcctcctacctactttccatgatgaatattctgtctgtactccaacactaatcaaacaaagtggtactcaagtacacagcatgagtaatattagtatctaacactgatcatctaagtatctacatataaagtagggatcacatgtaactactaattaactaagttgtagccccccaatgctagctagtttaattcattaatactccagcatgtatcaaaggcttcaattaaaaatgagcaaatatagctggagctagcagtatggcaaattgcaaagaaagcaaaagcaagtgcacagtctattcaatatcaaggcaaagttggaataatccgagctagcatggagagcagcctgcgtgcttgataaactttggaattattattcatggaccacctttgattagacttttttcatggccaattaaggttatatgcatctactagcttgctagcttgccaaggatggttgttaagttctgaagacttgttctgaattgaagacttgtgctgaattggaagcttgcttgcagctgcctgctagccactaggcttcaattcaggcacgaattaaacaagttgcgtgtctgcatcggcattgcagaactcaagaaaagattaatcaaaaggtcggtctaagaaaacgggagaaattgattaaagatggaggaggaagagagatgacagatcagttccatctatatttataatattgacttgagagaaatcgttaagtttttaatatttccatgatgctatatattcctacttgtatgagattgacatgtcacctgcagctactacctgcaagtgcatggcatcatgaacagtatatattagtagatctaaactagtttatgcatacagcaagaagacacggccaaatgtaatgtgcctaaccatttgcagacacttgctggtcattgatgagcctgaatattattgtgtttgtgtactggcctccaaataaaggctaattaccacattgtataatactgttcatcattctggatggccttaattcagctgctgttgcttactttctgtgcaatcaatctgccatgcatgacaggatatgtatacagacaagaaaaaatggatgggtaggagtagattgattggaagagtgtgtatatggtactactaaattcagttataaatagtggcgtttagtttgtactacagtgatatgaatgatcacctatgcactagtttatttttaattgctagtacaaaatgcaaaatatattttaaaatgtaccccaaaacagatctagccataccgttttcaaaattgaatcgaagtattgcaaagatattgatgataagaatttacagacacattaattgtgcattttacaaaatacataacttattcgtaacatgaaggagggagtatacataaacacggaatacttttgaaaatcctgtattatatagttacaacccactaacatcatttactcttgtaaagaagcctatgcgtacgtgaggccacacatcgagaagccagaagctaaaccaatagaccagtagaaagttgctttgtatttttttcaaaattcttgtaccccctcatgttcctactatgtgacaccatttgtcggtgaaccttcgctttttctctccttctataatgaaattggcagagcacctgccccttcctaaaaaaaaatatcacttttatatatcatacatattataggtatttagttaaaattgatatttgtttcatataatttcccgtgtaacgtgcgaggtgtcgtctagttaatcagagagacgaccgagacaaagagaatgcatatgtagtatggcagtacaaggaggttgcacgaaagcgactaaaaattgagaaggcaaagggccagcagggagggacgttggcatggacggatcatggagtcactactgttcgtacatatacatagagcattaatctatgtgtgcgtgtcaaagaaacgagaaattaagttgtttaatgatctcaacaaaaaggaaaaacgatgggatggaatggaactctgcaaccaccaggatatgattcgaaatatgctcaacacgattgcatccatccatccatctgaattcgtaattgaggttggatcgaaatttaaccttatgctagctccagttagaaatgccgatagatgtatcgatcaatgcgtgatgtgtgcacggttttcttgtgccaccgacagcgcctcgccaacaaccgaccggagttcaaggagaaggagaggctaatgagcaaatatcaagctattcatgagtggcgacgattggtaaattcacttgtacttttgtatgaacataacatgtttcatactcataaaaatatttgatgtttagtacaatatttgatttttaaaactcaaaccatcgacgatttctcaaattgattagtttattaaaaaaatacaaaagtaattatatgtctatatttgacttaattaggaagcaagatatcataaacttaatgtgttttacaaacttattccaacataaaatttttaatgatcaaaatattaaaagcttgaccaaacattatcataaacattaaatatttatgttggagatggtaggattatatcgaaaccagtcggcgcacatgtatacaagtaattcgataattattgttgtacataaataaatcatactccctttgttcttaatatttacacttgtcttgtaaattgtacagtttttttttaatgaagtgagcgtatctcaactggttagattccttgtggtggaatcaatctacttggatttaaattataaatttaacacgggtgcttccttgataacttcataatatttttttcacgaatgcgcaaaaggattgcacgtcaatatatttgacacgggtgcttccttgatccactctctctttagtctcagtggttctggagtccatccattcatagagccatatgtggcatttagctggcgtcgctgtttctggggatttgttgggagtgtagcatggctcggtgccttccgccgcttggagtctgtttttagccgccgtagtttctctaagtttcttttgctttttctcccttctcctaacataagtcggtctgggcgattgcgttgtgtgtaacttcgtaatctcgacatatgctggccccctcgacacgccggcgtaacgacggcaaggggttccggccggcgactgtggcgtgggctgcgcgcatttctcgaagcggcaagacgtacgtactacctccatatttgatatcgatcatgaattacatcagagatcagtgacacgccatggcagtatggcacgcacggatcgatccgtcaacgccccaactgcagttaggtggcgcgatagtaacaagcataaatcgaacccttttagttacttttatttctctcctttttcttctaatctcctcattcttcttaattcttaagatatactcctactagaagaagaagaagaagcagtacagtgattactgtcttactgaagcatcagagcccatcactctctccctttctctctgaaaactctgtaaactaaactgatctgcgaattaaagttaaattacaagcgtttttgcgcggtggcacttcactgtcacacatgatgaccccgctcacatcatcacttagcaaagctgaccgttaaaacgcaatttcccatcgatcgtgcaacgatatatataccacctgccaccccttcttctcctctccacccccctctctgcttccctccacactgcctcgccaaccaaccaccgctacacacgaggcggcgcgtggccggagagcgagaaaaggcgacgtacccatcgatagcgagaaattaagttgccggagaggaggaggatgacgatgaggttggcggcggcggtggtggtgatggtggtggtggcggcggcggcgatgtcggtggaggcggagctgagcgtggattactacaagaagagttgtcccggagtggagaacgtggtgaggtaccatgtcgccaaggcgctcaaggcgaatcgcaaggaaggcgccgccctcgtccgcctcatcttccacgactgcttcgtcagggtaattatctcaatcagataattaactttcttgcatatcaattattgtagcggctcatgattgatccatccatatatatcaatctacatttgcagtacgtactagctaaggtttactagctagcttaactgttagttagttgtgtgtgtacatagtacaacttggctttgcagagtttagttgtgttacagttggtttcattcttcagaatcactcatcaggtgatcgatccatcgaggaaacttatcacattctagctaggttagttgattaattaataaggaaaacaactttactcttgatggaaataacagcaacatttacacaaactaactaagcaactactcaatcagcatcttatcttacaccaacgtcgtcgtcgccgcataagcgtgtatgagaaatgatcaaatcttaagctaatatacataacacagcttcttagttaagtctctgaaccccacttggttggttgttgtcaagatcaacacagatagttatcagcaagttagcagccacacgccactgcatttgacacactgtcatcactccatccagagacagtttcttcttctttctcttcctttctttccatgcacaaaagaaaagaaaagttcaatggagacctagctaagctaagctaagctagtttcgtgagctacttgacttctactagttcactactaatccaacatggcaagagagagaaactaaaggtagattagagagagaaagatagatagatagagagagagagagagattggtagccagcaattcagcatctgcaacatgcatgctggaatcgaatgtgatactttccttgtgtccatcatttggactgtcaatgcatgctacacctttttttttcccttctggctgcttagctaaacacataattaagctgcattagcttagcttaattagctctagggtcccagaaacactatgcccttgtcgtcagtttattccctctcctttcttttctctgcatgggtgccagccagatgcagctgctgctgatgttgctgtgattggcaagcaacatgtaactacctattcaattggttcatgcatcatcagtacgttttgcatacacacaaataattaattaattagactctcatgtatatcatattagtagtagtagtagttaaacatgattttattggtgttcgatttctaggtaagctcaattagtgggatatgattatgtttggattgtgcttggggccagagcttctttgcttcctatggggcaaattgttttcttgtgctgattgtctaggagagagagagagagagagagagagagagaggaaaaggacacatatgggagagaaaaggggacactgtgttgagaaagagaaagcatacctatatctctccagagtcatgaccaataattggtaccactagctcctcagtcatgaatagaaaagagagtaaaagtaattaattgaacttttttttacttacccttttgattaacaagtaattagtgcatgttctgacagagtttcagcactctcatccaagcaagcatcctagcttacttggctctaaaagttcttggagttgcatttgttctgattaaattacatattttgattggtttgtgcgagccaatttgtgttcatgttattagactaaaaatatagagtgaaactattttatttagacatgcaagaatacaacataggtcattagtggctacggaattgaatgagcacattatagacgaaatggtcggtagcatcggtagtctttctttttgttctcctctttttaagaaaataataaaagaagatgatgtacatatatacaagttgcagcatgcatggacttttcgttgtgtggtttaagcatcagcagcaatagaactgttcaagtaattaagaaccaataatgcatttgccctctcaccgacactacatatgcaattatatgtgcatatcgttttccaacaactcagctgacgatgatcaatcgatcgatctatcacacatttttctcaaggggctctaatataattaaaggtttatttgccatagcttcagctccatcttttaaaagttggagctcaacgaaacagtttcagctccatctaaaataagagtagatctggttgaagcattctcacaaaataaattagagaggtggagctagatttagactgttccacaactccactccaaatccaactcttaaaactaaatttaagagttggagctctatcaaacagatcctaactgtgcttaagtacagataggatgacttgccaagcacacatatagttaacagtattagtattaactactagtgttttggacggtggaacaagagtaggaggtatgagatcgatgatgtgtggaattaattgaacgattccgtggagatgtttggtccaaaggacggtatgattcggcctagtagtgttaggctcattggttgagagaataaagaaggatgaaacaactatagaataagtagcattttaatacaaaacaaatttaatataatgatatttttaattatggatttaataaaactaattcggtgttttatatgttgctaagtttttaacaagcttggtcaaacttgatatagtttgacataggtcaaaaaaaacgtcttataatatggtgtggaagattgttaattgactaactacctaaattggggtatatagagaacttcaacatatgcagagtgtttaaggcattattagttgactacattgcgcgtgcttaattttttatcaattgtattgtctaatcatgtgataattaccgttagctaacataattatgacatacatttaaatcttaccccgatattcactaatcccaaaacatctaattgttaccagtcaaatttatggatcattcctgcttatcctactatggttctacttgtacaatgcagaaattctgaaatatttctgcctaaaaaaattcaaaattcgaacaaattttagtataacgatttgacctttttttaccacgcaaacaattttaagtttggtcaagtttatgaaaactttttgtatttgaattgtttggcgccattgattaattacaatgtaaaaaatgcacgacaaatttgaattctcaattggttgctgattatagtaattttttttttaaaaaaacgcgcgaatgttaatgatcgatttgaattggaatgggtggtgcaggggtgcgacgcgtcggtgctgctggacccgaccgcggagaacccgcacacggagaagacggcgccgatcaacatcggcctcgccgcgttcgagctcatcgacgagatcaaggcggcggtggaggagcggtgcccgggcgtggtctcctgcgccgacatcgtcatctacgccgcccgcgacgcctccatcctcctcagcaacggccacgtccacttcgacgtcctcgccggccgcctcgacggccgcgtctcccgcgccgccgacgcccagcgcgacctcccggactccaccttcaccatctccgagctcatccgcaacttccgccgcaagaacttcaccatcgaggagctcgtcatcctctccggcgcccacgccgtcggcgtcggccactgctcctccctccgcgcccgcctcaccgggccacccgagcagatcctcccgggataccgcagcctcctcgccggcaagtgcgccgccggcgaggacccgatcgtgcccaacaacgtccgcgacgaggaccccgccgccgtcgccgccaccatcccgtccttccttccgaagctgaggaagttcgagttcttggacaacagctactaccacaacaacctcgcgaggatcgtcaccttcaactccgattggcagctgctcacggagaagaaggcgcgcggccatgtccacgagtacgccgacaatggcacgctctgggacgaggatttctccgaggcgctggtcaagctcagcaagctgccattgccgcccaaggccaagggcgagatccgccgccattgccgcggcgtcaacacccaccactactgattcttcatcctcatcatcccaacatcaagccttccatcttgagctctcatctgcatcctcattttcaataattctttgtttcattattcgcatggttggttcatcatcgtcgtttaattttgtgtatcttgttcttttttttgatttgttggtgctcgtcgatctcgtgttgaattggtttaattttgtgttgaattctacgcgcatgtgtatgtgagaacaccagtacagcgagaattcatggtgtatagtagcttttgtgttgttgcattctctgtctattggtgtcaaaaagaaagaaagttaattagttgttgtttttttttttggtatggtttggattggatttgtattcatccatccaaaactttctccattttcatgtaataaggagggattacagaaagatcgatatatggcactggccacttcaattatgttccatttccagttttaactgtgatgagcaagccctactgtcattgctagtccagatcctctgtttttaatggatgtcaatttgcttctagcaaaaaggaaacatgaaatgaaaagaaaagaagcacaaaattatgctactccttcatgttaaacatactagtgatttcaatggcacaatgttaattcttgaattattatcacagtaactctagatggcagcaattatatttgggcccatccacaggaagattcgatgggcccaaatataattgctgtcatctagagtgcaagcctagggccatttggaccatgagaaacgtgttgggctcaaatgtgacttccattcatgaaatttagaccggcccattaatcatctagacccaattgtgggcccaaattgccatgcttgagacacatggcccatatgtgcagtccagcgggatcacagcccatttcgctaatcaagctggactccaacacacatcgacgaggccagggaataagatcactttgactccctcaactgaccaccgaatctaaatcgtatccctcaaccgtaataccagaaatctcgaccccccgaacttgcgaaaccggtgcaatttgactccctcggcggttttgggggcggtttcgctgacatggcaccatgtggcgcctacatgtagatattgacctagtcttcggtccacgtggcgttgacgtggcacttacgtggcagtagaattaaaaaatatacgtgggacccattagtcattcacacaaaaaaactgtgggcccactgacatgtggggcccacatgtcagccctttcttcttcctcctccctctcttccttctctctctttctatccccttcttcccattcggccgacgggcaggagggcggctggcggcatcggggcacatcagaaccggaccaggggcggcggtcggcggctagggcggcggtggctcccccgcgacggctcgcgatagtgggaggacgaggggaacgacggcggcgactggcggcagtgggaggacgaggggaacggcagcggcgactcgcggcaatgggaggacgagtggaacggcggtggcggcccgcgctgccgctcgtcatcctcatcctcgcgggtaccggcgtggtctccgacggctcgtgaggtcgtcgtcggtgacgaagcgactggcgcggggggtcatgtggaggccgttggagaaggtcggggtgacggggctggagaaggccaggggtggcaaacactacaacgccacctccttcggcgagaaccatcaaatcgaaagagacaaacaaaacaaagaaacaaaagaaaaggaaaaaaaggggacgagaggcggcgctcacctccatggcgggatctcacgggcggcggggacagggagggagcagctggtagctgcgaatggcgagatgcgacggggactccgaggcgaggcccaagaagctccgatggccgccgccgctcccctcgttcgtgcgccgtttccattgtcggtagaccccggcggtgcgccaccgcctccccaccgaggccgagccgggccggcccccgctcttgctgccctctcgaccgccggccaaatgggaagaaggggagagattgagagagaagggagagagggaggaggaagaagaaaggactgacatgtgggccccacatgttagtgggcccactttttttttaatgactaatgggtcccacaaatattttttaattctactgccacgtaagtgccacgttaacgccacgtggaccgtagactcggtcaatatcaccacataggcgccacgtcagcgaaaccacccccccaaaccaccgagggagtcaaattgcaccggttttgcaagtttggggggtcgagatttctgttattgcggttgagggatacgatttagattaggtggtcagttgagggagtcaaagtgatcttattcccgaggccagcgaaccagcggacccaggtttgggccagcccctgaccagcccactacctattcggtccaagagaatggtgaaaatgtgggctctcgtacccaggtctcaggccatagccttaagtggcccaggacctggtccgccactggatagaagtcagaactcgccggagaaatcgaagaagaccacggtgatcgacctagtgatctcgttggtttactgttcaccgatcggaccgtcgagtcagccggttcaatgctgaacggaggtatatggctactatatattttctattaaaaaaaatgagtttgctagcaatatggtaaacttgataatgggtctgttcactttgatgaaaaaaaaaaaaaaccttaccaaattttagcattttggtatagttgccaaaattttggtaaacttgtcaaaattttgacaggatttcttatatagttatcaaaatttaatagcaaactaaatgtagggcctgtttactttgatgccaaaaaaaaaccttaccaaattttagcatagttaccaaaattttgacaacttgccaaaattttggcaggatttcttatatagttaccaaaatttggcagcaaactaaatgtagccacttttttgataactttaccaaaaatttggtaaggttaaaaatggcatcaaagtgaacaggcccgtagccactttttttgcaactttaccaaaatttggtaaggttgaaaatggcatcaaagtgaacaggcccaatgtctcaatccgcaagtcacgggttcaaatcacttcccacacatgctttctcttatattttgcataaaatataaatgggccgtggtgtaggatgatgggccttacaaggctagcccaagcgttagcccaacttacaatgaaccgccggttcttattagcccggttcgccggttttcactaaaaaccatccggttcactcggttcttaccgggtcaaatgcatgagccgtccgttctactaaaccgaaccggtgagaggcatggttctggttttacgattcaaccgctgggccggtccggtttttttactaggctggcacaacctttcctttcccatatccggaggtatcccagccggcgactataggagtagaaatccggagagacgcaacctttttctttcccatatccggaggtatccctgccggcggctaggagtagaaatccggagatgcagtgaccaatcgctggaaagaagaattgcagtggtgctactccctccgtttcataatgtaagactttctagtattgctcatattcatatagatgttaatgaatatagatacacatatatgtctagattcattaacatctctataaatgtgggcaatactagaaagacttatattatgaaacggaggaagtatatcagaacaaggagcgccggcaagtagaagaagggttggaagaggaggaacaccaccactatatcccgattagtttcagcacgtggggtatgtgcgtgcttcccggcaagtggaccagctccagtttcagagaagatgggaattggtgatgatctgaccaccatccaactcgtcgccatagcctacatagctttgcttgcttgccgcgaaatctgatgagcatgtctgaagaattttccatgttaaattcagagttcagacttcgcttacttgcaatgcgacttgcctcccgatctaactactagatggctcgcgaccgatcgagcaattaatctccccatccacgcacaatccatctcgcattagttttctctcaacttattcacaatttcgactatatattgcacatgtacacaagctttttttttctctgttaaaacaaatccatcgcggctatattttctctctcattgcctggttattatctaatcggtcacaactaaaatttaaatttattatttgattttacagttgattttgcgttttttctcattataatttatcttttaagcattggtttttaaatcgttaaaacacgaatataaaagtttaaccttcaattcgttgcttagttgagttttttcgttgtctatcagctactcaccgtggacttcaatttttattgtggtttaatagagcaaccaccaacagttgaactgtttaggaaatatagatacagtagtgtaaagttgtatttggtttgatgctaatatatttttttagaaacacggtacaaacttaaatgcttataacgcacgtacactcaccccttgtaaacacacgcacacaccatacccctacgagcaccttaaaaatctgagcaggccaacatataattagaagctagtaaaattttgataagaatttagaaagtgtcaaattggatatcggcaatgccaatgatttggcttcggactaaaatcaccctatctagtattgaaactatcggtaaaaacatttcagcttcaatttaaaacggccctaagattcaagtaaatcgttaggaatgtgaagaataagtaccaattttattatgtagattggtcaggcagattggtatgcaatgcagtttgtagctctatgttgtttggagtggttcataagatattgcagttagtgttaaaggcaaaagnnnnnnnnnnnnnnnnnnnnnnnnnnnnnnnnnnnnnnnnnnnnnnnnnnnnnnnngagnggcaatatcaatcaatgccgcggg

SEQ ID NO: 6651 - DNA, 4332 bp, Oryza sativa
  unsure (1)..(4332): unsure at all n locations
accgtcttctaatacagggttggtaataggtgggcttataaacccctgctctatatatgtccgtttaaattgggtggtaaaggtgtcccttacacttcccctcccccccgattgnaatgtgacatgtaactcagtcaccaannnnnnnnnnnnnnnnnnnnnnnnnnnnnnnnnnnnnnnnnnnaatatagatacagtagtgcaaagttgtatttggtttgatgctaatatatttttttagaaacacgggacaaacttaaatgcttataacgcacgtacactcaccccttgtaaacacacgcacacaccatacccctacgagcaccttaaaaatctgagcaggccaacatataattagaagctagtaaaattttgataagaatttagaaagtgtcaaattggatatcggcaatgccaatgatttggcttcggactaaaatcaccctatctagtattgaaactatcggtaaaaacatttcagcttcaatttaaaacggccctaagattcaataatgcatctaccttgccgacactacaggaacgcccatcgatccttttccgttcgacaactgatcagacgatcgatcgagatagatattatggagctagcacatttcagctccagggctctaactatatagtactccctccgttttaaaatacttgacaccgttgactttttagtacatgttagactgttcgtcttattaaaaaaaattgtgaaatatataaaactatatgtgtacataaaagtatatttaacaacgaatcaaatgatataaaaagaataaataattacttaaatttttttgaataagacaaattgtcaaacacatactgaaaagttaacggtgtcaaatattttgaaacgtagggagtatattgctcaagtaccaacgaattgaaatgacttgtcttgtccattttaatttgcacgtaggccacttaacagcaactttgaaaacaaatggtaggagtattaactatggttaggacatattggggataacgacgaaggcaagacaaagatggaatagaacgattccttctgtattggtgagagaacgtgccgaaagatccggttcttgaatatattacagggaggatgaaatggaacgaaaggtactaactataaaatattatcaaaaatgagaggagaaattagtcaatttcattagtacaacccaagtgcatgtttacctacatccactatcatcatatacatacttcaagaaaagcataatactaatatatattatatcctcttatcagtacaaatataccattctcaataaaacatcgattaatgccttagaatattgttgcacatgcattaattatttgaattgtaaaaaccattcttcttctccgggagccctccatcggtctcttgttttctaggtgattaatttccggttcaatgtacattaggttaactgatattactgagcaagcctaataatcagtcagctgcttattctaaaattttgcttaattttcactctttcttagttggagttaattcttgagactatttagtcgcctgcggctttgcactctcgcgtctcaactctctcctctagcttactgcaacagctgatgtggaaggctaatagccggttattgtacatgtgctcgatctaatggaatacttaaatcatatgttaatatatactccctccatattttaatgcatgacgccgttgactttttgacaagcgtttgacctttcgtcttattcaaaaaatttatgtaattataatttattttattgtgacttgatttatcatcaaatgttctttaagcatgacataagtatttttatatttgtataaaaattttgaataagacgagtggtcaaacgttggttaaaaagtcaacggcgtcataaattaaaatacggagggagtaattaattgagcatgtcattttggagacaatcagacaactatatgcagattctaataaaacaactccaagatacataattaagaacacaatagacaagttgatgaatttaatctagtacagattagttcatcagctagttgcaactaacccttgcacatgcatccagcattccagccgatcattctaccactttgattggatatgctatctacatggaatccactttcgaatttatatctatatatgctcggactttttttcctactatcaggttgaggaagagttaaggcgctaattcagctatagtgcctatggaactaccaaccaattttttttatccaaattaattaacatatatttgctactcctacccaattagttgcagttggcctgatgaacagaagaagttggagactggcagattaactctgacttctgagatgacttcttgtcgatcaagagcaggtttttctccgtgaaagatggaatgactgaactaattaattaatagtataatttagttagcgcgggtagcaatagggtgctgcgtcgatatccactattagtccattacctagcgaaaatattttgacaatcagtcgtatgttatcaaatgtggaaaaagttgtaattcatatattattgttgtaagctcagctcactttaaggacgatctatgtgagaaaaaattacaggaattttacataagttagtttagtttcggtgaaattccttttgaaaatcctccatttcaagggaaagcctaaaaaactatagaatttttctacaattccacggacctagatttagaaagcagaattagagtcaatatataattatttctcctatttctataaatgtgtttttatttgaatatagctactaaacaaaatacctatgttttgctacaaataaatatgaattatgcatgtttggaaagaatcgattgtgatgttttttttatagatagagtacaattcatctgtgtacgtgtagacgtcttttcaggataaatttgtagttgagagatgtaataagattaagagtaaatttcacaaaactacaggtactttgcacaatctatcacaaaactacatatttaaaaaattgtctcataaaactacagatttagggacctcgttatcacaaaactacaggtcttagctctcccagttaaatctaccgtgacctgacaggggtggcccacttgcagtctcaggaaccttcaagatggttgccacatcagaaatcccatgtcactcctcctccggttgaatcgtcagtccacgcacgcacttttccttctcctggaaggaaccacgccagtcctcctgcgccctgggcggcaaaagagaggaaacgcgggaacgagcaaaataatggggatgaaggggggaacctaggaggagggagaacatagctcgtttgcttcggaggcagatttgtagagcagttctttcaattgtgcttccctcatgtcaagcagagcattcttgtgggctaactcatcattcttctctttctccaaacggtctttcagggcaaaagccttaaacatgtcagcttgaataattgcttcacgtttcactccacggtccaccatatcccacatgccagctagtgtcttcttcaccctcgagtcccattcaggatccacccattgaacgaacttgcattggtcctcgtcttcctgaataagcccaacaaaatcaggtcaaaattgtgggggaaaattaaaaaaaaaacaaaatcaaagaaaacaaaaaaacaaacctctaatggacagcccaagaacctcctgcctgtgtcttctccttcccaagccaccctccgtgctagacacaatccatgcttgcagcgcaatcgagttcctttctcctcaccatgccattctgtttcttccaaatataagggcactgcatccagacttacctcctacgaccccaaagatttcattcgatcccaactcaccaaatcaaacccaatttcgaaaaatcaaaatcaaaaccaatcgcacactcaaatccactagtatatacattgcataccttgcccaatgcacagctcacgctaccctgttgctgggatggtgcacctatgcttcgcttcttgctcgcgctattcgccgatgccatctctatggctagggtttcttcaggccaaagaggaacgatgcggtgaccaggcgaagacgcgagacgacgatgcacgcgtggaaagtgaggaattggccaccgaatgggtccacgtagaggtggccaaatgggccgggccaaacgggccgcgcgcggcacggccggacctgtagcaggcacggcccggcacggcctgctacagtaacgggccgtgccggcacggcccgtttagccgtgccgtgcttgggccgctggccgagcacgcgggccggcacggcacggcccg

SEQ ID NO: 6652 - DNA, 2956 bp, Oryza sativa
  unsure (1)..(2956): unsure at all n locations
actcctcatcttgtgctctcaagtgttttaagtgctctctttgttctcaagtgtgcatttttttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcaccgtcgttcaccttgggtgatttcgaccccaactacatgtcggggtttgacggtacctccggatcggctccaactccaccatctgtggaggaggtaccggttcatacggctgtcgttgaggaggtaccggttcaggaggcgacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcagagtcgtgtgccaagaagcaaggaatacaactccggcagcagcaacttatgctaaacccagacggtacggtacgcagttgggagtacgatcccatggttgctcgggaatctcttgtccggttaatcgccaggcaagatttacccttgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgtttgtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagagctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtggaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacatgtttattatccaactgctaatataattttgcacaaccttcttgaaattgttactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccacttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttacctttaaattatttcataataatgaatcacaatctatatttttaaatttttcaacacaacaaaaaaataccattttttctttttttttaacattagcaaatcattacttttttaaaaaacttttatttccattttttaaataccattttttcattttttaacattagtaaatcattacttttttttaaacattttatttccatttttaatttttttttccttatacatttcctttgcttttttttttttaaaaannnnnnnnnnnnnnnnnnnnnnnnnnnnnnnnnnggaggaacgctattcagtgcgt

SEQ ID NO: 6653 - DNA, 1382 bp, Oryza sativa
  unsure (1)..(1382): unsure at all n locations
natgtgcacaggggccgcggtgcccgaacgggccggtggccgcgggggtnccgtncggcaaggggcagggccggacatcacgggccgtgcttgggcggcggctcgcaacgtggncgggcaggcacggccggttttatcagcggtgcctaacggnccgtnccgaacgggccggtgcggaaaccgtgcccgtgccgggccgggccgtcccgcccgtttggccacctctgggtccacgagagggatagaaacacatcctgcaacttcttcgtacaaccgttccaccacgcacgcatttgacatgggatttctgatgtggcaaccatcttgaaggttcctgagactgcaagtgggccacccctgtcaggtcacggtagatttaacggggagagctaaaacctgtagttttgtgataacggggtccctaaatctatagttttatgagacaatttcttaaatctgtagttttgtgatagattgtgcaaagtacctgtagttttgtgaaatttactctaagattaaaattatgtgctctattttgtaatattaaaatcatatgaaagagtagttagtaaaaatataaacattttttttggcaaaaattcattgctcttcttttagaatagtgtagatattaattggtctatttacacggtcatatagagttttggatccatcatcataatcaaagggtgtgtatatatttttctttttctccgaataagcatggtaacttaattttaaaccacaaaagtaaacgtgttgggtcctttaatttttgctctaattaaaactacaaatttaattaatcagtgacaaacaaacgcgtacagttgtcaagctgaccagcaagagatgatgataatcgatcatcgtatatatcatccgaattaacgaaatggattggaagagaaggaagttggcaacgaattgaacttcgtcccaacttgtaatatttatatatataaacgttccatttgactagcgcaactaattaaactaggcttatcaggcgacagcggcgccaaactgacaatacaaagattggattttttttaagataataatataaatattgaatagacgcccaagactaaaacgcatcatcgttcatagtcgtcatataattgccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncn

SEQ ID NO: 6654 - DNA, 733 bp, Oryza sativa
  unsure (1)..(733): unsure at all n locations
ngnccataagtgccgaaaatacacctccagggttgataatacttatcatttggaccaagagcacagtctccaaaaattaaccattatttttcattataatatgtataaaagtgttaccaaatatatgattttattaaagtactttttaaagaaaattccctacatacccctgaaaagtttcgcgatctcttctatacccttgagttttgcctcatcccctacatgcccttgagttttcattttgatctcctctatccctattccgttagttgaccgtgagttgactgttaaatttttctaaaatgaccatatcgcccatttcccattcttacagtacatgttatatactctacttcataattcacaatgtgaaaaattgtaactcatgataaaatcaaataggacataattatttattgaaaagaaaatttaaactattgaacaaatttattttttttgacaaaatccatataagagctttagctagaaattgtgaaccaaaattatttatttgttgggttcaaattttgatgaaaacaatgtacggatatcataaaagttaatttaaaatttatttttttttaaaaaatgttcccgggggtggcgaggccgaggagttgcaagagcctctctgcggaggccctgtgcaacctgaggagctggctggagannnnnnnnnnnnnnnnnnnnnnnnnnnnnnnnnnnnnnaggcgagtgacaatcagngcacgcg

SEQ ID NO: 6655 - DNA, 714 bp, Oryza sativa
  unsure (1)..(714): unsure at all n locations
cgcgcgccggatgaanatgactaactcgccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcaacactgctggtgcagccaaatgtcctcaaggctccataagttgtcctcgaaatctccgagctcatcgaagtccggcaagccggcggtggcggcgatggtggtggtggtggtggcaagaagctccgaccagctgccgctaagcacgtcgccgtggatcgtgtcgttctccgccgccgccgacgacgaccggagcgtgctggatgcgtcgtcggggctcatggtcaccgccgcctggctcggctcgctgcagctcgtgtcgcccccgccgccgcagccgtggtggtggtacgcttcgctactcaccgccggcgccaccaccatggcgcccgcggcgagcggaatctgctggtgctggaggtacatcgcgccacgccccgagctcttcgaccttctncgcggcgccgacaccggcgccgtcgccgacactccgccgccgccgcggc

SEQ ID NO: 6656 - DNA, 738 bp, Oryza sativa
  unsure (1)..(738): unsure at all n locations
atttgcgctcacattcgtgacagatccctaggttttccaaattcctcnggtttntnnttnnnnnnantccaagggggccttaggtaattccggtaggaaagtgtggggaaccccctaatattatttccaccaaggcccataatagaggtggctactaccttcaattttatccatatcactcactcataaataaattaagagacaacatatatgatgtgtcacttctaatacataaatatcgataactttaatattttcacactatttttggagtttgtgtggaggtaacatgtgtaaaagaggtatattgtaggtgtatgttaatgtgagtgtggtatgaatgggttgtacgtactccctccatcccaacgtctcgactctgaactaaaaactcaactcctcccaaaatccctcgccgccgccgccgccgccgcggacgacgacgacatgggccccaccacggccaccgacaccggcgcgaggatgaagcccacgaccgtcgcgtcggcggtgcaccgcgtccagatggcgctctacgacggcgccgcggcgtcgagggagcagttgctccgcgcggcggcctcgatgctctcggggccggcctacgccgacgtcgtcacggagcgctccatcgccgacgcctgcgggtacccggcgtgccccnnnnnnnnnnnnnnnnnnnnnnnnnnnnnnnnnnnngtnngtgcaacgctntctagtggtgtcatcaaccccact

SEQ ID NO: 6657 - DNA, 743 bp, Oryza sativa
  unsure (1)..(743): unsure at all n locations
cgcgccatgaanacctgatnnnnnnnnnnnnnnnnnnnnnnnnnnnnnnnnnnnnnnnnnnnnnnnnnnnnnnnnntgtgccctacccttgccgcactcgctcgctctcaagctcctcctccgccggcgtcatggcacggggctgcgcaccgctcgatggtagcgtgctgccgccttcccgcatcgtgagcgagaggcaggccgggctgccgcacctattcatgccggaatctgccaccggcccggaggtggtgacgctgggcgaggggcgcccagcgccacactacccggggcggtccgtcttcttcctctttttcgcaatggcggggctggtcccgccattctctatttttttcatggatattctcgagttttatgatctacagatggcgcacctcacccccaacgcgataatgacgttggccatcttcgcgcacctgtgcgagatgtttatcggggtgcgcccatctctccggctgtcccggtggttcttcaccgtacagccggtgtcgccgccgacggtagtcggtggctgctacttccagccgcgggggcaggtgctgaaccgctacattccctgcgtcctccgcaaaaagtggaacaattgaaaaacgatgggttttaccttcctttgccgacaaagcgcgcttcaacttccggagcagcccacaggaaggcctccatttggcgccgcgggtaaatctgagaacggttacaacgccttttttgaccgtcgggcggtt

SEQ ID NO: 6658 - DNA, 1158 bp, Oryza sativa
  unsure (1)..(1158): unsure at all n locations
gctgtccagggtaatactctgtctnnnnnnnnnnnnnnnnnnnnnnnnnnnnnnnnnnnnnnnnnnnnnnnnnnnnnttggctgccgcgaacagcacggtgctggacgggttaagtgcccatatggaggccctgcaggcggagcgggcggagctcgacgcggtgtgggctcgcgtttaggaggggtggcgctcggtggaggccatggtggaggcgggccgcaaggcgcaccgccggcacgcctcacagctcgaggcccatcgtagggacctggcgaagatcgccagggaggtggaggaggagcgggagactgccctcatcgccaccgccgtgctcgacgaggcgcgggacgacctccgcctacaatacgggagccgggcgcggagctagaggagaagctcgacgccgcccggggagtccttgacgccgccgctgcccgggaacggcgggcggaggagaacgaggcggcgtcccggcagcgcgaagaggccctcgaggctcgcgccacggcactggaagagcgcgcccgcgccctggacgcgaaggagagagacctgcggaccgcgaggccgccgtcgccacccgggaggcaacactggcggcgcacgaggccgcctgcgccgaagaggagtccgcactccgcctccgcgaggacgcgctcaccgagtgggggcgagctctcgaggaggccaaggccgcggcgcaacggctggcggacagcctgttcctccgcgaggcagcgcgggaagagcaggcgcgccgcaatctgaaaggcgcccgcgccgagagggccgcactggatcagcgggccgctaagctcaaggcgcgggcgaaggagctgaacgcgagagcgcacagcggcggagcggccgcgggcctcggcgacctagccgcccgcctcgcagccgccgaacacaccatcgccgagctgcagggcgcgctggactcgtccgccggggaggtcgaggccctccgcatggcgagcgaggtannggcccgcatgcttcgggacgccgtcttccgtctagaccgcgccgggcggcaggcgggccttctgggcgggcggtacgcgaagtacgccgnncaacagggggggcctcgcccagggctttcagagatggccgggccctcgagcggctccccgaggagctcgaagaga

SEQ ID NO: 6659 - DNA, 2316 bp, Oryza sativa
  unsure (1)..(2316): unsure at all n locations
naacaggccagggaccctgacttctccccgtgggcagcgttgaaagagttccctcccggaacggggcacggcgcgcgcgcgcaggtcggggacgccgccgaccacatcgtccacagcttcgagggtacggcccctcagctcgcgttcgcgctcgactccgacgaggagggcggtgacgacggtgcggacgacagcgacgacgaggccggcgacccgggcgcgtcggagtgagcccccaggcccccgccaatcttaataacttttccttcttcttccgaggcctttgagcccccttcttgtatagactgatttaatctgtaatcaagtaacgaggaaatttctgcatcagttctgtttgttgtgtgtatgagacaaggatggtctgtgccgcggtccttctgtgtcttggcttgaacaagggctcgtgcccaggtcccagcctcaaacggcgcgggtcggggctagtgcctggggagatccacgtgtcgagactggccaggccgggagtgcggtgaccgagggttatggatgacccgattgtgggcctttgccgattcccccccggagttcaccacgccccggggcacggctcggttctgggccccgtttggcgattttagccggcccgtgccaccaagggtagggtcgagcacgagcgtgctaattcaagccaagattcttcaaaaggaaacaatggcacagacacagtcctcaggaaatcgaaaatgcttttatagaaatacggaagagaaaaaaggtaagtatatgcatgtggtagcccccggccaaccctgcacgcccggggggggtgcggggttggcccgagcccgagacatgacacccgacccccactaggggtagaagcgacgaaggtgttcgatgttccgcgggttaggcagctctgtgccgtcgcctgtggctagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctgggagcgcgcggctcggagggccgcgcgctgccttcgctcttccaaatagtcaaggtcgtctcggcgaagctgatcttgatcagcctcgcaatacatggtgacccgaggggacctcagggtaagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcctatctcttcgcagtagtcaccgaagagctcactagtgaactgggtgccgttatccgtaatgatacggttagacaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccaaacaggaaacggccacgaaagaggtatggtctgcagggcctgggccggctgatgggtttgcctagcgtggaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgcgccgaacgtgttcactcccttcgcggtcctcgggtagagtcttatctgcaaggtacgcctggatctcagtgatccaagcaatcaatctaggggagctgggagcgctcccctcgggtcccgaggcttggactccgacgggcctcgggggccgttcaggcgcatccgtctcccctagggggtcgggtcgcaccgatggctgggcaatcctttcttcaaaggcgcccggtggggtctgggctcgcgagnnnnnnnnnnnnnnnnnnnnnnnnnnnnnnnnnnnnngagagctgcccacgttncactct

SEQ ID NO: 6660 - DNA, 4465 bp, Oryza sativa
  unsure (1)..(4465): unsure at all n locations
cgcgcgcatganaacttgaantgccccctcccnnnnnnnnnnnnnnnnnnnnnnnnnnnnnnnnnnnnnnnnnnnnnnnnnnnnnntcagagcaccggtactccttacagacctggttaacggaccaactgggagtcgcctaacaccaggaagcggcggatccccagtccagctgccactctgagtcccgcaaggagtccctcgtactccgccatattgttggtcgcccgaaagtcgaggcggaccaggtatctgaggaagtctccgctcggcgaggtcaacgtgacccccgcaccagcgccctgaagagacagggagccgtcgaactgcatcacccagtaggcggtgtgaggcagctgcgaggggcccgagctggcctcgggggcggagacgggctcgggcgctggggtccactccgccacaaagtcggcgagggcctggctcttgatcgcgtggcgtggttcaaagcgcaaatcgaattcagagagttcgattgcccatctcaccacccgtccagtaccctctcggttatgcaagatttggccgagggggtaagacgtaaccaccgtgacccgatgcgcctggaaataatggcgcaacttcctcgaagccatcagaatagcgtaaagtatcttctgggcctgagggtatcgggtcttggcgtcccggagggcctcgctaacgaagtagacgggccgctgcacctttcggcggggccgatcctcttcgctaggggccgcatctccagggcgctcttcgtccgagaggccacgcggggcgcactcggcttctgtgccgacgacctcggggtcagagggcgacaggcgcggccttcccgcagtggccccggggccatcctgggggtcgggggcgcctggcaccgtcggacaagcaggcggagggccagctccggccgttgggggccttgggccgccgttcggctcgggggcctctcctccctgctctctcccgggtcgagtcgacacagggtggggatgcgcggagtgagggttgtcctcgtcgcgctccacgaccaacgccgtgctgaccacctgcgggggtgccgccaggtagagtagcaaccgctcatctggcttccgggcgaccaagaccgggggagaactgaggtacaccttcaactgagtgaaggcccgctcagcctcctccgtccaggtaaacggcccggagcgtttgaggagcttaaataggggtagtgccttctctcccagcctcgatatgaaccgacttagggcggccatgcagccggtgacgcactgcacatccctaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggcagagcggagactttcgaaagttttcgctagatccgagagtaaggtctcttggttgcgcgtcttcacaaccaagtcatcaacataggcctcaacattgcgtcctatctggctacccaaagaaattcgagtagtacgttgaaaaataggacctgcattctttaacccgaaaggcattgtcgtataacaataagttcctatgggggtaatgaatgcattttttcctcatcctccctagccatgcgaatctgatgataaccagagtatgcatctagaaaacacaaaaggtcgcaccccgcggtggagtcgacaatctgatctatgtgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacgatgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaaccttcttgaccgggacctcgtcgcacgtgaccatacgctgccttggggcggccgggacggaggtgctgagcctctcgtcgccacccgcgggcttggacgccgcggcgaggtggtccgcgcgctgctccataggtcgccatggacggtgatggggccaccggggcccggcatcttcatctggagataggcgtagtggaccgccgccatgaacttcaccaactgtcgcgaccgagaaaaatacattttcccgaacgctagtgtattaatccccgtcccaggaaaagccggggtacaccacacaaacatggtacaaaaggcacatctttattatatcgataatatttacattattacaaaggcacttaaggcctaacaatcaaaaataaacagcagcggactagcgggcctgcggctccatcttcacaggcgctcaactggggtataagccaggactccacctaagacttcttctccaaagcttctcttactgaaggggggaaaagattgagcaagaatgagtacaaccacagtactcagcaagccacaccggcagatgcatgattaatgcaagggggtacaaggggtaatattataggggttaagttttgcagaaaacagcatttaaaagtcacttagttgcccaaagccattttataaagacgatcctagagttacacagtgttattaatcaaggccgtgaaccctcacgaacctgccttaatccaaggcctacgatgattcagatcgaactggcaacccgaccctgggtctcagctcgtcccaagccaacccaggccaaccatttcacattttagttgttaagcaaattttaagaattaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagttcccaacccatcctagccataaacaagagtaccgacccaaccccacctacggccggaacccccgagacaggtaggcaggactgagcccccagcagcaggacaccggccctgtgccatgacatctcgactaccgggccgtagctcgtgtagccttcatttgtcctagagatgtccatcgacccccgacttcgtccatctccatccgtgtacttttgtttataaccagaccgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacataatgttgcctaattaatcagcgaagcatctacctaaattcatactagtggaaccatgaatagagtacccactagttggggttttgtttatcctagggtgaacaaggtaataataacaatagcaataataatgtcttaacaaaggtaaataggcatggctaaataaaacagtgataacgcgggaatttaaataaagcggtaatgcattaatttaaattaaaataattttataaactgggattcaatatgctcaaggatgatgtgaattgccttgctcagagagaacggccttccgacccttcggcgacgaccacgaaccacgcttcgggaacctctggaacgacgaaagctacgcgaagcacacaagcaaagctacaagcctataaagaagcaataacaacacataaaaagaaagcacacagttctttaggttataacaaacattaagagacttgaacgggccgattcgaagctcgtatgaccaagatatgatcatccgaagtttaatgctgttatatggagatttgcggattattataattaagctttgcaattataaaacatgtgtaagcgctagcctggaaaagacaggaaggctgcgccgttgacatgcggaccccacatgtcaacctaaaggaccgcggtagaccgagtacacagagacggtccacgggtcgacgaaagcagatcccgtgtgtaaccgaggcgagtggccgacaaacggactccactagacaccacacgggctgcacacgtggaaaccacgcggctaccgagcgggcacactaacacagtcaccacacgcataagcgaatg

SEQ ID NO: 6661 - DNA, 1398 bp, Oryza sativa
  unsure (1)..(1398): unsure at all n locations
nagcgtgctgaancgcccgctgacatctcctctttactcaggaattcggtacccccagacttggcccaaagggaggagggggattatttttagattttctttttattaaactttgataattgtttttgttgcttaataattatttccggtgctctgaaaattcaagtaaaatttgagggctccttttagaccaaggagaatttaacaaaaattctccgggccacattcgaatttttcttgtacgcattttagtgcttgccaatttcttttcgaattttaattaattctattattccttttagggaatgatttttatttcgggatgaatttatcaggacgtgacaccaacgcgggcctccccaggaccgcgttgtagggcagactgaggtccgccacatcgaagtccacccgctccgtgcggaagttggcggaaccaccgaaggtgaccgggaggtcgatatgacctagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgtgtcgcctcatgggtaggggccgcggccagaagctctcgcttcatggccttgaggctccggcgagaagcgtgagcgcacgctcccccatcgatggtggcgatggtggcctcaggctcctggaaccccaggtcatcgtcgccatcgtcgatgtcctcggcggtggccttctgcttggcctcacctcgtcggttgccggcgggagccgccggggtcttgccctcacggcgctcctgcctcttctcctcctcccacttcctggtccgctcagccaaacttttgaccgcgcggcagtccgcgaggtcgtggaggaaggtgttgtgcacggtacaccacttgccggtcgggcgctccctgctgggagcgccggcctccttctttttgtcgctcgcaggcctcccctttcggggggcccgcgaagcgccctcgacggcgaggacatgaccctcgtcgtcggaacgggccgaccccttcttcctcttcctgtcccgccgccctgaccgagcggcggacccggggggggccggagttgccacaccagaaccggaggagttccaggcccaggcctcctccttgcgagccacacggtccgcaagctcaaaaagctgcgcggtggtggggggtccgaattccctactctantctnctnggtggcancgcattacgacgttcggcgg

SEQ ID NO: 6662 - DNA, 2242 bp, Oryza sativa
  unsure (1)..(2242): unsure at all n locations
ccgggaccaaagtgacgctccggancgaggaagtgccctcctttgcgtggacggcatgactagcgtcgcgccggcgctcgatatcgaggcgggcatcgggccccccacgcacatcttcttgggtcggaggcgttgacgagggaatggcggacgaacgacgggtaacggccgccgcttgccgcgccctccgcctngacgacatgaagccggcggcgggcagcgctagaggcctcgatggcgaaggaccgcccgccggcgcctaggcgctgctgcgccgtcatgaccaagtcggccaagtcatccagccaacgtcgggctggagtctctggatcggggacgacgggcgggtgacgcaggagcgcgcctgcagcctggagcgcgccctggggcgtgccgccatcgccgtagacgaggcggcgacgcgccccatctcgccgtcctcccccgtcgcccgcgggcggcgaagtcgcggatcctccgacctccccgagcgcctccccccgcccaagatttcggcgagagggggacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttagaaagacacgcgcacccctacctggcgcgccagatgacggagcgtggggctcctcaccgggagaccgcgcaggcccccctttgccggttcggccgggggcgctaagtgaggttcctcgccctccatctgaggaacgtcagcgagagaagaagtgcacaagacacgggcgacgtagacaggttcgggccgctgagaagcgtaacaccctactcctgtgttctggtggatctgtgtgtgaaggaataccgagagccggagagcgagagagagttcagactctagaacccccccttcctcccttttttcttttcttccctttttttcccccttttttttcctcctttttttttctctccctcctaggcctgggcctcctttttatctggtcaggggtcaccacaagggcctctagctgcctaagaagggaaacatgctttttacaatgagggctagtctacagccggaagtgacctctgacaagcagagcccacgcctcctgccccgctcgcccgcttttccggtggacgcccatttcaaccttcatttaatggccagcgacttccttgccatacttgcgctgaagcctggaatggatctgaccgggactgacataccaactccaggagttagcacaccggctccggctagggacgagagccaggaagctctcatcattccgacgggacggggcaaggcgtgtgacaggccgcctgttgccacctaacccgcgatctgaccggtctgtgaccggtcacacaccgcgaccggtcacggaccggataagcgcgcgctgcaccgcattaaatacggcgtggcgcgctcgtccaacctgctataaatgcggttaggtgagccccgctgtgctcacctaacccacacacgtggcgccaaaaccacagggggtcggggtgccccagccctcggggcccaaacgggagcggcctgacccctcggggagacagagggaggggtggccacgtcaccctcgggcccgacccccccgagggggtcaggccacgtgggtgaccgcggctacccaagcctctagtcacgatacccccggcaccatgtcaccgacagtagcccccggcgttacggcagggcgatcgcccccctcgaggtaagcgctcgggcgtgacgccactccttaggcccggtgacaggtggggccggtccctacatttgttcctgacgcatcttcactttgtacaagttggccaaaagaaatagncaacataagaagatcttttacaattgaatggtggataatttaaggaattgtgaagtaatatttttttagtcagagattgtgctccatttcttttgacaaatttaattgggaatttgggattgctctttattttttatcgaaaatattacttgtttcttcagtcacaagataaacaaaaacttatgacaaatgatttggaatagtaaaaaaccccaaatatcagacaacttcactaacaccacatatatagtactgaaagaaaatgttggaatctcacgcaggcctcaattgaannnnnnnnnnnnnnnnnnnnnnnnnnnnnnnnnnnnnnngcgagagcgn

SEQ ID NO: 6663 - DNA, 733 bp, Oryza sativa
  unsure (1)..(733): unsure at all n locations
agtgtggnnnagtggatcatnnnnnnnnnnnnnnnnnnnnnnnnnnnnnnnnnnnnnnnnnnnnnnnnnnnnnnnnnnnnnntggcgcccccaatcgtcgggaacggacgcgtctttcccggccgccttccatggccgccggccgggtttcccgtcgccgttccgccctctcccatgcccggcttgcttccctccgctataaaatggaaccccctctttgcgttctctcgttttagccccttcccgagctcccccgtggccacaccacctttccccgccttttccttctctctctccggggccggccgggctccagccggcttttccttctcgtccgagcgcccttcggctgtgccgtcgcctcctccagcgtcgcaacccgcttcttttcaccgggcttgccttccgttcgcgcggggacatatgacatgcacaacgctgatggagtagaaaaggatgagcatacacacaaaataaagggtgcaatatttcaatagctctagaattagcagatgcttatctagggggacagcaaatattttatcagcaagataaattcattaattactttcctaattctttcagctatggtttcttctgtatgtgaaacatttattaacctaaagccctaaactcttttttgtaattggccatcttcatcaccaaatgaacaactacgcttaggaaattctctctagctctactacttcatatatcttgagtaacacaaacn

SEQ ID NO: 6664 - DNA, 845 bp, Oryza sativa
  unsure (1)..(845): unsure at all n locations
cgctactgagacctgatggtccnnnnnnnnnnnnnnnnnnnnnnnnnnnnnnnnnnnnnnnnnnnnnnnnnnnnnncgcccccaatcgtcgggaacggacgcgtctttcccggccgccttccatggccgccggccgtgtttcccgtcgccgttccgccctctcccatgcccggcttgcttccctccgctataaaatggaaccccctctttgcgttctctcgttttagccccttcccgagctcccccgtggccacaccacctctccccgccttctccttctctctctccggggccggccggcctccagccgcctttccctcctcgcccgagcgccgtccggctgtgccgtcgcctcctccagcgtcgcagccgcctcctctccaccggcctgccctccgtttcgcgcggtgaccgccggaggcgcgttcccgccgtcgtccagtggcgttgccgccactgtaccacctccagccgcccctgccacgctgctcaggtgcgggctggccgcgccgtctcctccttcgtcgttgccgcgtcgacctccactccggcctgctctctgattcgtccggagaccgccgtcgccgcgccggcctctccatcctcttcgtcgccggcgtcctttcggccgccccttcctcctccccggctcgtcggcttgctgcaccaccaccacccccggcattgcagcgacaaggtcgccctcgccctcgccctcgcctcccctccacccgaatgccgccggtgtccgtcgtcgtcttcaccgctcattctcgcccgctcgtcgtctcgcggcgccgcctccatcgtcggcatcgcagcggcgtggtccgcgccgtcctcgt

SEQ ID NO: 6665 - DNA, 829 bp, Oryza sativa
  unsure (1)..(829): unsure at all n locations
ttggaatccatgggcttaaagggtaaagaaagagttagataaaaaggnagatagaacctgcttttttaatagtcccaatataaaattagctcccattagcatccctgaagggactgatgtttaaggggggctaattcacctttagccccaaattagcccacatatttaattcttgggggctaattcaaggctaaaaggtgagagataataattagtccatagaatcaatcagggccttgtttttttgtgcttcacatcagtgatcgaaggcaatagttttttttggaactcaccataaaccggttcaattcctggctctgcttaattcgaaaagttttcgctcgaattccactgcacctaggccctgtttggaagattagcccagggctaattttgagagctaatatttagtcatgaattggtaggctaaacattagcctagggtggtatgtttggatccatgggctaattcaaggctaaaaggtagagagagagtagaaagagatgagagagagctgttttttttatagtccccatacaaaattagccccattagtaccccttggaggggctaatgttttgagggggctaattcatattagctcaaaattagcccacctgtttggatccttgagggctaaacattagcccatggaaccaaataaggctctaattactccctctatttcatactaagtttatttctttttctctcccgcttatccaaataagttcatttctaaataatcattacctctatatatatgtatgtggctaggatcattaacatttatataaatgtggacaatgctagaaaattttacattat

SEQ ID NO: 6666 - DNA, 766 bp, Oryza sativa
  unsure (1)..(766): unsure at all n locations
cgccgggaatagaatacttttctgcatgcccgcaggtcgactctagaggatcccctcaaaggattggagttttccaaatcctatacaatttctatggaatagctcattgtatttaggttttggaggagatttagcaaaaggttcgatctcttggaaaaaaaatgctataactatatctttctcatccgattcatacgtttttcatgcggtctaatcaaacgattattcgtgcgtattctctgctttacatttagtcagaatcgtgtgtttttttatttctccaacccgtccatcgtgcgcccctccaacgtcgccggcgccggcggccgatcctgcatgtctcctccgcccgtgccgtgcccgcgcgcgtgcgccttgctcggcctcgctatccatctgggcgcgcgcgtctcctgccacttcacgcaacgggtggatggttttggagttttggccggtgcgaccaccaccaccaccactcctcgtagtgcgcctagcgccgagcggaggaggcgacgactagcctaaacaacaataaagaaaaatcgcgtgtggcctagcagctgcacacctgtagctctagtggagtangcccacaacagggatagagagagagacctgccccttatgcaagcattcaaatcaacctgtacaacctacgagggggggggtccaggatggccggacaaaaccacccccccctggccgggtttttggaggggccacgccccaatttctgccactttccataaagagtttttttttt

SEQ ID NO: 6667 - DNA, 929 bp, Oryza sativa
  unsure (1)..(929): unsure at all n locations
ggcctgggatgatttgtanatcnnnnnnnnnnnnnnnnnnnnnnnnnnnnnnnnnnnnnnnnntggattatatgagcaattaatcaacgcaaaccctagataatagattctacgtatataaaatcatacagaaactgaactgattattcctattaaaatccctgcgttaatttaaatagacctgattaattagctattgtagtacatatatgcacatggtccagtgaaaattatccacgtcttgttgtgttctatacttgattctcttgtctatatatgtttggtttgcgaaaacgaaaattcagacatttcaaaaacagttccagagaaagagacttgtatggacacgaacatgcagagaggtgttatctgcatatatatatatatatatatatatatgcatgcagctgggaataatccatcacaccgtgcaatcattcacacacactgtttacactacttgaaaatctattttcgcagacggacggcaaacttcaccctggtttgtatttttgtaggcggctatttgactctaagggctatatccgtctgcgaaaataaatacccaaagtaggtgaaaatgctttttctattagtgttatctgcctgcctggatattcaagattccccgtcctgttgatgagtatgcatatgcgtgtttggttgtacatgtacttgcatttgcatatgaactcaaagaaagaaataacagtgaagaagtttgtgacagcgatttgccgtgaagctagccccgtcgactgaatatcccctacgaggtgtagagttaagctttcatcccttgcacgaaattggtcaagaaagttttggaactggagataagttatcatgcaactaggctaataannnnnnnnnnnnnnnnnnnnnnnnnnnnnnnnnnnnnnnnngttctncatttttcaaagncccgc

SEQ ID NO: 6668 - DNA, 770 bp, Oryza sativa
  unsure (1)..(770): unsure at all n locations
agtggcattgactgacatcgtatagcnnnnnnnnnnnnnnnnnnnnnnnnnnnnnnnnnacttatttaccttaacttaggttgcagctcagacagcccgagaatacaaccgacgacacggacgaggcgaacaccaacagcgagcagcagcggaaccaacggtctaatacccaacaccacaggcgacggctgggaaccaggacgaaaccctaatcttcacttcactttatcttctcttcagggcggaggaactatatatatatatttatatagagcaagggtgagtactttcgtactcagcaagtcacgggaacttaggtgtttaatgcaagcttggaagagaggcaaggttgttttgcaaatcttttatttgaagacattttgaaaacactaagtgatttatttctttctaagttagggccgaaaagagacttgcgtctcgattcgactttaagagatgtttttcaacagctcatttggcaatgtaccgacctcccgggtcagatcattacttttcggctcccagagccattccacttgattaatcggctcccagagcctttttcattttctcgggactccagagtccagctacccagcaagacaacaatcccgttccactcggggaagctagtctatgatgcccggagacatcccgaatacacagattcgtttttgacactcaggtcggcatctgccacaaggctgattttgttacgattccacaccacaacacttttcacaaagacaggcaaacaaatttccccacgg

SEQ ID NO: 6669 - DNA, 1226 bp, Oryza sativa
  unsure (1)..(1226): unsure at all n locations
agactgtnaagggttgaacatcnnnnnnnnnnnnnnnnnnnnnnnnnnnnnnnnnnnnnnnnntcatagaactttcatatcacaccgtatgagatttggttcatacacacattgaacttccgagtcatgaaacatatgaggtgttaggagaaaaatcctctgacaaaactttccaaatgacatggtcactgatatgtggatccgtcgatggtgggatccatatgtcagcgatcatgttcctctaactttacgtcggaggatcctaatccaaagtgttattaattagatatagaaaggtattttgattagcttagctggtttcctcgttaattagctatatatttacatggagccaaaacttacctcttaatcaattgcttaaatttaatcatgcccccttaactctatattagtaagacaactaaaggagagagctgtaaaacagctcaagagccaaacagctagtactactgtactagctaggtcggcacatcacaggcagggagcaggaaagagataaggagaggcaggttcagagtcatccacggtggagtcgattgagctgatcatacacagcttcacaacaaagctgctaacgtcaacgcatgtcgctgtatgagagagctatagcttgctgcatgcctagctgatgctgtccctcagagaaatcgacattgatgggtgtgtataattcgcgctaaaattagaagtttggttgaaattgaaatgatatgatggaaaagttagaagtttgtgtgcgtaggaaagttttgatgtgatgaaaaaactgtaaatttaaagaaaaagtttggaactaaacaagggcatcgtctgagtctgaatttctgttcgtgtcttcatctcaagaaaatacttctcaatatactccggccgtacactcgtcgtagtaccactatacgttcaatgcgaggtagaaagatgcaggttcaaattgttgttgctaccgactaattaatctgttcatctgaatctgaatttttgtcatattttgggcccttccagtttcaaatatatatcgatcgggcagtggttttaactgaactaatgtacttacgaggatgatcaaaacaaaattaatgatctaaaagctgaaatgcatgagaacctaattgtgaggctcctagttacacgacaaatcagaatctgatgtagtgaatatttttctccaagggtaccgagctggaatatcaattcaaagggcccat

SEQ ID NO: 6670 - DNA, 1796 bp, Oryza sativa
  unsure (1)..(1796): unsure at all n locations
nccatgttaactgaanactgatttgcaacctccnacccggcgatctcttagagtctacctggaatcaacaactgaaattctagctcatctctaatgactattaattacttacaagcttcaaggttttattttatacggactaaaagggatcttgtccatggaaattacaaatgccatgctctgggtaaactactctgttacaaagacgtattgtccttgttagtgccacctatatgcaacgataaatacctggcatatgctgaaggagaaaatacctattaaaactccattcggcactcatacttatcatacggtgtgaatggctaaataatgcgggccttttctttattactccacctaacaaacatatgatgtactgaacagctactcatgcatacaacgccagggttaacctaaacacgactgagcaaacatacctctactaattggaatatcactcaatactggcaagctacagaaagaaccggctgttaatttgatgggttggattatcatgaccctagattatgttgagtagtccatgctaatatataaatcagctaattggaaatactatgtcgctgtttgggggagcttgtcccagctgtagcttttcccaaaagctgcttctgctagaaactgcccctaacagtccacagcttttgagaatatgtagttaaagattctgaaaaataaactaagaagccagaagctgggtttcagagcttttccagattcttagaagctggctaccaaacagctacttttcagaatctaaagctccccaaacaggccctatgttttctagcttgagccaactcgatctggctcacgagcctcttcacttgaacagttgcgaaacagacaagcaatgatagacattggagagattgaagcataggtggaggccaagtctagcgcaccacgccccttacccaggcattcgaacttgtgactcataagttgtaaactacacctgcgaggacaagctggcaaggagcggcgacgttatttccaatttcaattgagggggaagcgactagttggttgcgttgtcagcgtaggcgtaagtcaatattgtgtaatcgtacaaatgtggctcccttctacgctattttctgtgtgcatgacttggcggtgtagcatgagtatgcactcctgttgcgctgtcatctgccccaaaagaatagagagaattagggtttttactagtgcttatctttgagctagacaaataaaccaaactataataggctggctagcgcgagctaccgaataactcatgagctagctcgaacccagctcattctagaaatgaggttcggaggaggctttggctctgctcgtttggctatcgatcgagccaaaccaaaccaatataagcctgagtgttttttcctacccctacaaaggtttaaactcttaccataagcacagttgaaggctatcacaaaatacaagtttggtaactagtactccatttcaaaaaatagatttattctcttttcttttcgaatataagttgaatgaaattacgtggtttctttgaaacgtcagaaatcagtttaaataactctttacagcgtcgatcgctctgtccagctaccatttcacaatttttatgggataatagcagcatgaccggtagacacatgcacatatcacgatgatatcatatcttttttcaacgaccaaaatgaattttggtcggtataacgtggttgcacgcatatgnnnnnnnnnnnnnnnnnnnnnnnnnnnnnnnnnnnnnnnnnataatatgaataataaaccgc

SEQ ID NO: 6671 - DNA, 30623 bp, Oryza sativa
  unsure (1)..(30623): unsure at all n locations
cggcccannnnnnnnnnnnnnnnnnnnnnnnnnnnnnnnnnnnnnnnnnnnnnnnntgaccatggaaattacaaatgccatgcttgggggagtttactttcttacaaagagtttgttcttttttttgtcactttggtaacgatagctttatggatttgtttgttgttgagttggattatgaaaactttgtttggtgcaactacttattatacgggtgtctggttgaataatgttttttttccttttctttttaacctaagaaacatatgtttgagagagcaactacacttgcatacaaatttgtgtctaaccttaattagactgagcatttatacctatactaattggtcactctaaggatactcacaagctacagaaagaaccggctgttaatttgatgggttggattatcatgaccctagattatgttgagtagtccatgctaatatataaatcagctaattggaaatactatgtcgctgtttgggggagcttgtcccagctgtagcttttcccaaaagctgcttctgctagaaactgcccctaacagtccacagcttttgagaatatgtagttaaagattctgaaaaataaactaagaagccagaagctgggtttcagagcttttccagattcttagaagctggctaccaaacagctacttttcagaatctaaagctccccaaacaggccctatgttttctagcttgagccaactcgatctggctcacgagcctcttcacttgaacagttgcgaaacagacaagcaatgatagacattggagagattgaagcataggtggaggccaagtctagcgcaccacgccccttacccaggcattcgaacttgtgactcataggttgtaaactacacctgcgaggacaagctggcaaggagcggcgacgttatttccaatttcaattgagggggaagcgactagttggttgcgttgtcagcgtaggcgtaagtcaatattgtgtaatcgtacaaatgtggctcccttctacgctattttctgtgtgcatgacttggcggtgtagcatgagtatgcactcctgttgcgctgtcatctgccccaaaagaatagagagaattagggtttttactagtgcttatctttgagctagacaaataaaccaactatatatagcttgctaggcgcaagctccggaatacttcatgagcaagctcgaaccaagctcattctagaaataaggttcgaagaagctttgggctctgctcgtttggctatcgatcgagccaaaccaaaccaatataagcctgagtgttttttcctacccctacaaaggtttaacttcttaccataagcacagttgaaggctatcacaaaatacaagtttggtaactagtactccatttcaaaaaatagatttattctcttttcttttcgaatataagttgaatgaaattacgtggtttctttgaaacgtcagaaatcagtttaaataactctttacagcgtcgatcgctctgtccagctaccatttcacaatttttatgggataatagcagcatgaccggtagacacatgcacatatcacgatgatatcatatcttttttcaacgaccaaaatgaattttggtcggtataacgtggttgcacgcatatggttagttgcaggcattaacgaacgtgctccgagacaatagatactacaaaatgattgattccaatgatcatggatatgatcgaggtaattaaacatgtactccctccgtttcaaaatgtttgacactgttaactttttagcacatatttgaccgttcgtcttattcaaaaacttttgtgaaatatgtaaaattatatgcctacataaaaatatatttaacaatgaatcaaatgataggaaaagaattaataattacttaaattttataaataagacaaacgattaaatatatgctaaaaaatcaacggcgttaaacattttaaaacggagggagtacatctatgtattcgtggatgcaactatgaaaggcatgctcgactgtgaccgtgtcggcgagccacgtagtcctccgtatccatttgtcgtatgcttcctgtatttgtactgttatttctcgctccataatgcatttgacacgtattttatttttcttgcgtacgggctcggtgctcacgaaataaaagcgacggaaatactattgcagtttggtttctagctggcttatctgcccgtgacttccgtctcctaatccaacccaacgtcatagagtagaatatgaagataatggatttctatacatcactggagtagaaaaaaaaagagatgaaaaaagagaagcgaactgagtaactaataagctggtaaggctccttgcactgaaacctaatcgcccatatttaaatatcagatttaacagatgtgtttgtatttataaataattatattttttcattggtagtcgacaatgtagttttcagtggtgtatttggagaagtattcatcgatacatactccctttgtttcgtattataatacatattttctaaataaactttttttgaaacatttttttctaaataaacttatttaaatgtgatcagttttttagaaatttttttttataatatgaaacatagtatattccataaatcgataagctaaaaagaacactcccagttctccataagtactcatatgcatcttccattaaagtaacgacaagtgtcctcttttaaaccttatacgaaaccaaaccaaatatcgcgtttggccatcattggtatttatggtgaagttgtcgctaatcagatcactgttagcgagtctctgcaaggaaaacgatacatttcttcttctcgcgtttttctttaagcattttggcttgtccatggtgctataagtggtacacattagcaatgatgtggtgtgcagggaaggggatggggcaatgactagggagtgtgtcatgaagataacggtggtgtgacacgaaaaataattgtattatagggctgctgtatgacacgcagtggaaagaaccgagagattcgaaaaataccatgatatttataaggggtagaaatcatattctcctaaaccttccatttttatattatcacagcgaccatattaatatttttttaccagctcaattactagaaacttttatcttttttttttgcaaaacagggcagctcatattaaattataaaagagattacaactctttttgttgcaatatctggaaataaaagaactaccaacacagaacaaggaggctccacatattgaaataccgcaagagatatgagcaaatgagtgtagccacaatgctgacattgtaacacacgcaaaaacatgtaaaatgaatattgctcaccatattcatatatccttcgacaaaagagcaaaccaataccaccgaacaagtcgacaatttggaacctaaaactaacgccaacaatgtaatatttgatgaccgacaggcaagtctccttgatttccatcgaggacctcacgaatgaagtagccagcaacacatagattaaaaaagacaagaaaaaatctaaatagatttaattccatgaaaaacatgaaaggcaaaccttagacaccaaatagttccaacctacattgaaaaaaactcaaaaaacttacgagaagctgtccccttcctcatcgtatccggcgaggacagaggagaggggaggggtaatatgtgtccaataataaaactgatttttttttaataaatcggtcgtaactcgtaacggtagagaccacggtaagaatgttagggcagtactgtcacgtacgttagctacctatatgagcgagaggagggatatatacacgtgttaacaatccaagcacggtgggtgttgagatccgacggtttacgaaaaccgaccgactttctgcaagcgatggttgacttgtacatagtaatgattggcaggtaatgacgtactgcactgtacgagagtgtacctccccaacatgccataaccgccctgccaagatgcgatttgacaataggaattctcgtttaccgaggcttaatctccattcctccacgattcgctccagcgccatgtgactagaccgagctagctcgctcgatcgatctctcacatacacacggcacgcacgtcgggtgcaacgacttatcggtgccaagttgccgatcgatccggtttttttcgtttttgccagttagcctaattctgcctataaatacacgggcaaatctcctctcgccaaaacacaaagcagacaaggtagtagtacaggcttttgtacgtacgtagcagagggagttcccaagatggctggggcctctgccaaggtcgtcgcgatgctgctctccgtgctcgccacgtacggcttcgccgccggcgtcgtctacaccaacgactggctcccggccaaggccacctggtacggccagcccaacggcgccggacccgacgacaacggtgcgtgtagtacatgcattttttgcaaattacgctgtcgtacgtatgtgctcttctgacattcgaatgctgacacgcattggcattgttcgatcgatacgcaggcggtgcgtgcgggttcaagaacaccaaccagtacccgttcatgtccatgacctcctgcggcaacgagcctctgttccaggacggcaagggctgtggcgcctgctaccaggtatagtataaccacgttcgtgatcacatatgttgttttggcttatcgacacggtctccaataaatagtacatctcaacattaacctttgtaccctacatctgaaaagtgtacaaaacagtgggtatggaacttctgatcataaataaatccgtaccaacataattttgtttacgagcaccgtactgcccgccacgttaactgcagttggtggtaatcacaacttgattggtcaacgggccttgaaatccgtgggtaacacgttcttcagttcagcgtttgactttgtgctagctgctgcttaattacatgcacatatggattaattttgcccttaattatattcctcatcatcagatacggtgcaccaacaacccgtcgtgctccgggcagcccaggacggtgatcatcacggacatgaactactaccccgtggccaggtaccacttcgacctgagcggcacggcgttcggcgccatggcgaggccggggctgaacgaccagctccgccacgccggcatcatcgacatccagttcaggcgcgtcccgtgctaccaccgcggcctctacgtgaacttccacgtcgaggccgggtccaacccggtgtacctcgccgtgctggtggagttcgccaacaaggacggcacggtggtgcagctcgacgtcatggagtcgctccccagcggcaagccgacgcgggtctggacgcccatgcgccgctcctggggatccatctggcgcctcgacgccaaccaccgcctccagggccccttctccctccgcatggtcagcgagtccggccagaccgtcatcgcccaccaggtcatcccggccaactggagggccaacaccaactacggctccaaagtccagttccgttgatccatcgatcgatctacctatgtgcatgcaatgccttcgtcgtcttgtgtcgccggtcaagaacgaattttgattctaccgatcggcagttcggcactagtactgtactacgattctgtgtgtgtgtgtgtgtgtgtgtgattgcaatgcaaattgcgaacggatcaattaagagcgtttttttctctctctctttttaatttgtagttgtgtgtgtcagcgagatgtgtgggaaatggaacaggggcagggcacgcagtatccatgtgcttgctctgaaccgcccacattgacaaatgacccaatgccaatatgccatatatatataccggattggcagacttattgtattgtgaccaaaaccaagtttgtaattgaactgaattaatacggtgtgtttgcttatcagatcacagagtagtacaatatcacaccattagcagcagcagcagcatgggttgctcagtacacgcgagccgtactacggcggatgcacgtgaggtgccccgggcgcgtacgcacaacaaaaacgtccgtcatgtgtggtcgaggttcattacactgtcttgcgtgaagccatgtaccgtaagctggaagcagcacggttgcagcggccatggtgcatgttcttgcgtgtgagcgcgcggttttgtgtggtgtaagtttgtaatgatggggtagggcatgttctaactgaagttgacttaattttattatccaaagacaaattaattaaatcacagtctgcattccgtatcagccaattctttgtctaagggtctgtttggtaaaactctagcttcagcttcacctctcctaatgctggagctcagccaaacaatttcatctctgcctaaaataagagcgaagttgggtgaagcactctcataaaatgaaccagagaggtggagctgtgtataggctgctccacaacttcacttcagacttaactcctgaaactaaatttaagagttggagctctaccaaacatgccctaagttccattctttgattagaagcagtaaaactagatgatagttgagaaaaaaaaaggggaacttatatcaagtaaagagagtacaaaataggtaggagttggcaaagtaccaatactatggagacatagtcgtgctcacaccctcaactccgctttcaaaaggacttttataagagtagggagttgccgttggtctattcatttctttcaacatgtattagaggacgcacccacagctgtgtaagtaaagtaagatacaagcatacctgaaggttcaaaaaaaaatcctatatacaaagtatcaataaaacttgatccacctcactaccaatggtggagctaaggcccagccgaacggagctcctctgacgtaaagtcatagagacgtgggtccctgacaggtgatgtcctaacaaatttcagcaaaaatttgaagctgtatagtgtgaacttgagttttaaaaacatgagtccagagttttacttatgtccaatgggtatggccgtatgggaaacttaagggctcctttgaaacatataattttgaaatagaggaatacatgaaaaatacaagaataggacagaaatgcacgtgtaaaatagatgattcaaaaacatataaattctaggaaaatagatgtttggatgaggtaaaggacaaaatggagaaaaattcagaaaattatggacccactataatagcttgctctgttatcttttgaataatcacttttttctttaaggttcctttatggattgatttgtccataatgttttaaattaaaattctcatggctttgattttggaacacaaatttcgtgttaaaaatgtatttttgccaaataaaaaggagtgtaacctaattcaactcgctacatcatgagtacgtaggtttcaccccagaacaatatcatgtatttagattttattggtcttgcttgttgcacaggcctaatccgagctacaacttaatatttagattgtggttctaaaattccttgagaatttacggtacatctgacactgggtatagctaatcagtagatagtgcagatagtgttagagcattcatataaaccccatgagtattaattaaggtgagttcacacactatgcataaatataatagagatttgtgtagtgtatagaacacacctaactctataataggatcaacacccatcaggggcggatccaagaagaatagtagtaatgtctgaacaaactagaacaaagctacaacagtccgctctcctatctacgtatgaaaaaaaaacatgtgggggcttcatgggggctcaagccctagatccgcctctcacacccatggaaattaaagtggatttcttcatgaatactactcactccatctcaaaatataacaacttttagcctttaggatttgtcccaaaatataacaacttattcaccaacattccattctcaaccaattacaacccttcaccattcaattttcccacaaaccttcacttatcaaccaatcataatattctataatttctttttacctactttattaataaccatgtctaactctaaaactctttatattctgggacggacatagtaatctttatttaaagtacctggtattaagggaagaacccctttgctatgcttggtgtttaagacccgtgtttgcagtatagagcctttgctatgataaaaaaaaaattctcttgatgcctcttctagttttttacacattgcctttgtacatgtttagtactgctccctcaatttcaaattgatctacatatagtttttttttgaggttattcctaaatgatttacatatttgtgttcatttattaggtctattcgttatttgtgcctgggaataaatggacattgatgcatgcatccatgcgtacacaagcatttataacccacatgcaatatcttgatttgctattggctaggaaataatggggatgatgtatgcattgagtttgttgctagagtaaatatagtatgagagagttattagcttttcttgatcttggtgtacccatgaaatatatagatcaatttgaaattgagggagtaagggcacccgcaatggttatctataggctctctataagagatccatgtcagcatattttcctacttggaatagattaaatgaagagagagagagcaaagctatctactaacctggagataatctatagagaaaaacgagacaatgcatgagagagctatagatacccatgtagacatactattgaggtggtttactattaatctagtctattgctgagatgtacatgttttatagagaacaccttactttaccattgcgggtgctctaattcactattcacagttactaatggatgtgtcagtgtatatactactatataaccagactcaccagccagagcccaaagcaccgtatctcgatacggtgcatatgtcaatgattgtatcactgtgtggatgtgatcggtatatcctcgcatcattttttttacttaagagcacctgtaatggtaaagtaaggtgttatctataaaacatgtacatctcagcaataaattagattaatattaaaccacttcaatggtatgtctacatgggaatctatagctctctaatctattgtctcgtttttctctataaactatcttcaggttagtagatagctttgctctctctctcttcatttaatcacttccaagtagaaaaatatgctgacatggatctcttgtaaagagcttataaataatcattgcgggtgcccttaaaacaccggtgggaagtcagcaaagtcgtgcttggcatgtgtcctgaatcttagtgagatgccttctttccattcactttttgcagggtatcctgtaagttgtaactaccatatatatccacatttttgtaagggacaaaaatacggctagtatgcaactatgctgtctatgcacatatgtatcacactaccgtgtcactctgtcaatacaatattagagttggcgattatatttaggacggtcactaggtggtttcacactacctacgcgttagttacgcacaatggtgatactacaatgatatggtcaccctagaagagcgttgggtacaaatgattgcttcaaatgataccgagattattgtccctaatcaacctgcccctgctgattgatctctctctgtgattgcgtggttatttctggtgccttattatggaatctcttccgttccccgaaacaacgtcaatgacccatcatgcaatcgatctgtgcatgcatcgatctaaatctgaaacgagaaactatatacatattctggaatataatcgatcattcatcttccttaccacaaaaaaaaaattcatacgatcgatcatttggcaggtacgtatcgtccacaatatcataacatgggataactgccaaagatgtgattttataatggtacgaactcgtgaaccgaaccctccatccgtccatgattttctccctagccatgtgacacagctagctctctctctaccacgccggccggtggccacgtcgggtgcaacgaccccttgatgccgccgtgttgctcgtccattacatttggttcccttcccctctcgttttgccctgcctataaatacaccggcaatggcctccgattccaaccatcaaaccacacaccagacaatacttactaccactactactgctgctgctgccagttctagctagcctactgctcttctccgagctgaagatttttcgagctagctaggatggcagccagaatgggcagcaaggtcgctgcaatcctcgcgattctgtccgtgctcgtggtgcatggctcttgcaaggggcatcctgtgaactacaacgtctccgacgcctccgcctacggctccggctggctccctgcccgggcaacctggtatggcgctcccaccggcgccggccctgacgacaacggtgcgcattttgcagctactgatgatgcttgtggtgctcatctgtgcttttgcttggtctctgaactgacgcattggcattatttggtcggttttaatttgcaggcggcgcttgcgggttcaagaacgtgaaccagtacccattctcgtccatgacctcctgcggcaacgagcccatcttcaaggacggcaagggctgcggctcatgctaccaggtacgaaaaaactagtcaaattacttcaccatggcaccaattttgcaattagcaatcatttgatttgattggtcaggacgtactactactacatttttctatagcatgcatgtaggagtaacatgcagtgcggcacattttgttgaccatttgtttgacttggttgttacagatcaggtgcaacaaggacccgtcgtgctcgggcaacatcgagacggtgatcatcaccgacatgaactactaccccgtggccaggtaccacttcgacctgagcggcacggcgttcggcgccatggccaagccggggctcaacgacaagctccgccactcgggcatcatcgacatccagttcaggcgcgtcccctgcaactacccgggcctcaagatcaacttccacgtcgaggagggctccaacccggtgtacttcgccgtgctcgtcgagtacgaggacctcgacggcgacgtcgtgcaggtcgacctcatggagtccaagtcggcgtacggcggcgccaccggcgtctggacgccgatgagggagtcgtggggctccatctggcgcctcgactccaaccaccgcctccaggcgcccttctccctccgcatccgcagcgactccggcaagacgctcgtcgccaacaacgtcatcccggcgaactggtcccccaactccaactaccgctccatcgtccagttcagctagatcaatcatccactgctgatcgaatatggaatcatattggctcgcgatcgatcgatcgatcgattagtttattctctactactgctgctgcaaaatttgcgtgggattgaggtgtttttttttattaggcgaggcctcatgtgctgtctggtctagtgtgtgaagtggtgaagtgatgcatgtgtgggaaaatggaggaggggcacagtaatacagtatgtgcatgtgctctcccgcccactgtcactgtactacccagtgctttgtaaccaaatcttaaggctacagaattataaatacaatgcttaagttaattacctaatcatgtgcttcctggtggctctctctgatagattctctgatttaatctcgtgttcgggttggttaagtagtacgtgtccatgttctttcgtggtactcacatacatatcaaattgatttgggaatcaacaatgtatggatataccggaggagcagatctctgaaaaatatgccattctctaatacctggagaactgtactgcagaataccattacgctcccagtttgaggtgactttaggctcccagcaaaccaaactaaaatctgccatatattgtcaaagtctatatatatatatggaacgaagcgaattgggcgtacctcagataagaacttccatcaattgtaagatatgttttttttttgagaattaattgtaagatatgttgatttggtcttttcaaataggatgtgcttgtgtgcgtatatgaatgtttgctttgtactatgtgttttggaaaaaaaaaaaggctaaaaactggtaacaattttcagactgatattattactacacattgcccccagcttaactttagattccattggatttaccaaattttcaatttcattaggaaatggttaccgaattttcatgtactgattataaaccaaacagtcagttttggtcagcattaccaatagataggtttaatgaggctaacaaacccacactagcaactgggaattaaatttagaggttgagtcagggattggtactttattagtacaaatagatcaagaaaaaaaaagggaaaaagtgcaggcagatctcaagctgacttggaatataccatttttcagaactgtactgcttgctaggccgcagcagagcgaaaagcttaactttatctttctctagttttggcaatcctggaaaggttcagcataattgttatcgcgaggtgcaaatcaagtatactcaattacggtgatcactgcgctgattgaacccaaatgatacaaatccccagcattctggtatactatcagtccaagatatcgttatcatggtcgttggtagcttcagttaagttatgtgagctaggctcggcaacgacgccggcttcaaaattacctgccgaccaactgcattctcgccggaattactggcgttaaaccatcgctcttatatttgcaaagctgactcttgactacaattaaggttaacttcagtgtctgcacgcctatcgaacttagatgcgactggcttgaggtcataaatgggagtactaaccgtgatgcacgctgaagaacttgtctcttttctactgtaataaacacttgtcaacgatgaatcggtcatcgagaaatggagaaagttagccccattccgtgaagcttgattctttctgcagctctggatgcgtgccagcagagaaacatgactggtcattccatagctcaagcctgcaaaggatttaggctttgtttgaaagattagcctaatgtttagtcttaaattgataagctaaatattagtctagagtgacatgtttgaatccatggactaaaaggtgaagagagagtagatagagagggagatagagctgctttttgatagtcccaatataaaattagctccattagcatcccttgaagggactgatgttttaaggggggctaattcactttagccccaaattagcccacatatttaattcttgggggctaattcaaggctaaaaggtgagagataataattagtccatagaatcaatcagggccttgtttttttgtgcttcacatcagtgatcgaaggcaatagttttttttggaactcaccataaaccggttcaattcctggctctgcttaattcgaaaagttttcgctcgaattccactgcacctaggccctgtttggaagattagcccagggctaattttgagagctaatatttagtcatgaattggtaggctaaacattagcctagggtggtatgtttggatccatgggctaattcaaggctaaaaggtagagagagagtagaaagagatgagagagagctgttttttttatagtccccatacaaaattagccccattagtaccccttggaggggctaatgttttgagggggctaattcatattagctcaaaattagcccacctgtttggatccttgagggctaaacattagcccatggaaccaaataaggctctaattactccctctatttcatactaagtttatttctttttctctcccgcttatccaaataagttcatttctaaataatcattactcctatatatatgtatgtgtctagattcattaacatttatataaatgtggacaatgctagaaaatcttacatcatgaaacggaagaagtacatcagaatttctaaaaatatgaaataaatgtattggcagtagataaagtaaaagtattacattcgataaaaatatcgatactctagtatttttttatgttttatttgtttacgtgagatatgtgaaaaaaaagaacgatacccttgcacatctcacgttcacctgacagttacccagactgaaaaagaggacaaagtaaacaggctcgactgcgacggcgcatgtgcgggctgagacaatgtggattcacgccgacggctgctgctcaccggtgcatatatgaccgctctctctcgctcgctcgctcagattctccggttggttgtttgtttttttggctattcggcacgcaaaacggcgctgttgcagcagatttccaggacccactgcgcgctctctctcactctacccgtcctcgcgtcgccatccatccatccactgagctttcgccggccgatcccccgcctcgcgctcgtgcaccccgtctgccgccgcgccgcgccccccgcgttctcgctgcggcgcggctacggctgcacgcaaaaggaagaaagaaagagaaaaccgtgcactcctcgaccaatggctgtacagtgtgttatgatgtgtggatagtactagtaggagtagtaacaaacctgcaggttttggggcctgcttttcaggcatcggtttgttcttgttgtctggcacgctatttatccattgttatcctgcagacggaatgtttgaactttgaacttttggtatccatcctgaaatgcatgcaggtcaggctgatcggtgcagagaacacggcgagatcgattgcgagtaacttgcaacgtgatcagaatgacaggaactcagcgtagtttcatatattttgcagttgcttacaagctgaagcaagtgaacacgtgagctgccatttgcacggtggcacatacagatggtcgcgttgcttgcagaattgcagtgtggtatggtatggtatgggaggatcaggggaacaagtggtggttaccgggcggaataatgtagacgtggtctgttcggatttcagggagtccggccctgactgacccgagtgtatatcccgtgattaacgtgaccggagtgatgtgcacgtcggcctttgtcgtgacaggttcgttgaaaagaaaaaacacacgaaaattcatccggcctcacatgacaatatgccagtgatcaactgttggagacgtcactccaatttgacccggagtgaggaggattggagaggaaagcaaaataccgagacaatgaagcccacgttgagaggcagcccggtacactacgcagccacatttgacattagtagtacgttttttgttcttgtttttttggtttgttggtgtgattggcctagctttggcaaggaggcaggggcattgaaaaggtgaaagcggcaagggagcagctcagctgagctccccccatgtgcactgcctcgtccggttcctcatcacacgttgatgaatcattatgctgcctataccaagggaaggatatggaatggccaccatattaaagccacacttggattagtcggattgcgacatgtctgtggatataaccaaactatagtagcaattttgtgatagaatctacgtgattttagaagcattattttagtatatcatattattggtagaagttggggggtttgtcccatcttatcttattttaagcttttttctgtttatttttggatttttttggttgtttgcctacgggtagaggccggaaatgtaatccatttccattatttaaaaaagtagcaaaattatcaacgatggaaattggatgacgggtgggccgtccaatccagtctcggggcaaaaaactggtggacattgctggaccactaactaccgggccggtctggccgggggggccggcagggcggcggcgagtcggtttgtttcgtggaacaacgaccggttaacgatcggtaagaccgtgctccatcatttggtgtttcttcagcttggacccagatggatggatggaccgagttttcgctttctctctgtctgcgccatgagatgctgttgtgtggtcgctcgcatttggatggcccacggctggccgctggcctttgcctgtggccgtggtaacattggaggaacaagttaattgctgaaggaaaaagtccaccttttgtcccttatataagagttgagtttcaatcgagtccctcaaccagaaaaaccgggaacctcatcttataaaacggatgtaaatataatcccaagatcctacttcctccgtttcacaatgtaagtcattctagcattttccacattcatatagatgttaatgaatctagatagatatatatgtctagattcattaacatcaatatgaatatgagaaatactagaatgacttatattgtgaaacggagggagtacatgatacttatggtcaacaaaaagaaatgaaatacgatgagactcacatgtcagacacacacgaaaaaaaaatccctatccctgtgttggcaaccttttatgacaagttgacaagcacaattgcaacacctaaagctttgcggtgatcctagagttgccaaccacctcaatttagcaaacgctaaatcaagatgggttttgataaactaaaccagctagcggagccgatctagatagaatgatggataactacccgtctcgtgggaaaaatggaaggttttcaggacaaacctacaaagaggtgtcgtactctcgcagcggcggcggacgatttacagcgcaaatcgacaaagatgaacaaactaagtaaaaactaaaagcaatgtgaaaaacgattcgattgattgattgttgattgtgtcttgacaattgaaccggccttgtccgttatataggggttggtcttgccctctacaggccctcctccacgtccaactcaggatagaaaccaaaggaaacccgaaacatgacttcccaagcaaggaaaactcgaaacccgacgaaacagactcgggatcggactctgccggttagaccggctacacaccgccggtctgacagacctactggcggcggtctgaccgaccaacgcacggcggtcagaccggccatctcagaggaaaaccggcagacttccaaactttggtaattttctctattttattcctaggtgccaaatttggatgtaaacaccccatctctttctctaccagttctttagattagggctacattgtacctggttttgtaattgagagacgcggttaaatgaaaccgaacattagttgagggatgtaagtggacttttttcccattgcaaaatgaaccaacacaatagggaggagaggctagcaaacattgatgtattcgcaaaggaaaaaagttcacctaagatctcccatcttgtcacgaagttaaaaaatcgtctttgaaccgaaaatcagatatatggcatccctaaacttatataaccggatcattataggtgcttaggcagtattgaccccggttctccccgcccgttgccagccatcccgaaggcttgattgagatgggaaaagagaggatagatgtcgaagaagattgaggtgctgccatatgggtcttacgttaactcagctaccacataagacaaaaccggggttatttatggacgattttgtaacttggcaacaatacgaggaacctcaggtgaacttttttccaccacgaggtccgtgtaattctttccttcggcccacaagaatgcaggtcctgggtgggatcggaaacgcgtcatcacatcagggcgtcatcacatgttctagcccaactcgcggcgcatcacgtacacaaattgctggcttgacgaatgttgagaatcccacgtaggcccaaatacggaataagttaactttgggtccctctatttgtcacccagtctgattttcatcccttgatcacaaaaccgggtacgacaggtcccccaacttacgaaaccgtttaaataaggtccctcggtagtatttgacccggttttggttgaggtggcgcctacgtggctaatttgactcggtcttcatttgacgtggcattgacgtggtgcttatgtggcaattcgatcaaaaataataaaacctacgggacccacatgtcatcctcactaccacttctctctatccccttctctctccctcttctctctctcagcctgagcggcggggcggagcggtggcggcggggaggagtggtggcggccggagtagggtagggaagagagggccaggcacccgacggcgacggcccctacacccgcgacctccctcgccgacgcggcgatccatgggtcccccgccgccgcgtcgcagagccagagcacggtagagacgtaggcggcggggaggtggtgctcgggcgcgaggcggtagtcgagggagacgatgatggctggcacggtcgcagccatggcctcgcacgaggcgtggtagaagacattgtcagtggagaagaggacgaagctgccgccgtggaagtagagaatgatggggagcttggatgccggtggcggcggcgggacggggttggggaggtggtgagggaggcgtcgagcggcacgtcgcgggagaggaccgggccgaaggcggagggcggcgtgtcgggggacaaaggggcgcatgatggtgccgtccgagtggaagaaggggaaggggaagctcctcgctccgacgggcggccgctgacaagcttggtggcggtggaaaagagaggggcgacggtgaggttgtattctcctctctcccctccctctttctccacatccgcacactgctttgctgctgccgatggcatcgacaagcgtgagaaggcgacggtggtggaggctggttgcggcacagggcgtgcaccgctccctctccatcgcgcctgagagaggagaggggagagagatgaagaaaggggagagaggaggaaggagaggagtgaggatgacatgtgggggccatgtgggtcccaccattttttttattaatttatgtgtgaaactgacatgtggtcccacagggtttattatttttcttagatcaaattgccacgtaagcgccacgtctgtgccacgtcggatgaagaccgagtcaaattagccatgtaggcaccacgtcagccaaaactgctatcaaaaccatcgagggacctcgtttgcctggttttcgtaagttgggggacatgttgtacccggttttgtggttcagggacgaaaacgacaaatagagggacctaatgcaaacttattctcccaaatattttccggtgccttcataggctaccagaaatcccgttccggcccgaaggagtttgctatagcggatccgtgggctgaaattgttgacgtttacgcggaaatcccaagaccgccgaatctgcctttctttcttctttttcccccttcatccccaccgttcgctctgtctgtgcgccggcgagcgttgccgtgccaccacttggcatctcatatgcacatctttcccattgaaaagtgaaccccaaaatagcacaagaatagccagcgtcatcaaacacatataacccgttggatgtccatcgaaatgaaaaaagaccattggattgtatagggagaggtagtaaagagtaaacggtaatatcaaaacaagggtgctctagacccttccaatgcctcacaaaaagtgaagtgtagtaagaatgaaaaaaaaaaaaagataaacaactggcctacacccctacctcctataaatctccaaccaccaccaactcactgtctctcctccactaaaatgaattatgttcttatgcggttacgcttcaattttacacttaaatatttacaatattcatatgttacaatcacaaaatatttgaaagattcttttatttgttagggtttttattttttctcatactaatacacatatattctatcataataatattatttcttaaaaaacactaaatgttttatatgtttttcacaataaactcttaaattataaaatactattaaaagaattttcgtatatcggatcagaaccttaatttgatgtctcggacctactcggctatatcgtcatcacgttctttttttgcagcataaatcttatttatgttattgagttttccaaattttctataaattactctcgttactgatgatatagttaacatcttaaaacacatttgtataatccaacaattaacagctagcactgtctctctagtttcgtttgtaacaatgtggtaatgctagtttagctgagatgtttacttgactgcaagctgtgttgcgataaaatatcactaccattcctttgacgatacaaacctagtacaatttttaatttcaggatatggatagattttatactgtgaacttctgaacctgaaaaatttatctttacaaaatttggcattggcataattataaatttaaattaaattacagggccctgcaatgatatgttgttcgagtcaatgaaaagtgcatatataagggacagtcatctacaaatggatcagcattgaagagtgcaacggattaaacaatccatgcaatttactctcataataagcttatctaatgtatacatatccattcattaaagctattcacatgggatgactataaaacatctctctcacctgctttcttctcgattggtttgtttccttctaatggagcaaagttttctgtttgctacaagaagcacttgagctatcaattgccgttgttctgcacatgtgaaaaacacatttgttgagtcatctcataaattcaggcagcaaacaagagtcattctgacctgacatatgcagactgacacatacaagagataacaatttataattgttgccacgtttatctttacgatctgaatatgaaataatagaagattcagatgcattcttttttgaatttccagaaagtttaaaaaaataactctattcttttttttaataaactgcaagtttgtttgataagtttcatgtatgctatatacaaataatctccaatatgggatctttcatgatatccaaacctaaacaattaaaaatcagcagcctcccaattagctcctagaaaccacagttcataatagtacactgaaacaacatggaaaacgctgctctgtttttcctaaagtaattatttaataaaagcttgtactgcttcttctttaaacagtccacaataattggattgtcacatgctacagctaacaaattcaggggagaagcttcacgacagtccctggaagagaattttacggcagaaaaggaaaaagaaaatcataatttaccctgaaagcaaatgcagaaaagttattcttttaacaaggctgcttttcggcagttagtcagttactggccaagttttagttggtggaagtgcacataaagcttccaaatgcatacataggaggtgtattaatcaatgaccaactactatagctacagcctaatatatcccagaaagaacacacccaatcagccaatctcatttcaaaatgactgtaaaaattcaagcatgaagataaatgccggcagtgatctgatataaaagtctctccccttcaatttgactacacagcaaatctatttcatcagaaattagaaagaaaacccattagatttaactgagaacgagtactatgccacaaatatgcctaatacctgaacaaggacgtgagcggcgttgtgggagtggacgaccggtggatgtcaatggcgaagaaccggatctgacagcaatgtggcgactggcggtggcggtgaatcgtgtacggctgatcgagggaagttagtcggcaacgcaagtattggaaaaagggatgagcgaaacaaacatattcgggaatcaacctcgaggtcgacgatcggcgggtggcaatgggcaatcggcgggcggcgtggtcgtggtcgacggggatcgatcggccaggcggtgatggcgtggccgcggaagacgggcagcgactcgtggcggcgtcgaatcggcctatgcagtgcgaccgtgagggcggcgaggcgacagtgatctagcgagagatggaacgcgatgcgaggggatgtgttgcgggcttgcggccttgcgggggatttggcggagatcgcgttgttggaggggatggggaggaaatcgcggcaatactggcggcatggatgcgaagtgggagagaagaaggtgtgggacaagaggatctgggagggaggagaggcgcgcctccagtgccatcggatgtaaatcatcagatgactttagatcgttggatgtgtgatatgatgaatgatgaatgagtaaaactatttgttgaactataaggtagatgcagtgtcaatgttagtgacatccaacaatgactaggtttagtttgttttgtacaatactgattatacccctctatttatctataaatcttaattttcgcattttatattaccaacatatatccatgcaataggattgattatttctttgataacccgtaatccgtactatgggattagagctgtcaaaaaagcttgaggcttagcaagcagctcgagcttgactcgtcctatgcttgattcaagcttggatcgagctccaaacgagcctaacctgagcctgagaaaaaagcttgaaagctctaccgaactgaactcgagcttttaccgagcttgactgtgtgtagttcatattgtttattcacattattgatttaataaactaatagatcaatatatatattagtatctaattacacaagaaactagcatgtgttagcgtaatacatttatcttagtcattttctactctctttttttagtgtgatcaaatagaaaataattatacttctcaggatattatcattaaaataatatatattatactacttattgctgagcttgagctcgaacaagctcaaaccgagcttgaataaaagctcgaaggtacaataggctcggctcgagcttgggtagaagagtttgctcaaacttggtgatgtgaacaagaatccttctttcatatcagtattagttggctcacataattctgttattttggttggtataaattttatttatgtgaatgatggtaagggtaaaaaagttgttatgataactgttatatttatggagccaaagaagaaagaacggcctaaaattaatacaaagccgagtacggctttttatgaaagggatcataagaccatggttacgccaaatatttttactgtagctgtttcgcactgcaaagacacaaatattttgttcctttacttcctgaaaaatggaagagtaaagaatcaaaaatggtagctgatggtgtttttccacagtgccagacaaacttcgttggtgcttatcttgtggctaagaacaacattaagtttattcaggttgattatatgcatgtggagctgccaacttcacgaggaagcatgtctgctaattaatttaataaagtgacacttaaatgtcagcattaggcaaatgtgctgtaatattttattatatattttattttattagctgaattccatcttaatcggggtgtgtcccaatgtttcaccaccgtcgccgccgtcattaaatacggagtataacattggatatattttgatcagtcgagcccgacctacacgccgagttgggccgtgtccgcccacttgttgaaccattggcctaggcaatgacggcccgactcgaagacacaaaagctcagtgtgctcctagttggaaaaagtctattggctcccttatctttttggacagtcttgacatggctagaataagtttattttgtatcccttgtctatttgggttgtgtcttgaaataagtctattattcctccctcatgtcttgctcttgatctaatcgtatcctcaaccgcaaaaccaagtataacatatcccctaaattgaaaaaccgatataaattgactcctttggtagttatgaaagcggtttctgctgacgtgatacgttgacttgtccaaatatattaacgtggcagcccagtcattaaatgaattaaaaatagaagtgggtcccatgtgtaagtgaaagaggtaaaaattaaaaaatggcggcgccacttgacagccccacttcccttctcttcttcctcccttctatttctctctcgcagccgccgctgcggtgctgcgcctgcgctgaggctgattcggccgcgcacggcgactggacggtggtctctggtcacagcaatgaaatcaacggcgatgaaacaccaaacaagtaggttctgcccagaactagccactgagctggagactaccaaaatggagtgaacaagtgcgcagaatctcattacctaaacggagcagcacagtgtgccacctgaatccacagccacagccactgccactgcaatccgatcgagctgaagcagacgaagcacatggtcatggagatgccacagcaaagaagcacaaggccaccaccagctttagcatggatctaccgctccgcctccaatacccccacgagctcgccattggcgcctccccaaaaacccgctccgtttaggctgaccaggcggccggtgccgcgacgcaaagggaagttcggcttcgctcccactagccaccgtagccgcatcagatctctcgaaatccaccggcttgcctatcttagacaaaagcctccactgcatcgatcgattgggcttaatacatcaacgagaaagaacagcaacaacgtactccctctatttgccatatctttgcatcctcacctgagtcctcactcactcgtcacttcacttcactcgtgtgtagacgtgctccggatttgtctatcgttgcggggcgaggagataggagcaaaattcccgccgttgatttcatcgccgtgatcagattgagagaccaccgcccagtcgccgtgcgcgtgcgcagcgcgtcggcggcggctgagagagagaagggaggaagaagagaagatggggggggggggggggggggctgtcaagcggttcccgcattttgttacttttacccctttcacttacacgtgtgacccacttctatttttaattcatttgatgattggctaccacgtccatatttggacaagtcacaacatgctacgtcagcaaaaaccacatccaaagccaccaaaggagtttatttataccgatttttgaagttggggtatgtgttatacccggttttgtggttaggggatgcgattcgatcgaggacaagagatgagagaggcaaaatagacttattcatcgtgccttatatggtttgatcagtctactttggctcactcatccattttgcctccctgatctttggaccgtgccggaccggtccaccatgccgaggcagaggtacaaacacgacccaacaattgggctgtgtcgtaactaagccggatcaaaatctcatgccgtgagccgggctgttgggcctcgaaccttttggccaactgtagcgtggagcaagctgcagtggccaggcccctggctgcacacacagacagcatgcagcatccaacgatcgatctagctagctagcacattaacgccaattctaccgttcggccattcacgtgaagcctcatgccggcctgtatatagatatgcatccatccatgcatgcatcaatggttgctaccctgttcagctcatgcatgcatgcaatggtccatttggccttgtttcttctctgatgaactggtgaatagattagcacacgtatttttaggcttctaaacggtgtgatttaattttacaaatccttttgtacatgaatatggtttactataaaatcatttttcatctttatattagtttaattcatttgtttataaccttgaacaattatgataaatcattaagctatattaattctgccatccaattaagagggccatatatgaccttctttgcttgcatactgcatcatctcgcagcatgtatgtacgtaagccagtgatccttaggtaacatcaaccagtaacatgactagtagttagtactagcttgtaattaaattgtgagtccaatatacatacactcggtgtctcggttgaattggttctttaattatagtacactgtataccagcagtgcaccacgatgggcactgtgtacgtgtacactagtagtactccgtccgttgattttttagcacatgtttaaccgtttgttttattcaaaaacttttatgaaatatgtaaaactatatgtatacatgtaagtatatttaacaatgaatcaaatgataggaaaagaattaataattacttaaattttttaaataagatgaacggttaaacatatttaaaaaagtcaacggcgccaaatatttagaaacggagagagtatatgtactgtacattaagctgttggggtatattaattgttgaactaagtgctgtatatgaaatctgaccgtgcatgctgatgagaaatcatgggctgcagctagctatagctagtactctggttcaccggatgtgcatgaccaaagtaatagtactgagcttttgcgctgtgcttgcttccagccagctagctatactcatggctcacttcttcgatctgtttcatcaaaatacatttaaatagagatggtagatcagtacatctgtacatatatataagccatgtaggatagatctacaattctacatgcatgtacattagcagcacactgcgatcaatttgtatatgccgattgcaaaacgtacgaatggtgtgtgtgtgtgtgtatacaagtttcagacttttagacgactgaagcaaagcatggcatgggccgatgggcgcaacggaagtacgcaggtttggctggctaactcagcacacgtacgtacgtacgtacgagctggagtacgtgtagctaatacgacgagttaattaggcttcctttgacaaagctttagattctcggatgcggctgttaagtagtcagcttgtgagaatataaaaatattaaaatttttaacttttgactgctatagtttctttttaattctaagttttgtagttactgattttcaggatttaaaattcaagtgataatttagactattgatttagggtaattttaccatcctttagaaggtaccaagagataccataatttctaatgtaaaatttataccaaaatttctagtgtaaatcttggtaccttcaggtaatttctaaaggactataaaatttctcattaatttaagggctcctttggaacaaagaaaaggtagaggaagttcggagaggattggatacatatataaaaataagagtgaagtgcacgagcggtctctaaacttgtgtgggtgtgtcatctaggtccctaaactctcaaaatacattttcggatccttgaacttgttttggagtgtcatacaggtctaaacgagctccaaccccttccatgcgctgatgtggcatgccacgatagttcatacgtgttagttggatccacgtgtcagtcacatagaaaaaaatataattagaaaaatatattttctcctctctaccttaaaatttttatttttttttctgtctacctaagaggagaaaatatggtttttaattttattttttattgacatgtggattccactgacacgtaagcatcaccgtggcattgccacgtcagcacattgagtgggttagaacctgtttggatctatataacacacatggcaagttcagggacctacaaatgcattttaggagttcagggatctagatgacacaccggtacaagtttagagaccgctcatgtacttcactctaaaaataattcgtacgtagtataaggtattttgaaacaaaagaatgactctttcaactttctttgaaaatcctgtaaaaataggctatttataggaattctaaaggaaaactaatatgaggtctaacataatgttttctcttcgttttgacttataaacttcctttgtttctttctatgcatggagctacgaaacaatgttctttgcaaaatccaatggttttatttcctttggagacgttatatcatggcatcatactcctgtgattcttttttttttgttcttgtggttttgaaatcttgctgcgttccaaagaaaaattcgagaggaattgcagcggacagaaactccctaattaaaaagtgacaccaactgctccagagaattaattggatcgatcgggctggtacgtagggccagaatccggttacgtccccgccacagacaacgtgcagtacgtcgatcgattaccaagtccataattaactacacgtacttcctacttagatctatttaaaccaaaagaaaacctttggatcggtaggaaattaataaacgaggaattttttgatcaaattaaatttgcattgtttttgaagagatcgtgctgattcgatctctctgtctactatctatcacaatctgaatccgtagttccatctgatcgatcacctgctagattaagaccgtgtcactgtagcgtgaactgcgatgtgggccccaacgccaagctgggccagtgggccctggctaatgctcacggccgtgactggctagctgcatgcatacgtggcccatctgcctaaattgagtatcgcagctggtacagatttgctctctccatgcctcctcatgagcagtgcttattttaattagagcgatttgtactttcaagtttcaaccatctttgcgctgtttaagtttcactatgaatcacattttatctaatttttttatttaagactaatttttttaattttgttgcactttggactattcaactctattctttaatctttagccatgtctagtctccctccctgtaacgatatggtctacagagaggtggaggagtttgccggtgtttcgaaaccaatatgcttgaggtcattgatgcgttaaataagtggtttagagtattcgaaattacaacaaaggtaaaaataccttgcccaaagaaaaatgttggtcaatgagtgatctaaagtgaaaccgtggtaacaaaaagtggcacaagttgtaattcactcttttatttattcatcggccaaaagtgatggattatttacttgattgtagcaataattaaatattatatgctatgaacataataaatacagtagataaatattataatttttatagaagcatggagcaaataattcgaggaacaacatgatgaataaccataaacaaccaagtccatccaggtgaacctacaactaaaaggaaaagaaaggaagaagatcaatgctctagtaattacctcctccatcgattaggtcacaccaaatgcagatcaacacgctaactaacactccctgctggcagtgcctagcaccagcaaataattatttactgctgaaaatacgatcgatatgcacgtgtaaaaatgtatatactccagtaggcaactgaattagaataaatcattacagaggtaggagtatatatattaatatatgtgcaatgaattttcaccgatcttatcatcatccctctgcttgcatatgttccaaaaatagcgcagccactgtcaacaattcaagattatcgacatgattcgagtgaagaaaggcgttgatggccacagtaatatccggatcacagcttgaccaggttgcatgcatcactgtttatatagtagtatatggctgatgattctgttaattaaacctcagcttttgctacattggtccttggctactgatcgaagtggatggacagcttcattcgccgacgtctgctgcgtgctcatctttctggtgtggtcgatacaaccaaaaagaaagaaaataaaggaggatgaattggagaaataaagcaagggagacaccatcttttcattgccattattccttccatcccatctacaattttctctgaaccaaggttggatgtattagctagcaaccggtggttatctcatgatctcatctggctgtgataaattatttttctgaaaattttggtctgtgtataatcagcacaccgacagaaaaagggcatgctaattcgtgcgcacatccatgtcaattgaacatacccctgcatatgggatcatccctaattagcaacatgtttgtttttttctttgagtaaaacaagatgatatcgataatttaatattctactactgtggtagttccaggaaatgtgtagttgtatacagtcacatcttgcagtacttctttgcccactgtgcaagtatgtgtttccacaaaatggaacctaatgttggggagatcaggataggctttagtgctttacatatatgtccccctagctaaattaatcttctcacaccaagataagagttgctgatcaattgaaggaggcattgaaatggagatttgagcgtatctcaatgtttaatcccttccaatttattggctcacaatacattatctaaatcccttaaaatttacattatctaaaaaaaatggctcacaattggccatgagcacataatctcccactggtcaaatccaatgcacctccacaaaagcatcacacaaattactttataaattccctccattgtttgcgccaacaggcatgtgacagcctatattgcttaatt

SEQ ID NO: 6672 - DNA, 728 bp, Oryza sativa
  unsure (1)..(728): unsure at all n locations
ttatttcctaaacacaccctaccaatttattgccaaaattaaatagtatgtgtgttttttggattgaacccaaatattttggtggttcccttatactatttggtcattttctagaagtttcttccctgtactattagaatttgattttatattggtagcaatccaaatggtagccaaataattttaccctaccaatattttggtagtgccaaattttgcntagactttggcactaccaataaattggtagggtagagaaccaaacaagccctaagaaacggaatcagccctaatcaatcatatcttcctttttcgtggggcctctaatcatcttcctttgggatagtggttgagcacgggttatcatgtagtcgagtcaggttaggccaaatcacacgtcgacctttgggtacgtgttgggcctcacttgtgatggattgggccatgctcagtctttacttggcaagtctctcatcgactgcgggggtcgcgataaaccgccataaacggttccgggttttggaccaccaccccccaccgccgccacgcagccggcggccaccaccccatccccgtcgactccaccaccaccacgctagctagctgctgcctggacttggatcagacagagcaagggtagtagtagtagtagtagagatgcggctaatgcttctcgagttccgggtaccaaggtcgaatntcgaatttgcaatgnnaangcgcgcccg

SEQ ID NO: 6673 - DNA, 751 bp, Oryza sativa
  unsure (1)..(751): unsure at all n locations
agtgtgtacgtatntcgctgaaacccgcacagaaanntttgagaggcaagagcaaaatgaaagtgagaaatgtataacagtagtactaacagtagtaggatgcatccatctgataaccaagaggaaggcgatatgtcccgttgagcttgctgccattctcaggaggggggaacattggtctatcaagcaagtctgggtagcaaccgacaagaaacccttggtcagcaccatcagagttggcacgggcaatctctaggtcatgaaacatgcctttgaagacatccatagaaggctgtaaatggaaaatgttgccgatgtcagattactgtaacaggaaatagtaccagcatcagattacttgttgtgcactacatatgtgtgagcagaagatattttcaggtgtgacaacttaacactgattatttattaatgacatgctatttcatcgtagtacttccctaacggatactatattctaatgaatatggaaggaaaatatccagtttgtgacctgccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggaa

SEQ ID NO: 6674 - DNA, 729 bp, Oryza sativa
  unsure (1)..(729): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcaaaatgaaagtgagaaatgtataacagtagtactaacagtagtaggatgcatccatctgataaccaagaggaaggcgatatgtcccgttgagcttgctgccattctcaggagggtggaacattggtctatcaagcaagtctgggtagcagccgacaagaaacccttggtcagcaccatcagagttggcacggccaatctctaggtcatgaagcatgcctttgaagacatccatagaaggctgtaaatggaaaatgttgccgatgtcagattactgtaacaggaaatagtaccagcatcagattacttgtttgccactacatatgtgtgagcagaagatattttcaggtgtgacaacttaacactgattatttattaatgacatgctatttcatcgtagtacttccctaacggatactatattctaatgaatatggaaggaaaatatccagtctgtgacctgccaannnnnnnnnnnnnnnnnnnnnnnnnnnnnnnnnnnnatatgattctataatcgcgc

SEQ ID NO: 6675 - DNA, 7608 bp, Oryza sativa
  unsure (1)..(7608): unsure at all n locations
ccgggtttgtanatcatanttcnnnnnnnnnnnnnnnnnnnnnnnnnnnnnnnnnnnnnnnnntttttctcccctcttctgcaggaggcggacgagctgatcgtggggctccccgtctccgccgacgggagcgagacgccgcagtccaacaaggttcggagcgtcgtcgggaggctcgccgtccaagcggccgacaggtgcgttgcattgcgtgtggctgcaaagctgcagactgcactgcactgttcaatgttcagtcagtcagtgtggttgccctgcatcaatatattagaagaaaaagagtttttgttacacaacgcaattagccggaccggcttatgctaggggaagggagaaaaggcaaaataaaaactgaaactatgaaaagacttacgccggcaaaatgcaactccgaaaggttgccctgcaatgtgcaatgttcagtgtcgtgttcataatcatgcgtctatctgaaaatgtgcaggggattgcgggtgtatctgcaggatgagtacgggacaacgatcgacgccctcgagttcatgatctccaggtaaatcatggctacctgaatcctcgctgtcgtcgtcctaacatgttctgtaaatttcagtactagaaagcattgttcagagtctggaactttgtttttcaggggagtcaagaggtctgcacgtgatgtcaaatctgatgcgtattctgccatggtatttctatgtttcggaatgcttcttcagacttctctccttgtggcagtttctacctgaacttgaccagttttactttggttgtagatgattttggagagatatttctcgtcatcaggtcaaggggctaagattgttcttcctaaacaaccacaactacagagcaaattgttagagaagtcaaggcaagatgctcaagtttaggaagccgtgtacgttctaatctctccaaccatagatagcagacttatcacaacagcgttcttgttgttctaccagctaacttcaattgcgtagtacagtattttatatagtcttgttcgccgtactcatatgattaaacgaagggaggatgacttgttgacattctgccaatttatcaaaattacaagtttcgatcaaaattcttcatttgctgtttcaaatcaaccagatgtaaatcgtgcaacttgcccgatgataaatctcgtggtcagttctgagtctggatttcgttgctagtagacttcttgttcagatacttgtatgtcacttaataataatagcattatggtttccaagtccaacaagattgtatatgcgtagttttcatagagaaggaatttgagagtaaactgctctaaaactcagctttggaaagaaagaaaaaggtaatgtacaacaatcccccgtcccattccatgtgctaaacacgcactttacccatttgagagtatgactgatctatctttactgtatctgcatcaatcatggttgctgcaggcatacattgctgctgacacaaagtagaatgcctgagccaaaatcgtcagaatgaatcaagaattagagaatgtgattctgtccaaatgaagatgcatctgaatctgtacaaattgaatcaaaacagcttgctgaattcggtttcctgggccggttcaccaagccgagggaagaacggttccctctcgagcatagtctgcaacgagtccatcaccctcaccagagacgcccacaagaacggcgcagaacaaaatgcgtacccgaagattgccagaaccctcacgataccaccatggtaccacgggaatgccatgacgaagaacatgccaataatagctaaccagggcgtgagcacagcaagcaatggaagcaagaaggcattgctcacgagcactcccaatgccaatgcaccaaacaggtacatggaccagcccatgaatgggtgaaccgtgcgtgggattataaagaacgggatggcatatgcaattagcatggccacgattgcagacatcttgatcagcccctgcaccatggcattttgcttctcgggccgccggttatagcacagttttgtcatcccaggctttgccaacctggtaatggttataatgactgcgtacatcaatatctccatcaggatcactggcatttcagcggcatacctgttgatgtgaacatgcaaaggttaagtgaacagtaaggatgaaagtggagtttagagtctgctcaagcacattttttcagttcagttcttgtctttactcacccaagatcatcccaccgttgcttgtgccaggaaaggcccagtggcaagattggccatgaccaccaataccaaggtttaaaccaaggggcgctggggaatgtgataacgctgttgggcccacaagggacatgccaatgcaacttgagatctgcattattccaccaaaagggtgtcaaagataatctttgagaggcaagagcaaaatgaaagtgagaaatgtataacagtagtactaacagtagtaggatgcatccatctgataaccaagaggaaggcgatatgtcccgttgagcttgctgccattctcaggagggtggaacattggtctatcaagcaagtctgggtagcagccgacaagaaacccttggtcagcaccatcagagttggcacggccaatctctaggtcatgaagcatgcctttgaagacatccatagaaggctgtaaatggaaaatgttgccgatgtcagattactgtaacaggaaatagtaccagcatcagattacttgtttgccactacatatgtgtgagcagaagatattttcaggtgtgacaacttaacactgattatttattaatgacatgctatttcatcgtagtacttccctaacggatactatattctaatgaatatggaaggaaaatatccagtctgtgacctgccaatggctaaaatccactgtacagattggcagaatacagctcatatttcatcaaaccctccaaatggccaatgcatgatcaatccagtggtagtggctcaactgtcatatgacccattaccaatccaatgccaccatcaacacagctgtaggtatggtcaaatttaagaaacacaccgtttttactctaatgaacactatgtaacctggcagaagcaacttattttaatcatcaaggcaacagaatctcaaccagcatactccttctgtcccaaagtaacccaacctaaaataagatgtgaccaaacctagtacaacgaatctggacaaacctcctatccagatttattgtattaggttagatcacatcctattctaggttgagttacagaacaggtggtacagactagaaaatactgtacaaagtacaggaattgcatcatcgtacctggagcacgaaaagaccagtgtggaagtagcaagggttgatgaaaacggcacagaactgtccacactggaagagctcatcggtcttctgaaggaagatgttatcggagtcgatcatgacgacgcgctcatagtcaaccagggtccacgcatagagcttgttcagcgtcagcttaaacctcctgttgatccctccaaggttgctctcataaggattcttcatattctccaccagcaccactctcatgccatcctcttccctcctgtttccattcacaataaaaaaggtgtcaagttccaaaaaaaaaagatcacatgaagatcttgtaataacaaaccacagcatggaaagttttgaacaagaaatgtgattgcaaccatctttgttcgcattgcatgttgtctgaaacgttttgactatgacaaagaagccattgattcgaagtttcgaacaaatcatttgggatttgaccgtccctgagaatatccatcggtgcaactgattcattttttcaaagaaaggaaagttgaccacattaattgaactagtactccttaccaaccaaggcaagcaaacagatagtcaaagttccaaagccagcgcaaccgtcccaaatcacaactatttttcatattggcatatatagcgactagccagaaagaacaagtaactaacggtaatgtaatcagacaagaacatcaccagttgaaaccgagcatatgcagtgcacatctcatatcgtcaaacacattgagaaaatccgatacactaaaatattaatcagataggaagcttccccttctgcaggtgggcccggccccctcccacgaaaccatctactagtattaaatcctagttgaaaaatacccgaaatgccctttccacgtcatcttcttcttcttccttgttcccaactccagaggaagaaaagctctctcaaaaacagaaacctccataggaagaaacgcggctttattgattaattaagaaactagcgtgcgctggcaatggcttagcgagggtaattacccccgcgtttcgacgattagcgatggtgaggtgagcatcggagaggcggagagagagactcacattgcgcggacccagtcggcggggacgtcggcggaggcgatgaggacgcggtcggcgtcggcgccgatcctggcgagggagcgcatcatgacgcgcacggcgacgtagaactcgtagtccctcggcgtccccatgtacatcatcgccgcgtacgcgtgccggtgcctcggccaccggccctgcgccgccgctgccacgactccactctccctcccttccaactcctccttcaccgccgccgtcgccgacaccgccatcaacgccgccacgacgacgaccaccaccccccaccgccggcacgcagccggcggccaccaccccatccccgtcgactccaccaccaccacgctagctagctgctgcctggacttggatcagacagagcaagggtagtagtagtagtagtagagatgcggctgatgcttctcgagttccttcaaaagcagaggagagaaaaaaaatggagaagagaggagacgaacgaggaggaggggaagcggccggcgcggcgtttcccttatttatgggtgtgctcgtggaggggtggggcccacacgtgcctgacaggtggggccggatcgggagtgggcccacccccgcagcgacggctgggtgcgcgtggccgtgtcacgcgcgcgcggatgagaaagagagagagagagagagagaaaaagaaggtgcagcaaacgctctgtgcgccgcgcggctcgtgaaaggaaagaggaaagacgaaggcgaagtaaagacgcgtgcggggattggacggctcggattgacccgttcgtcgcccccggccgacctcgtcgtcgtcaacacaaatgctacacacgcacaacggcacgagctctccccttttttatcagcgaatcagagatagagtgtttcttttagccaaaaaaaaagggaaaaaatacgaattactattttcttctccttttttgcggttaaaaaaaatgagccaattcagaacaaaaagaattgatgctttggtttggtacaaagatgtgtgtgaaaatctttcgccagagatccgcatcatcagcatcggtgacggcatattaaatggcagcggcaagctaagcttcaattaatcaagctgcaaatggagtagtattaaagcttatgttacgcagagatttagccaggctgcaggcttagtgcacgtaaacctgggcttatgttattcggaaaattatttttctattcccatgacgtgtagacgagctgttcaacggctcaacctctccaaggctttgcttctcttcaggtacatctacgatcaagatatttaattttgttgctcaatgtcaaatttaaaggagagaatcgttctctttgtacgtcaccgtccggcagttgcataatctctaatagcgggcagggaatttaatcgtacaggaatcagttgcaaactctttgctgtttgctcttcaatcaatgtaccagccgcaaacaaaattgaaatattagaatttcaccattaaagttgattattgttatctttcatcatgctttatttcttacattgacctttagatcactaaaaacgtactccatccgggtttgtaatattttcattttagataaggatgaggtcaaactttagaatctttgattatgaatcattttttaaatatttatcttttaaatattgtaactatatgtatagattagtcttaaaaaataatttaataaaatcatatatttgttagcacttttatactccctctttccctaaatgtttgacgccgttaacttttttaaacttgtttgaccgttcatcttattcaaaaacttttatgaaatatgtaaaaattatatgtatacgtaaaattatatttaacaataaatcaaatgatatgaaagaattaataattactttttgaataagacgaacggtcaaatatttttaaaaaagtcaacggcgtcaaatattttatgatggagggagtacatattataaataaaataatgatcaaagttgtttttttgagaccgtactattgttcaaaacgacaagtattattaactcagagggaatatatatagaaattttatctttagattattttacttataatcaactgtaaacgacacaaatgacggcttttagataaggtagtatcggatatagtcagaggaatactttaatattttgggttgagctattaaaggtggcatctatcattgtaaagaaaaagcatatgcctcattggtctgatcctttgcttgcccctttccattagagcaagtttaatagtatagccaactgctagtttcaattcatctatagttaatttaatagcttatccatacaatagttatatactacactattaatacctggtcccatctgtcatacacatattgtattttggagtccgtactataactggctacaaatctgtagcccgctgctcttctctctccttatttatctctttaaaatatgtctgcagctggtctatagccagctattgtacctgctcttaattccaactgaaacgatccaattgaaacctcacacgtcaggattaattaaacccgtttctatcgtgtgctgatgttaactcgctccatgattccgggccnacatgggggggttttacctcaaccaaaagaaagatcctgtttagacctattagtagggccaattaatatgatctcaattttacggaattactggaagtggaacggagtcaatcggagttacggattgggtgatatgaattttggaagtttaattggagtttctggagtaggagaaatggtttatggaatttatagaaataatattctcaaaaatattattgacagtcactgtcatgcgggaccaaaggaaacgggttatggaattctggaataaagaattgatttatgggacaaaagaaaaaaggattattaaattcctggaaaaagaaaaggatggagggatgttaattggacttgggccgagcgaaaggcgccggcccaaaagattcccngccccgcccaagcgagaaaactcattgatcttttttttaaactacccctatattcaatttaaatacgggccacattaaaaaaagccgtgatattttttacaacaccccgggcacaaaggggtacccttatggctgcaaactgtcttcaacgaaccgagccaaccaaggttggacgtttgtatcgttag

SEQ ID NO: 6676 - DNA, 33715 bp, Oryza sativa
  unsure (1)..(33715): unsure at all n locations
ccactgattcaatccatttatgtggagtatccagtacacacacatttctcatatgaacaaaaacttttttgtgtttaatttattgatcagattgagaggtgcgcccgcacctcgcatatgcaggaatttcctcctgccctgcacactatcagtataaaagacgtataaacatatacatcagtaatacactttgtggcaaattatacattgccgtataaatctcccccttccctacgtacgtatatatcttccttctacatacaccccacgtacgtacacattaattaactccacgtagttattacgtagttggttaattaattaattatacgtgcgatgagaatacacccaaattatacccggcgaaatacgtcgaatacaatacccgaagaagaagaagaagaagaagaagaagaagaagaagaagaagaagaaaaattcaaaatacaagaaaagaaaaaaccaaagttattacaaggacgacgtacatacccgacgcgtgcagctaactggtagctagcctgatttaagtttgactaagtttatagaaaaaagtactaatattttcaacccaagacaaatttattataaaaatatgttcaattattgatttgatgatactaatttaatattataaatattactatatttgtttataaatttagttaaatttaaaacagtttagctttaaccagagagatgtgaaaagaataatattgaaaagatatgatggatgagtcattaacatataattaattaatattaataatttgaactttaaaaattggtgtattttttttaaaacacacatcatttaatagtttaggatatgtgtgacaatctttcctctaggaacgaacccagccacgttttgtatacctctgtaactaaaaagattacatgataataatctacttactaatgaagaaaactggataaagtcgtgagagtgaggtccggtatttatccggccggatgagcgtccaaaggccaaaaaagtgttgggtgaaaagtgtgccaagaatatgcagctttcgtttctcgtgggcgtcgcgataaggccgagccaacagtacgtagctagtgtgctttgtcacgtaccagtagcaacgcactacagtagtacgtggcacacgaggacgttttgcctaggaggaagagaatggccgtgtcgccacgctcgctcgacagcttccagctaatccaaaatatcttttgtttactcatagactcgatcgtacttatagcaacggcgagtgttgaatcttcgtcatgtctcgtggtcttttgggagctgtgaaaggaacgggaccgtagggttttcgactttgtgctctcttcagtcttagtggttctggagtccatccactcggaaggccatctgtggttttaagctgacgttgctgcttttagagacttgttgggtgtatagcgtggttcggccccttcccgctgtttggagtttatgtttagccacggtagttttctaagcttcagcttttttattttatcttttctcccttttccctggcataagccagtctgaccgatttgtattgtgtaattaaaactatgttagtcgtgtaattttttttgcacgttcattaaaaaaaatcttcgtcgtatcgaagtggaaaaaaaggggattgaagcgtcgtggtcgtcaccaacgtacccggccggttaataagccggtcgctagcttagctttggttttgcttcggttgccggtctagctcgctcgctcgctcggtttgtccccttgtgatctctgcttccaaaacgggctgacccaagtttgaattgaatcgcgacaccaaccacgcgctgcgcgggcacgcacgccgcgattgacttgtagagtcgtacgtccatgcaatatattgcagccaccaatccaccgcccggttaggcgcagcggcgtattggcatcatattggagtagcggattagccgtgctgcgtcggatgcgcgttggcagcagttgccagttgaacccaccgtgaccatggccgtggtcagaggtagccagcgccacggtcactctcttccaactctcaaagctactagtgcaccgtacgtcagtgggccggccaacgcccatgatcgctactgctacttggcacttgcagagtgagtactactgttccaggttgcagatgcagatgcaggcaagaagatactttggggtttcacgaaactgcaggctgcagcttcccttcagacctcctcttctcttctactactactctttgacttcaaatgcggccggactcacttgcctgtgaaggaaacgaaatatactagtattccctatttgacgccattaactttttttaaacatgtttgaccgttcatcttatttaataacttttgtgaaatatgtaaaactatatgtatacataaaaaaactatttaacaatgaatcaaatgatatgaaaagaattaataattacttaaattttttaaataaaacaaacggtcaaacatattttaaaaagtcaacggcgtcaaatattttgggatggagggagtactattcaagtaaggggcgcagctaaaacgaaatgaaaagaggtgacacttgcttaaattattttactttagatcaagtttaaactgattcggttgtataaatttatatttagggatacacacatggtaaaatagatgagataaagctttatcgggttcctgggcacccctcatatatctagcttcaccccgctcaactttagaatttcacttctcctacttcctcgtctcattttaagtgcagttttcagtctatgcgtctaacatttgaccgtccgtcttatttaagaaattaatatttttttagaaaataagtcacacataaaatactattcatatttttatcatctaataattaagaaaaaagtaaaataagacgaaaagttaaacgttgaacacagaataaaaactatacataaaatgtgatggatggagtattacaaatccacaatattactattaccagtagtatacgaccgatcgattcacacggttaggatattaacgatcgttaacactagtcactggcacaacaagaggacacaccactagctctgtagctcaccatcaacgaccattacctttggttaatcagtcatgccaacctttgctgtcacataaagcatgaaagttactgctcctaagaggagtatctcgatggacgacggactccttcagaaacgaccagctcagtagctcgcacattcagactttcaggcaaaacctgtgtgtatagtgtgtactagcaatacattacccaaggttaaaaaaaataaaactactccataaaaactactgatacgatacgatacgatgcgatgaagatgttgagattatagacatataatgatttaatctattccataaataaatcatgacattacagataaaaactagcatgaacgcatcattagatctacacatgtaaactacacagtataacatgaacagatcaaatatgcgcaacatattgaacacgtaccgaggtgacggaaagaccggctgcttggtcgaaccttttcgcaagtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaaggcagaggttccggagacctgctctcccgatcgccggtgcacgccggcgagcgggatggagtagtctacgagcgacggcgcagtacagaggtaggaagcaaaccctagattgattttttttgtatgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatctttcggaacgtttccaaaacaaaaacgaatccgaatttgcaacaaaacaaaactgcaaaaggagcctgcgaggcaagcgagcgagcgcgcgcgtgtgtttcccctcttctctccaccacacatgcttcaagcaactaggagggcatcctcccttttaaggaggtccccctctcctagaataagcaaggtggtactaaactccacatgcataccatcccatgaggtgggcttttgtgattttccaaagaattaatcttcgagtgggctaaggcccattcattaattccaacggaagattcacgcggtgaagacacgacttgtcgactacttatcaggtactccagtgcacacgcacttttcgcacacgttgattaattcgctgcacttttgctgagtggtgctgacctgaccttttcgtcgatgatatgtttgcttcggttcttcggattcatacggtcgatcgattcgcagatgcagtaatacgtctagggcaaggcgaccgcgacggatcgatactctctttgttttgaccaattttaaccaacgtcacgaacgtgtgtgtgtgctcgtcagagtcttcgggcagctcagctgggcccatctgtcagccactcatgtggtatgcatgtccacgtcactcgtattgacttcctgccagataatatcatatcgcgtggcggccacactcaactcaccggccagaaattcagagtcgcaatggaaatagattagaaattcagaatgagagtacaatctcgggagggttttaatcagtgattagtttggtgatatatgacctgaaatatgcttcaggtgttagtagtgtagtgcacatttgaggaggaaagcttagtactcccaaaaaaaagtctaggtagcttcttaaggccacaattaattaatgccacaagtagcaggattattcagatattatcttcaacatattcaggttgtcatctagcacaaggtcaaccaacctagaagaaagaagaatgcgtatatgggtgcaaccacaacgcgcatgctgttattagtcctagaaattagtcgaagatctctgttttttaccgtttccttctcgctttagatgaatcagtcacatatgttacagttgtttcttcagagttcagattcagagaggattaggtactgtactagaaaatgtcagttgtacaccgtgggttatccaatattgacagcctctgttccaaatataagaatctactgtagttagcaaccaacataaaaaaatagcagtgatcatactgtttaaacagttatttgtagccccagcataaggtaaggtcatccgtgaactgtaatagcacacaactgttctaaagacttcagcaaatttggcccagaggatgtggcccatcagtagtttgtccaaagaggttaggcccaatatttgtttgcatgccactaattaattaatcactcaaaatacattacatatactcctacctactatgtgttgcatgtcttctatgcgtagggattggaattaatcaaatgaccttattatcaccttcaacatgatgcatgtgatgaatattctgacctaatctggaacatggacaacttattcatcggcaggagtctcccctgcttgttcagttttcagcaaagtttgcactgatcatacggtcataccgtttttcagcaaacaatctgtaaccccggtcttgggctctgaagaaagaaacagtatagtttgttgtttagctaatcagcaaatctggcccaagaggattaggcccattatttaatttgggtttgaactaatggagacaactttcatcaaggcctaaatttaatccattagggtggtgagcctgtcagttttaaaaatcaaataaaatgaagaattattagatggccgtgaccttgactcaggatcagtagtatatggaccgatacaggtttctttcggtagataggtagccagtaccttcacaaatctcacctaaatacgccattttatctctcccaacgttgacatctctctctccctttcttccgccgcagattacaccatcacaagcagccagctcctgcgtgtgcgaggatgaagcatgcataatggccaaattggcccccctttttaggtcgccatgcatgaacaatggccatcgatcgagctctcctctccctttctcccaccaaaccccacaccattttctacctcgcatttctctcatctccctttccacaattccacatgcatccaaaaagactacgtgaaaaagaaatcatttttcgcgtgtatgcttaaacaaaaagaaaatgattggacattttctttcacgtgtatgcttaaacaagagatgcagtacgtggtaagggatgcgtgattttaaccctaagggtctcatcttttcgcttatacttatcaaacaaaatttgatttttcgaccttaaatttggagttcattttgggttttttttcatcgaagtttattttttggccttcgcttttaggttgataaaaacatgtgtataaaagttttattcacaaattattttctgtttgcaaatatgttgtttcgcttattccccgaataagcaaaacgatgggccagatatatttttttttcttaaaaaatgtttggaggagcatctctctctctacaaatctctcccttttttgtgggtgtgtatgcttaaacaataatcttagtatctgaacccatcaaatacgtcacaaattaaggcatccttctctacgtatctacactgaaagtatcgtagcacatggacgtattcaattggcaggaaatgtgttgtacaaatgtctaatgtacatgattaattgcaattagctagtgcgtatatagaagaataaaatctagctcttccatcatgtcaagagagcgacgtgccctctcaagaacactcttcttctacctctccacgatgcaacgtataggcggcaacaagtttcttgaagccggagcactagctcgatcgagagctagtgctgcagggttctccccaacttagaatctagggtttgccagcaatgtacttgctctgatcggccaagcttaatcgccgcgatatttattaacttatatttattaatttatttaatttatggagtccaatggcgtcggcggcggcgcggcgcggccgctcacggcgtcgaggcggctgctggcgcggagcgcgagcaccacggcgtcgcgcgccggcggcgccggcgcgttcgtctacgatgggatgcgcccggcgccgctcttcttgtcgaccaacttcgcgcggtccctccgtaaggcggcctcgttcggcggcggcggcaagaagcagtacagcgccgacgacgacggcgccgtcgccgtgaaggcggcggcgccgccgcggcgggcgctgagcagcaaggagaacaccgtgcacgagctgggtacggccccggcgaggggcccgtgggagccggcgaggcggccgaggcggagctcatcgggggggtcgtcgtcgccggagaacgccgggagcaccagaggatcggccgtgctcagggacatgatgacgcggaggaaggaggagcccgaaaagaagaaggcggcgcaccgcgcgcgcatgctcgccgcgcgcttgctccagtggcgcttcgccaacgcccgcatggagaaggccatggcccgcgccaccgccgccgccgaggtgaggccgtgacaccgatcgccatggacgcacgctagctcgcttcccgtacatgttctgacggcgcgccatggatggatggatgcagaacaagctgttctacacgtggctgcgggtggcggagctccggaacatccaggcggcgaagcggatcgtggcgcagcggcggcggcagaagctgaagctggcgaggctgctccggccgcagctctcgctgctcgcgtcgtgggactccctcgccaagccgcacgccgacgccgtcgacgacctcggcgccgtcctcgccgccgcctgcaccgcgctccccttagccgacggcgcccaagtatactccactactcccctcgtcgtctctgacagaaatatttacactctttgatcaaccaaccaaccatcaacaaattgctcacatttgcagggcgacatggagagcttgcacgaagccatgttcgcgtgcgtgggcacggtgaacgacatcgaagccaacgccgacatgttcttcgccacggtacacgcttaattaattcagctttttgataaatcaaccactaaactgtcgaaaaataaactgagcaactaaaaataatctaatggaaaaattttacatctgcgttcttaacggtttaaaaccaatattaaaaataaactacaatgaaaaaaccttagaaaaatcaacgacttaaactaacttttaaaatttaaaatttggttttggctgataaagataacaaacaggcgattttgaggcgaggttactaggaaaggttagtttagatgcaattatatgaaccttgcatgagtgattgatttttttttttggtggtgcattattattcaggctggggtgacgagcagcacgctggaagaactgtcgacgacgataaagcaggaggtggagggcctgcaggaagccatgaagctggcaaggattgtcactagcttgcaggttggtaaatggtcgtttttagctgatgcctcactctcaccagaaccagatttagtctagtctaatctggtctagtgagatcagtatcttctgtactactaagatttggattgattgtcatatactccatttctccagcactagtgctgcctggctgcctactccctaattctatttgtttttgtctagtctagttgttcttttgttgcaacgaaagctcaagctcctggattagttgatgacaaataattctgtttcatggcttacattgtgtttggactgcaggtgcaggaagtgagcctccgggcaaacttgattcagattcaggcaaagcagaaggttgacatgggagcatctgtcccggcgattgcaacttctggttggtgtttctgatcatcaaagtacacggagatggagcagagtgtcaatcactcgcccacttatataaattaagatgcaaagagtactaatgctagtaccagcgtcacggactgaccggtgatctgagccgacattactgatgtttttatgtatatgttcgtgcctgaaacaagtaaattaaaacaaaaaattagacgatgaccaagaaattaaagatacatggtcccctggttggccggtcgcattactttcccaggtaaatgttcagtttgttggaagggcactaatttgttggtcttttcatgttcatgaatgttaagttgatggatggatgtaattcggtttgattaacagtgtatatatgtatcttacgtatatttaagggcgttggtgttcatgttggtgtgtagaattgaatatcacagtttgtggatagagattgagttattgaggtgtatgcaatatgcatattcagtgttcacaaactgtatatcaattattccttcaagggcttgtcctttgagttacccaagagtcaacaatgatatttgccctgtaaaatatatctgttgtttatgtaagaaactctatccattttctttctaatgaaatgagctgatagctactaattaaccaacgggaattgtattatcagtacatcatagcagataataacgtacgagagtctagaccgtcagccactactattgcacttgcagtatatatagagtagttaaaaatgggcctgtttagaatacatggacaacccaatgggccatctgtgccacagcccaagagatagagtgggctttccgtttgctccctacaagcccacatgatcacctcggccttggtgaggcccaagcgccagtaaacctcgcccgtgaacatcaacttgcactgcacccagcagaaaaatcttgctgctgctgcagagactccatggcctggattcatgcacgagtctgactgtgcagagcacgatgcccgaggcggatgttggcgtatctacaaacacaggctatagttttattctcttgcaggatgtttgtgcaagagaatatgtttgtctgtgcgattgttcatccatcgggacatttttaactgaagtagtagtgaattgaaccattcatgtagacaagggaattttcaaaaacctggattgttcaggttccatcttaaatttgaatccgaaacagtgaaactaaaacaagacatttcaacacacacaaactggtgacaattacccagcgagcgaacaaatacgcatcaaaggaaagcaatcaaactggtacctacaactcaatgctagtaggacattagctagcaatcaacacacaactaacctaaaaccttggcacgcaacaacgacgacactagcttattaactaaatgactcccaaattagaagattgtaataggtaaaatgcatggtaattaattaatgcgaaatgtggatgaaaagagagattaagagcacatgaagccggtggggacgcccttgccgcagaagttgaggatgaggctgaggtggatggggaggttgaggttgatgcccagcacgttggccttgatggccgtgcacaggcacaccgccgcctccaggtccaccagcccgttcagcagcgggcagcacggctccgtcgccggcacccccgccttcgcctttatcaggtccagcacgttcgcgcacacccccagcttcagcgcgtccgtcgggcacttcccgtaccacccgctcgtcgacgaccccccgccgccgccgtatccgccgccgctgctgccgcctcctccgtagccgccgctgcctcctccgtagccgccgcctccgccgctgctgccgccgccaccgtaatggccatggccgccgccgccgccgctgccgcaggacgggcaggcggtggtgatggcgaagaggaggaggttgagggcgaggaagagggcacaggaagccgacgccctggacgacgccattggtgcacagctcacgagcagctactagctcaagcaaattaagctgagaatgcactaccagtctaccaccactgcaactgcaagtgtgatgagctgagctctccgagttgggggatctcggctttatatagagatcgctcactcgccaccaacggaatggagtaggagtacgtagaaatggtacattaacatatatgttcttcgggagatgggccaaatgcgacaagaagccgtgactcagtgactggataacacacatggatgtagtattcagatttcagagaccgatgcagaaatatggctggccgaccctgcctttcttttccatcagcccgtggtttgtttggctgtctccatgattttttgcttgacctgcttggcctgatgtgatggaggaaagacgatgtgtgacagcggtgtaacatggaggattacttggttttacatgggcgatatctgtatacaatgagtgtagattactgtttgaacaccgtaattaattagcggaatcgattccctaggcgcgaatgagcagtttaatccacggtcggtttgtacgtctagctagatgattaatctcgatctcctggtcatcaggttaggttaatgtacagttgtgtgcatataatcatatagctagtagtacacatatactacctccatctcaaaatgtttgacgccgttgacttttttaaaaatgtttgaccgttcgtattattcaaaaaaatttaagtaattattaattctttttctatcatttgatttattgttaaatatacttttatgtatacatatagttttacacatatcacaaaagtttttaaataaaacgaacggttaaacatgtttaaaaaagtcaacggtgtcaaacatttagggaagaagagagtatatccctgtgtagagtgtagctagctagattagacttagaatacgaccatgatgggttcacgggatgatggataaatagttttccggtgctacaaaagctttagcattatattattattgcatcatgcatgtgatagctgcatcatttgtatgagtacattgtttgtgttcaactctctatcgacatcgatggacggtgcatgtatggtaccgtacgtatatgctactagctcttcagaaggctggtccaatcgtccccttatctttaatactcatcgtgtctcgtctaagttgtcatttgctatgccgacatactccctctattacctgcattagtagttaaaagtgcttaaattttaatatggagaaagtactgcatattccataaaattttatgcattaaatatattttaataatatgtttgttttgtgttggaaatattattatacctttttataagtttgtttaaacgtaaaaaaaagtcaaaacgatttataatataaaacagaggaagtgtctatctcacaagcctagataaaatgtcttataatggattaaaaacccgccctctatatatccaatggggatatatacacagctaaaatacaaaaaagtacatagactcgacctcacaaaaaggatttccacacaactaaccaacataaacacttaattatgctcacacaattctgaaaaacaagtagctccaaacatccttacaaagtacttaagacccacaatgataccacatcacatccccaatcaacttctcaagttccatccagttttagagaaaaactccatgacattattctctatctggcgataaccattcttcagagtgtcgctctcttcatccttgaccaacaacaaccattgccttgtccaatgtgttcccctgaaaaataacttgcaaaaatagttgagtttggattcttcaaaaccacatcatttctacaaagccatatcgctcaacatatgtaacgctccgcttttcgtgaggcgttaaaaactaattcggaaaaatcctaattgcaaaaattttcgttctttgtgtgcgagtctaagtcgtgccgtggatctcagtttaaatccgtccttgatccctctcgtcgccatcaaaatcatcctcatcgaaattcctcttccaatttaagtctccgaaatcaaattccgaaattcaatcgcctcctttgaatcctcgccaaacacttgtcccgattccaaaaataccgagtccaccttgaatccattccttgactcctccctgtttccccgagtccaagtaatcatattcgaaatttcattccaaatccaaatcccttccaaatcatctctctgcataagtctattttgcctccttctaattttggatgggcctgatccccctcccctcggcccatctcctctctcagccgttcctcccctcccctccctccacacgtgcgttgcgcgtgcgccgcgctcgagagagagatcgcccactctcttctcatcctcgctccctctctctctctccgtttctctccctctcccgtagaagctcccccaccggcgtcgatttcccgccgccgccgttcgaaatccggccgcacccccgcgtcgcgcgcgctcgctcgctcagtggccgaccggccgaacgccgccgccatcagcccttgcgtcgccgacgccacgtgctgccgccttgcccccgctccatgacaaaccgaccgccgccgtcatcgccgacgtcatccatggcccccgccgttccacgccgcacccgtccaagagtgggagaagcagctgctctccctctcctcctcctcctcactctccctctcctcattatggcaagggaccaagcccctttttccccttctttttccctttcccgaccaccgccggcgtcaccacctctgcgccgcttgaccgctcgcgccacccgcctcatctccttgaccgccccaaggtcggttctctcaaaccgacatcgccacctataaaacccacaccccctcccatacctctcgcttcctctcctccatcacaccactgccgcctcgccgttcgtcgtcgttctcgccctcctctgccgtcgtgcgtgtcggggagcttgcgagcatgaggagtcgacgaggagctccgcgccgcccccatcctcgcgcctctccatctcttcttccccggccgcgccctctcggtgccgcgccgccccgccgtcgcgtccgcctcgccgcgactccatccgcgccgccgactccgtttctctcgtcggtgagctccccactgaacccccttttcccctgtcgcacgccgcgccgcgcccgccgccgtgcgtcacatctcgccgcgcgcccttgctctgtcccgggcgtcgctcgccgtcgccggcctctctcggcgtcgcccgtgccctctcgaccggtggaatgagctcgcgacctcgcgtagatgctccagctccaacgaatcgaacccccgttgccccagtgaagttttccctctttgctcgccgtcgacgatcgccgtcgaaatccgccgtcgtcagctcctctcgcgtcgattcctctcgccgccacgctcccggggatccccttgacctccccctggctgccccaaggccgtcggccttctcctttgtctccgcgccgtgtcgccgcttccgccgccgcctaacgctgccgtgcgtgcgccgccggtgaccatcgggtcccgcgtccccgcgtgcgcatcgcggtcgcgtaccggttcggctaagcccgagcccgcgcgcccttcgctcttctcgcgcgcggccacgtcggcgtgccggcgagattggtcgccgccgccagccgccgtcgtttttcccccggctaatccgctccgttgaatcgattccccttggcctcctctctcttccggtgctaacccccccaatccacctcgccgccgttcgccggttcacgtcgctcgtcgccggccatcggatcagcctgcccggcctcctctcccttccccatccgacgtggcatccacgtggatgccacctcagccgcccggccccgcggagaccggtcaaaggtctcccggtccaccgatccaacgcgccgccttgcgtgcaccccgctcgcgtgagccgtgtcgccgccttgtgggtcccaccttgcgcccggcacggtggaccgcgtccaccggcttgcgtcgcgtgggccgcgcctcgttcggccttgggccgcctcccttccgcgcgccggcccgctcgcctcggccgcgcccgcgcatctcttcgggccgcgccccttcgctcggcccaagtccaattaacatccctccatccttttctttttccagggatttaataaatcctttttcctttgtcccataaatcaattccttattccaaaattccataaaccgtttcctttggtcccgcatgacagtgactgtcaataatattcttgagaatattatttctataaattccataaaccatttctcctactccagaaactccaattaaacttccaaaattcatatcacccaatccgtaactccgattgactccgttccacttccagtaattccgtaaaattgagatcctatttaatggcactactaataggtctaaacaggatctttcttttggtcttttgtttaggttttcgattgtttgcgtatagttgcggttattggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattccttgtcgctccacccttgtggtacctcagtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagttgatttgtgaatgcctaaaatggcctatacttacgtgaggatttgatccttctatgtggcgtgaggtaaccctgggtcggcttgggaaaggctttgtcgcgaaccactggctggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggtagctggactctgggagtccgagaaaatgaaaaaggctctgggagccgattaatcaagtggaatggctctgggagccgaaaagtaatgatctgacccgggaggtcggtacattgccaaatgagctgttgaaaaacatctcttaaagtcgaatcgagacgcaagtctcttttcggccctaacttagaaagaaataaatcacttagtgttttcaaaatgtcttcaaataaaagatttgcaaaacaaccttgcctctcttccaagcttgcattaaacacctaagttcccgtgacttgctgagtacgaaagtactcacccttgctctatataaatatatatatatagttcctccgccctgaagagaagataaagtgaagtgaagattagggtttcgtcctggttcccagccgtcgcctgtggtgttgggtattagaccgttggttccgctgctgctgttgttggtgttcgcctcgtccgtgtcgtcggttgtattctcgggctgtctgagctgcacnntaggtaaggtaaataagtcctctatttattttaaagattgctatgattcatatttgtcaccgtgggtaccagcactatgtcctgggactggtaccgagatcgcggtttcgtaggaagcggttcgcgccgttttccctacgacacgctcctgttaggtgccgttgtaccggggtatcagattggggtgtgacaataagggtccctactgtttcaaaaacgacagagctttttgagaaagtgaggcaacattattcagcagcttatcattaaacacccaatcattccgcacaagccaaattgcccaagccccagcagcaaacaggtaccaaagacatctatttctaactcccctttggttttagattaaatcaagaaggtcatttctagaagtagggatcaaatcccagtgaaaggcgtctctgtagcagcaccaaagaaattgagctggagggcatctaaaaattatgtgatcagcatcttcctccactccacacagtttgcacagtgggctccctgaccaattcatcttcttaagttgtttggctgcctgtattctcccctttagcattagccacataaaaattttaatttttaaatggatgaaagacttccaaagatcctgcagttttatgtctttaatccccccaaaaatcatctccctatataaggacttagtggtaaactgtcccgactgatttagtttccaaatcataacatcttttcctaagtgtagcttaataggagccagtttctcctgcagctccacccactcctccaactcattttggtccaaagccctcctcgagtcaattttccactccccgtctaagtacattcttttaacaatattgttaggctcagagcagatgctgtgtatgtatggaaactgtgttcttagtggaacatctcctaaccaaacatcgtcccagaacctgactgcttcccccacatcccaccacatagctgcttcctagatccatccacttcttaacttcatgcaaacctctccaaaattgtgagctcccttcagccttagattggaagaagccccctccatttgccaagtacttccttctcaagagttcacaacaaggactattatttccagactccaacttgtaaatccatttgcatagcagagcctcattcatcatttttgtgttgacaaagccaagacccccatcctctctaggtctgcataaagcctcccatctaagcatgtgatattttttcttaccctctagtccttcccagaaaaatctagctctaattgcatccatcttatgatgtgtttgagctggcaacaggtataaccccatcatgtacataggaatgctgctcaggcaagaatttattaatatagatttaccaccgtaagacaaagaaccacatctccatgttgccagttttttctcgatcttagtcactggtactgccaaatctttagctgtcaatctccccttactaataggcacacccaggtatgaaatggggagctatccttttctacagttgaataaatcagctactctatgggcctcctcctcagtagctcctataacaatggcttcacttttctggtaattaattttgaggcatgacatctcttcaaagcagtaaagcagaaatttcacagttactatattctcatctgaggtagacatgaagaggattgtgtcatctgcatattgcagatgagttagtcctcctgtgactaaatgaggcacaagcccttgtaagtgaccggtttctttggccctatttaacatctcggaaagggcatctgccaccaagttgaacaacagtggagataaagtatctccttgtctgactcccttataggtcctgaaaaactccccattctccccattgatgttaacagctactttcccattttctgttactgatttcatccagccaatccatttgtcacagaaacacttcctttgtaagacatcaaacaagaagtcccagtgtactttatcataagctttttcaaaatctagctttaaaataatgccggattggtgagatttttttaactcatgcaacacctcatgtagaataaccacaccatctaaaataaatctaccaggtataaaggttgtttgattctccccaatcactttggatgccacaaatgtccttagggtcaagatctttgttaaaagtttgaaacaaacattgagcaaacaaatgggtctaaatgctttgatattgttggcatctttaatcttggggattagagttattaccccatagtttaatctccacaactccaaactctcctcaaataaagaatcaagcatttctttaaactgatcttttaactgtggctaaaattccttgaagaaacagactggaaggccatcgggccctggtgctgtattagtcttcatgcccttaaaggctttctctatttcttccatggtgaaaggtctagttaaatattcattatcatcctgatccaatctgcccctcttagtccacatgtcctgacttgggaagatttttggaggtgactcagaaccaaacagagacttgtaatattgttttatatgatctttcaactccatctggtcatcaatcactctaccttcatcttccaaacttcttattatgctctttctcttcttaccgttggccacaccatgataatacgctgtgttagcatcaatttttccccactcctctcttgccaataaatctcctctgcaagatttccttcccgtaatattaccaggattctaagcttccttataatagatttccttcccgttagagcttttggttcctaaaatataagagattttaggtgaatgtgatatatcataatactagctattaatctggacaaatagcctacgatgtgtcgcattcacataagatcttttatattttgggacgaaaggagtaaacgacaccctatgccgtgatcgtatcattgggctttcactagactctccatagttccagacttccagtgaaacaaaaatggagcactattagttcgtttgtttggctccgcagtagctatataatttttgtgaggatcatcatcgactgtttttattcacacttaattctacttttttggacttaccgtaaagatttcccttgtacttaaaaaaacaaatactccaaaacacacttgagttttttccagagaggtatgacctgtgagttttttttggaagcaagcagcagcattgaaaaaaaaaatctgacataacgtctcttcttccgctgaccacacggtcccacccactcccccccaccgtccacggcaccggcggcgaagccccgatgccgcggacggtggccgtggtcggcgccggcgcggcgggcctggtggcagcgcgcgagctgctccgcgagggccacgccgtgacggtgttcgagcggtcggcgcgcgtcgggggcacctgggcctacgacccgggctccgaccctgacccgccctgccttgacacggccgcccccggcgccgccgccgtccacggcagcctatacgcgtcgatgcgcaccaacctgccgcgcgagctcatgggcttctccgggttcgcgctggcggggagggtgttcgccggcgacccacgcacgttcccgggccaccgggaggtgctcgccttcctcgatgccttcgccgtggagtccggcgtcgccggccgcgtcaggctccgcgccgaggtggtccgcgtggggcccctcgccggccacggggagaggtggaccgtggcatggcccggcgagggcggcgtggaagaagaagaagaagaaggtgttcgacgccgtcgtggtgtgcaacgggcactgcactgtgcctctagtgcccaagctccgaggtgaggtgttgtcccagtgtcatccagaatttcagttaggagcagcgaaaatcttcagcattgaaatttttttcaagtttgatttgatctaaacttgaaaaatctattgcattcgcgatttcagattagaaaatctgactccctgagttgcaggaattggcaattggcaagggaagcagatgcacagccacaactatcggactcctgaaccatttcaagatcaggttcaagatgctgtctcggttacagtatcagtacgtgttcttgctgctgccgtacagtttcagataaaaatcgtctactttttttatgcagattgttgttgtggtaggattaggagcaagtggagttgacatagctagagagatctcaaatgttgccaaggaagtgcacattgcatctaggtacacagaagatcggcttgggaaggttgataccttccagaatacctggttgcattcagaggttcaaagctttcttaattaactcctgctcaatcactgttccccgaaatcatgggaaagtgaaatcatccttagaggggatatcccctcgtttcgtgcatgtcacctaaatagtcaattaaaaacataaaaaaaaattggcaacctagattaatatgaaatatatcactccacaaacatgcaagtttaaatttaacttctacaaattataacaaaaataacaaatatagttgtgaacatgcgataactattttcagtttaatttgttatttttgttgcaacttactccctccgtttcaaaatgtttaacaccgctgactttttagtacgtgtttgatcattcgtcttattcaaaaaatttaagtaattatttattcttttcatattatttgattcattgttaaatatactttcatgtacacatatagttttacatatttcacaatttttttgaataagacgaacggtcaaacatgtgttaaaaagtcaacggtgtcaaacattttgaaacggagggagtataaaagttgaatttggtcttacatgtttgtggagtgatatatttcgtattaatctatgttgtcaattttttttcaaattttttgataactatctagataacatgcaaataacgaggggatgtccctcgagggatgaaaatccacatcccgaaatcctgctcaaaggcatcatgtactgaatcaatgtgctaattgtggatcatatatacaataatcaggtggattgcatccaagatgatggccaagtgcgtttcagcgaaggatctgcatcaatcgcagcagatacctttctttactgcacagggtaggatcacacttggtcgagctgcatacattcgtttggtttgcatttcgatgaatttactgaagattgcattggcaggtatcggtaccatttcccgttcctggacgtggagggggtcaccgtcgacggcaaccgcgtcgggcctctgtacaagcacgtcttccccccgaagcacgcgccgaacctctccttcgtcggcctgccagtcaaggtataacaacgacacgtcctcgtcgattgttcagagttcagacaaacaaacaccatgacaattcaggcaagagatgtatatgtactgtgcagaccatcatgttccagtcgttcgagctggagtcgaggtgggtcgcccgggcgctgtcggggcgggccgagcttccgggcgaggaggccatggcggccgccgtggaggaggactaccggcggatggacgccgccgggaagcccaagcggcacacgcacgccctcatgcctgactgggtacgtatacgtacgaagttacgcatgcatatgattttgtgtctcggcctctgagctcaccatgttccggccattggtggccgcgacgatcgacgaacggcaggtggagtacatggactgggtggcggcgcaggtcggcgagccgcccatggaggcgcggaggcgggagatatacgagaaggctctccggtgcatctggtctctggatgacagctaccgggacagctgggaggaggaagaagaagaagagaatagatagactcatcgagttctctccttgagcccttcctttggagtttgggttcttaaggagccttgagtataaaatttaggatcaaaccaaagaatctttttcttggtcccaacatttcctaaatgccactacggctgtgtttgtttatccactctcccaactttcactttctcatttttttacgcgtatgtttcccaaactgctaaccgatacttcatccattcctgtcctgattcgtaatattagaatatgtcacacccacctaaaattccataataaaattcgaatcgtgtgtcacacccaaaattccataatagtatgagatggaaggagtatttttcagttataaaatagccatatagctccttaataaaatgcgactcgtgtgtcctagcgtaaatgggctgtctatctggaatcactattaacttcatagcatgggcttttgatgggcttccgtgatcgggcccaactttgctgccgagaagtacacacaaacttgttgggtttataagattaagcgtgttgaggcgaacaagatgcctgtctgaaattttcttcagtcacgagatcaatgcttctgtatatcctaatctcataagagatcatccttagtttcggtgagcatgaacaccatcgattgatttttctatcatggagaagtttggtcagctggagaaaataatagtatgcttgaataattagctcaatgcgaagtcataacacttatcaatcagaaggaaaaaaaactcgtcggtttctcccaatccaatcagctagcaacgcctgctgaaaagatacctccgactatccaagtaaacggggacgaattatatatttttgaaaacttaagacgggatcagctagaactcgtatacaattaacctacgcagctgttgaactaggcgtgccaatgtgttgtacatacgtaagtacattacatacatattcgttttgtttctgactataaagtctgatgattcttattatagtcccatatatatattttttctcttctataaatatagtcgacgagatgcatgcgtccaggggtccagcagcatactctattttctctagttgacgtttagaactaaaaaaaaattaaaatccttcatgcatataaagcgatcatagcaggcaaaaaaatgaggagcagttgaagaagttggtgcaaaaaggtgtccaaatttctaccgccgtgtttcgcacaacgtttacaaacgctgcatatcaattttactgaagtatatatttgtcaaaagctgcatctgtatctgaatatatataagcacgcaggtctcgatcgatcgagtgagctcaacctgtccccaagtttaagccccccaaaaaattaaaatgcatgtcactagtcactactgatcactgatccatcctggaccatccatctcgatcaggcatcatcatcatccacgacgtcagcggcctccctccatggaatcatatcaaaccaatcaacaataacagcgtaattaattaattgcaaataatgcagcttcctagctagatcgatctgcagagagaggagtttgttcacgaattcgcgtttcttgcagacagatggacagcgatggatcggagaagaagaagaagaagaagaaaagcattttattgtaagtcggcggagattgtggcgcttggcccctgcagaaagccgaccgggagggaggtggtcgtcgtccgcgcatccgggacgcgacgcctcgtacgctctaccacgttgacttggatgcctgcctcacgcgcacggtctctctctctctccctctcgtggcctactccactagagctacaggtgtgcagctgcgaggccacacgcgatttttttttattgttgtttaggctcgtcgtcgccgccgccgcgcggcgcgaggcgcgcgacgaggagtggtggtggtggtggtcgcgccggccaaaactccaaaaccatccacccgttgcgtgaagtggcaggagacgcgcgcgcccagatggatagcgaggccgagcaaggcgcacgcgcgcgggcacggcacgggcggaggagacatgcaggatcggccgccggcgccggcgacgttggaggggcgcacgatggacgggttggagaaataaaaaaacacacgattctgactaaatgtaaagcagagaatacgcacgaataatcgtttgattagaccgcatgaaaaacgtatgaatcggatgagaaagatatagttatagaattttttttccaagagatcgaaccttttgctaaatctcctccaaaacctaaatacaatgagctattccatagaaattgtataggatttggaaaactccaatcctttgaatcaaatagtcaaataagaaaaaaaatcttataggatttcaatcctatgaactccaccataaattcttcgattcaaatggatcctaaatccaaaaatgcttcctatgttttttcaatacatgatgccttttgacttttacatatacatttcaaaaaagtcaaaaacacgaaactattatttattttgttgtgattcattttattggtcaatatattttatatttagattctggctccgccttaggaatactaaatcgttcttgattgcatatggacactaaatttttctttttatttttttatgtgtaggtcgattttgaacttggttttttaagtgatgtatgtcctttgtacataataaaaatagattttttcacaacagtttacatttcattcgagagaaaaattgcatatgagggtacatccctcgaggaattagaatccatttccatctattatatttttgctgctaaaaaaccctgtaagttctctctcttctttttttttccgaataagacaccctgtaaattctgtaaaaacaacaactaaaaactcattaatctgtaagataagatgaaagaaagagaagacagcaatgaatcccctatggctcccatcaatgatatgcagcttaatcaccctgattattgacagtccaatctctaatctctcacctgcattatgcaccctaaacaatatgcaaatatggcgtcaagagagagtactgaagcaaacacaccacctgatcacttatcatgtgaggaatatacacatcgacaaataaataaatattctgcccgggtctaactggctcttggagatacccaaaagagaggggaggaatcttgccgcggatagagattgcgagcaacttctctcaactatttttttgctcaataattgtgctttgacctagagatttgtctactaaacaagtatacatactatgtgcccggacgtgaacaacttctacctgttgagtttaatcctctttaatttgctgaattgcagtccaatttatttatatttcagatttggcaaatttataagcaagacaactcatcatgtggtcagatcagatgggcatgaacacacgtaattatctatctggttcgtgtaccatgacatggtaagcctctgcatatatatgctaattaagtctggtcggaattatgaaaatgattgttagagtgagacctgaataatgaactagaattatatacacacacaagctaggaattaggtggtgataataaatttaatgaattgaaaattttgattgtggcagcagagactagtagtaccagtttctggctcaggtaggctccaatcatatttctaatctctctcgcattcgatctcgattacaaaacaaagtgggagaaaaggaagttaatcgtattctaatggcgattttgcgatatcgagtttggaagagccatgatgaatattgaatatctggtactcgaccacgtaacccagagtatatatttcttcttgcgtttggctctctgaatctgcttggggtgcagtaaactggaaaacattgacgtaattcatctttggtcataattaatctgaatcatttttggaggcccttgatctttttttttcctgaatcaagaaatgacgaacacagagatctaaaacctgtttcagaaataccagcagctggaaatctgggacaatttggttgtggataattaattagcaagcaactgctgagacgcatgcagaagcagtagtacagtttgccggattcctgctccctaagtggggttcaaatggagattagcctctgaatgattaatcttccccagctcatgaactcagattctcattctgtcatgcatctacatggagattgctgtactgatatttgtgaggagataggttgatcttgcatgcaaactgccaacacactgcaggtagggttaagttactgccagcttcagttgtgaaattataatatcatcacttcaaaagttcagagaaatggactgcaatttccctgatttttagcacatctgcgtggacattggagaccactgactgaatggattggtccagctgtcctatttttgcgctgtcctcatttggaggagaatctatcatgctgtttcatcggaactcatcgaataggaatggagttgaatatgttgtgcatgattcattgtcctgacacctaatagataaaaagtgctctctgtgttgaaattaattggatagatggatgatgaaggtagctagctagccacattgctgcagcataatatatatcgcagtccactttaggatgagcaactagctagctttcttctctgattgatgatggcgaggtgtcaccctcctaggctcctatccgaaactgcttgaaaccatcagtaactggtttgctctgaagaaaaagcgattaagaaatatcagggatacaaatatccaagcactagatgctaaggttggaattcatggatatttgtaggtttcacccttttcagaaaaagagcaaaagttgcttgaaacatttgtcgtgagattgcacgatttatcctgaagtgtgtatatatgtgatccgtctcctaatctatgcttctttgtttcttttcacaaatatgcaaaagatttatgggtcctcttattaatctatactcattttttttaaaaaaaattaatagtagtggtggtgagtggtgaatccgccaccgtccctaccaccacctccctaactttttggaatgggagagagttcacatgtcaaccacccccaccatcaactctccttgtgagaagcaaaaaaggataacgtaagaccagagggtccatatatcagtaataaatttatgtaataataggttaatgctaatttttataaattaaaattccgtttcaacacgcgaacaatatcctagtaaatttatatgtttctatcgttaggtttggggagcttttaacagttgtagctattttagaatactctcataaataatctagatttttacttagattttgaaaatttgtagctataggattaagaaaataatgaattagaagcccgaacctagaaaatccaccttttacaaattctcacaagctgtctttaagaatctcgaatctacaaggctatatctcaatataatccttaaaattaatatcatcgattaggtagcttaaacaatatttattttggcatatcattctagttccatttccaaacctattgttggttggtatttggtacgggaatagctagcgtcgaaattaacggttaactcaaaactggatttgtggttgggccttttggggctaattgataactatggctactagcaagtaactgttgataattaggactagttaggtaaatagtatgaggttggccaagccctcacgattataaagcaaacagttgtttagaccacataacatgaagactagctggccaaataagttctgccacatttttctagctcaattattagcctagttgcatgataacttatctccagttccaaaactttcttgaccaatttcgtgcaagggatgaaagcttaactctacacctcgtaggggatattcagtcgacggggctagcttcacggcaaatcgctgtcacaaacttcttcactgttatttctttctttgagttcatatgcaaatgcaagtacatgtacaaccaaacacgcatatgcatactcatcaacaggacggggaatcctgaatatccaggcaggcagataacactaatagaaaaagcattttcacctactttgggtatttattttcgcagacggatatagcccttagagtcaaatagccgcctacaaaaatacaaaccagggtgaagtttgccgtccgtctgcgaaaatagattttcaagtagtgtaaacagtgtgtgtgaatgattgcacggtgtgatggattattcccagctgcatgcatatatatatatatatatatatatatgcagataacacctctctgcatgttcgtgtccatacaagtctctttctctggaactgtttttgaaatgtctgaattttcgttttcgcaaaccaaacatatatagacaagagaatcaagtatagaacacaacaagacgtggataattttcactggaccatgtgcatatatgtactacaatagctaattaatcaggtctatttaaattaacgcagggattttaataggaataatcagttcagtttctgtatgattttatatacgtagaatctattatctagggtttgcgttgattaattgctcatataatccagctgccgcatacggacatgaattaccagaaatggttttgtcgatgaacggttgcattagatagccttttcgattgcagaaagccgggcaagtaattaaattaaaccccaacttgaacgagacagataatcagacatacgcatcacatcttatgatgcagcaaattaagtcaaggagagggcgaatatataagccgtccaaattgctgattcaaaaagacagttagctaggtcatcatctagcttaactagctagggttaatgtgtggactgtatattctctgaccacaagtaaagtagccatctccattgatgacatgtcatgtagcttatgatactcgtatattctagtataccctcgttattccaacttccaagtgctcaactgctggccatggattctattggcacttggtttcttgtgttgtctgtattgcaggacaatatgcatgcattggtttctgctgttagaaaaattcaggctgctgacaattgctgtggtatgatcatacaaggattagacagtgactgattccatcggtttgtcttagtataggttttacactattactaatacagtaatacttctttatggctgaagaaaaatgacgtggttcttatattagtttctttttcgggaagaaaaataaagcattacttggattgaacactgacacaagaactgggaaactcttttcatctcttaagggggttttcctcatttttgcatgtcatttaaatattcataaaaaaatgatagatcaatatgagacacgttattcctcaaatatgcaaattcaaattcaacctacacaattagaaatgaaaataacaaattttagtgcaaatagtacatactatttatagtcaaatttgttgtttttatttttatctatataagttaaatttgaatttacatgtttgtaaagtaatatatcacacattaattgatctatgttatcatttttttcattttttttatgtctttttgtgtgacatgcataaaacaaggaaatcaatatccccgaggaatgaaaatccaccttccatatagttatatacatggggatgttggagtaaattgagagaatggacacctttacgcacgcaattattgaactctcggcagtcagcaaactactccaatttgcatgaggctatatgagacaacaccaatttgcattacattaatttttaaaattttgcaatttgcatcacattggccagatgtattgtcagttctaccttacaatttgccaattgcttaatatataataaacatttgatacaatccggggggctggaactcgacaatgcgagcaccctgagagagaaactcgaacatgtaaacgaattaaatagtggtcaatcaagctgacggagctcgaaaatgtcaacataaattccgacagaaaaatttaaactcgaagtcgcaaacagccctagagaactcgaagatgcatttaccctgggagagaaactcgaatctgcgagcaccctgacggatctcgaagaggtgttgagaattacgtactcgaatatgtattcgtattattgtatatatttgtatatacaagcacaaaaatattcagtaataatgtgaatgtgtgacgttttcagaacttaaaattttgtcctgttgaagaatcatcggcagaatcggtcaggcacgcagcaatgggaaggagtggtagaaaatatttttatgttgggacgacttacatctgaatttaagtgcatttttcaagtgatgctgatctgtcgtcaaaatgtacagtgtcaactccttgttttgtcgtcaacgccatgtataccaatgaaactgatagttggaattgatgactaccgagaaaaaggtgaatttttccaacaaacatgatattattgtggggacctatgaattttccttctgtaaattaaaactcctcatcatcgattaagctcaaaagttcacggttcagtaggcagaagtatcgtcctataggtagcagttacatgatattattattgtggggacctgtgaaatgttcctggatctaccttctattcaagcatgtgatcagtagctagagtagttgattagcagcttatatagtttcagctagcaactaattttggctaccactcgtttaaatcagtggcaaattcagaaaatttttagggcccagataaaactatgttaagtattaatttggtatgaaaaagttattttcaatcactatatattaacatcaaaattctattgacgagcctgatcggtcgatgggtggtggcttcgccactgatatactacctccgtcttaaaataagtttattttttacttatcatacacatataaatacaaaaaaaattataataccactattttatcgaatcccaatgtaagtattgttcactttatatactcccagtataatcattctacaatttcacaaactttgatgtaatgattactttagaaatgaatttttttgggaacaaatgaagaaggaagcttaaaaataaacttattacgggacagagttagtactacatgcactgcacgtcattgctgtgaaattctcacacgtgctcatacgtttttatcaatgtaagtgtaattaaggcagtatgggtcataggcagctagcggcaaaatgcaagctcaatcagtgaggtgatccacagacactctggcaggctgcctgtctggatagcctgcacctgatcgagcatatcgaccagcatataaagtcctccaacatgatctgctctggtgtctgtattctgagctaggcccctccaaattgtagagtaaaatcatgtttacatctatatgcatgtgagacaatattgagtggaatctgcaaagaatctgagagagactgtgtggagccatgcatgaaaattcagcacaagcagctgacttggagctttgctcctttgaatcaaagagggtgacagatcttatccaagacagtttagtttacttctgaactaactagtaaaaattgtagaaatggacatgcagatgtttgtttgtaaaaaaaatgtagaaatggacaattcatgactaaatgtttttacgaattatcctttatcttagttttggggaagttagccacaaactaaggatttttttaggtagatcacattgtatgaggactaatggactgttgatttattttgatctgacgagggacgactgtcatgaatcttaccttgaagggggtaagagacaatcctattgcttctatacttgacaccaattttcatactgatagatttgaaataaattagatttgaaaggataggaattataatacaattaattccatcttttttactctaggaagttgacattctttgtccatttccaaaagaagactttcattcaataatttaagagtgaaaaatgcaaataatgatgtagactttttttttcgagtacaagttggatgtacgcaccacactcgtacgtgtacatgtgggtgtgttctagcacacgtttatttttatcaaatttgtctcatagaactttcatatcacaccgtatgagatttggttcatacacacattgaacttccgagtcatgaaacatatgaggtgttaggagaaaaatcctctgacaaaactttccaaatgacatggtcactgatatgtggatccgtcgatggtgggatccatatgtcagcgatcatgttcctctaactttacgtcggaggatcctaatccaaagtgttattaattagatatagaaaggtattttgattagcttagctggtttcctcgttaattagctatatatttacatggagccaaaacttacctcttaatcaattgcttaaatttaatcatgcccccttaactctatattagtaagacaactaaaggagagagctgtaaaacagctcaagagccaaacagctagtactactgtactagctaggtcggcacatcacaggcagggagcaggaaagagataaggagaggcaggttcagagtcatccacggtggagtcgattgagctgatcatacacagcttcacaacaaagctgctaacgtcaacgcatgtcgctgtatgagagagctatagcttgctgcatgcctagctgatgctgtccctcagagaaatcgacattgatgggtgtgtatannnnnnnnnnnnnnnnnnnnnnnnnnnnnnnnnnnnagagagtcttagttgcactct

SEQ ID NO: 6677 - DNA, 12992 bp, Oryza sativa
  unsure (1)..(12992): unsure at all n locations
cgnnnnnnnnnnnnnnnnnnnnnnnnnnnnnnnnnnnnnnnnnnnnnnnnnnnnnnnnnnnnnnnnnnnnnnatgcctagctgatgctgtccctcagagaaatcgacattgatgggtgtgtataattcgcgctaaaattagaagtttggttgaaattgaaatgatatgatggaaaagttagaagtttgtgtgcgtaggaaagttttgatgtgatgaaaaaactgtaaatttaaagaaaaagtttggaactaaacaagggcatcgtctgagtctgaatttctgttcgtgtcttcatctcaagaaaatacttctcaatatactccggccgtacactcgtcgtagtaccactatacgttcaatgcgaggtagaaagatgcaggttcaaattgttgttgctaccgactaattaatctgttcatctgaatctgaatttttgtcatattttgggcccttccagtttcaaatatatatcgatcgggcagtggttttaactgaactaatgtacttacgaggatgatcaaaacaaaattaatgatctaaaagctgaaatgcatgagaacctaattgtgaggctcctagttacacgacaaatcagaatctgatgtagtgaatatttttctccaagcgggttagtagtatctttcagattcacacgcatctcttttccctacaaacacttcaccttttttgcaagatgctactactaattactaaacatcacagcctcagagaatgggcagcacacattgatcataccacacactgttccctgcacataaaaagtttcagtcaaaaaattatatatcttgatacacagtagtcaagatcacttgtgttccatcaaaattgtatctgctcctagtttcagaacgtctcttgactgcaaaatccagtttgtccacaagtattctccaaattttccaagtgtgtaaactgtggtagttgagattaacgttgtaaccgtccattgtgggaaactgccatcatctcaactttctgaccaaacacacacatgtgttgtaattagtcaagaaaatcctggagaagtagtaaatcctaatccagcatttgatcctccactaatcctaccaattaacgagtcgtactcaataattgctcgagagcgattaaattaacgagtgccagagtcatgggagaaagaattagaaaattggaggagatactgattcccccacataacaccacttgatactatttctcttaattaattactcccttaattaatcaatcacacctataattaccccccagtgcacgaatcccgatgcaccacccccctctccgcctatataaggccaccactcggacacggtggcttcatcacagcatccatcgccgccggccaccaccaccaccaccgccgccgccgtcttactctctctgtctcgagctcgagcttgttgttgttgatatggcgatggtgttgccggagacggcggcggaggggaaggcgctgacggacgcgtgggactacaaggggaggccggcggggagggcggccaccggcgggtggggctgcgcggcgatgatcctcggggcggagctgttcgagcggatgacgacgctgggcatcgccgtcaacctggtgccgtacatgaccgggacgatgcacctcggcaatgccgccgccgccaacacggtcaccaacttcatcggcacctccttcatgctctgcctcctcggcggcttcgtcgccgacacctacctcggccgctacctcaccatcgccatcttcgaggccgtccaggccaccggcgtgatgatactcacgatctccacggcggcgccggggctgcggccgccggcgtgcggcgacccgaagggggcgagcgcggagtgcgtggcggcggacgggacgcagctcggggtgctctacctggggctctacctgacggcgctgggcacgggggggctcaagtccagcgtctccggcttcggctccgaccagttcgacgagtccgacgtcgacggcgagaggaagaagatgatgcgcttcttcaactggttctacttcttcgtcagcctcggcgcgctgctcgccgtcaccgtgctggtgtacgtgcaggacaacgtcggacgccggtgggggtacggcatctgcgccgccggcatcctcgccggcctcgccgtgttcctctccgggaccaggaggtacaggttcaagaagctggtggggagccccctcacccaggtcgccgccgtcaccgccgccgcctggagcaagaggtcgctgccgctgccgtccgacccagacatgctctacgacgtcgacgacgccgccgccgccggccatgacgtcaagggcaagcagaggatgccacacagcaaggagtgccggtaagttcaccacccactctgcatctttagtattcagataaagtttttttacattattaccccaacacaaaactagccggtaagttcagatgaattttgatgaaattaatttgaacgagttatatataggatcaagatgcatatgcatcattcatgtgggccacgcattgacacaaatctagtaatagtgctactagtagtcagttttaatttagcatatatagcaagccaggttgtaggaaaatgaatgaaattaaattaaattcataatatatattctacctccatcccataacaacttagtagtagctaggagtagagaacgagacatatactattactacgaatgtgttcagatttatagtattagaatatatttcatcatgtattagattgctatgttacgagatggagcgagtatattcagggagttcatgattggaggcacgcactgtttggcccgttgctgtgacatttgcaaccacacccctcttaagaaaatcatcttcattttgacagctgaaaccactccagccactcactgtcatatatagacagatagatatacggtctcgcaagcctgtaggtgtgtatatacttggaccagcactactagatatctaaaccattaaggtaggtcaaatcaagttatttttaggaagcctaataagtagcccagtcccaacgacgtatggtcgcagccatctgccaggtatatagctagagtcgacatacacatgcccataagtaaattaaagtggagtacgtgcagaaagcaaaggccctttgaccctgaacattaacaaagtcggtagaggcaagattgattctagcatgatacgatggacgagtcacacagaatcaaaaccaaagcagagtaggagttgctaagtgaagatgagcactgggcgaggtagcacctcctcctccacatagtgacatcccatgcgtacataacacagtggcttattagccagtacatgtacaaacacgaagatgcatttgcatgtgccgcgacccagtgaccgatagcttcagctattctcccaacaaattcctcctttctccagtggaaactagcagagccctgaacctgccttggtcacgggtcgcggcagcatctcgcgtgacaaatatcacatgcgacgcggcgctgcatacgcacgcacgcccgtgtgcgtgtgattgatcagctgcttggaacttctccctcttgcctatctcaactcatctagctcttcccgcaaaaaaaaaccctcatctagctctttgcgtctgcgtgatgcaacgtacgtacgacacaccggccgctacaaagacttggatcttgcagtggcggtagctaccgcgctgctacgtgcgcatggctgctcccttgtttgcacgcgcctactataccttcctcttacttaagtccagtgactattagatcttcccgcaaaagaaaaaaaaactgttagatcactaatgtatgagactgtagcaaagtaaatttatatgtcagcgactcaaaattaagtaacttaagtcgaagaatccgcatccatgaataaacattgtgtggtttatcttagctaacacaattctaactcatctcaaaatttaaatgcattttttaggtttttaatatttgattcatccatttctgcctttggaaaaataacatgacaagatgagaataatctataatctagttgatgtcacctgatgatctgaagtagcactacaataatccgtaattttttggtggtcaaaaaccatcaagtataacatgaaaaccgccaaaattcattattctatcggccgtctagggatattcatatttgttggctgctaaccataagagaatatttttttgttagtcggaccactaagcaaattaaaaatattacgaactttataactttgtcggtttggaccgataagaatatatcttactttggctgccaagaaacaccacaagaaaattacttatttttgaccgttagaaccaccaaggtaataatcattgacgtgtttggtttgtaatatgggtgcaggttcctggaccatgcggcgatcatcgacaggtcggcggcggagtcgccggcgacggcgagcaagtggaggctgtgcacgaggacggacgtggaggaggtgaagcaggtggtgcggatgctccccatctgggcgaccaccatcatgttctggaccatccacgcccagatgaccaccttcgccgtcgcgcaggccgagctcatggaccgccgcctcgccggcggcttcctcatcccggcgggctccctcaccgtcttcctcatcgcctccatcctcctcaccgtccccttctacgaccgcctcgtcgtccccgtcgcgcgccgcgccacggccaacccgcacggcctcaccccgctccagcgcgtcttcgtgggcctctccctctccatcgccggcatggccgtcgccgcggccgtcgagcgccaccgcgccaccgcctccgcctccgccgccgccgccgcgcccacggtgttcctcctcatgccgcagttcctcctcgtcggcgccggcgaggcgttcacctacatgggccagctcgacttcttcctccgcgagtgccccaaggggatgaagaccatgagcacgggcctcttcctcagcacctgcgccatcggcttcttcttcagcacgctgctcgtcaccatcgtccacaaggtcaccggccatggcgcccgcggcggcggctggctcgccgacaacctcgacgacggcaggctcgactacttctactggctgctcgccgtcatcagcgccatcaacctcgtcctcttcaccgtcgccgccagggggtacgtctacaaggagaagcgcctcgccgacgccggcatcgagctcgccgacgaggagaccatcgccgtcggccactaatagtgaccgatcgatgcgtcagcatgacatacgcaagctagctaccagttagctgcacgcgtcgtgtatgtacgtcgtccttgtaataactttggttttttcttttcttgtattttgaatttttcttcttcttcttcttcttcttcttcttcttcttcttcttcttcttcgtgtattgtattcgacgtatttcgccgggtataatttgggtgtattctcatcgcacgtataattaattaattaaccaactacgtaataactacgtggagttaattaatgtgtacgtacgtggggtgtatgtagaaggaagatatatacgtacgtagggaagggggagatttatacggcaatgtataatttgccacaaagtgtattactgatgtatatgtttatacgtcttttatactgatagtgtgcagggcaggaggaaattcctgcatatgcgaggtgcgggcgcacctctcaatctgatcaataaattaaacacaaaaaagtttttgttcatatgagaaatgtgtgtgtactgtatactccacataaattgattgaatcagtgggtcatgatttcctttgatatggaacagtgttagctgctgctctttatgtttgattggtccatttgttcgatcgaccggcgacgacgccatgcaatggcaagcaagcgatctcgatcgatggacgtagtgctctctccagtactcatcatcatcctctcgatcctccggcctcatcagttaaaatttaaatttttaactttaaatttatagttgattttagtttttttttcaacgaagtttatttttcagcctgtacttttagatagctagaacacgtatataaaaattttatttataaattatttttcatttataaatataccacgcctcataccatgcattacgaggaacacgggaagcgaagtggaagatcacacctcatcgatcttcttgtaagtatcacgaagatcacgaggcacttggaattaaagcaagcaaaaggcaaagagatcatatatcgatcagttttagtggcattaataaatattgttacgagaggttcatgagctaattaagggcggctcgatcgaactgtctggaagcctccaaggtggctggatcggcagctcatctgcatgctgccaacgaaagaagagaaaaatttagagaaaatttgaaccatgccacataaattttataaaatttgtgatatgtcaccctgacccacatgtcattgactcatgtgggtcctacatgtcattgagatacgggtggcatatctcaaattttacaaaattagggtggcatggttccaacaaacccaaaaatttaagggttcggagaagaaaaccccgaacccacttgaccggctcagctaaaccaaagtagccgatcgaggcggcccaaatgaaagctgagcatggcccagtccatcacaggtgaggcccaacacgtacgcaaaggtcgacgtgtgatttggcctaacctgactcgactacatgataaccgctgctcaaccactatcccaaaggaagatgattagaggccccacgagaaaggaagatatgattgattagggctgattccgtttcttagggcttgtttggttctctaccctaccaatttattggtagtgccaaagtctaggcaaaatttggcactaccaaaatattggtagggtaaaattatttggctaccatttggattgctaccaatataaagtcaaattctcatagtacagtgaagaaacttctagaaaatgaccaaatagtataagggaactaccaaatatttggcttcaatccaaaataacacacatactattcaatttgccaataaattggtagggtgtgtttttggtatcaaaccaaaacggcccttagagttcctgctcccctctttcgttttctgcgtacatattttttaaacaaataaacagtctgtctatttttttaaaaaaaattatagaaaagatgatttaaaaatcaaattaatccattttcaagttttttaactaatacttaattaatcatgcgctaatgaactgctttgtttttcgtgccggaggggaatgttcccaaccgtcacaaacgaaagcagcctagatgaactagctaagcaacggtagcagcgagggcacattggatactgatgaaaatggagcggatgaggacgaataatacgcatatctcatatttgttttcgtatttttatcggatataaaaaacaaatacggatagctcagatacgaaaacaaataaaagttatctcgaatagaaataaagatagaatacgaccggacactaatatagagacaaatattcctaggaacatgaaaaccacctaaatttctaatacaaacaaataaataaatgtctaattaatattataattgttgtagcggggctgaacaccatccccatgctcggccgaaaacatgggtagcgaggaaattggattcgagcgactatttgctcgaataaaattcccatctgcatcagcttctgaccaggaatttgcatttgcctaagagcgcttgttccaaggaaaatgtgttcgagtaagtttgcttggcttgacctaacatcactagtgacattgtatttgagcaggttcattggctaaagcaaatgaagtgacgaggagccaaaaggtgggagagcttgttcgagtccaagcacgggtgttcaactcgggcaatcaaagttaagggaaagtaccatcgaacaaataatatattttagggaagtgttatggggaccacctcaattgctctcaccagctggcactagatgtcgagacgactgaaatgtaccaatatgcccctaagggtaatatgataacttcatataatcctgcaatggcaaacttgtaaatcttgagtacacggctgagcactatttaaaccaaccaagatcctttaacaaggagcatatcagtagagaaaaatacttttactcacttttggcatttgtcttttgagctcactctcaggatagacgagaattcgtactttcccgtctatcctccaactttgtccgtgtccagagatcacgacaataatatataaaatatagtgtaatttataaaaatatttataagttttaaaacatattaatagtttggactagtgttgtgagatgtgctatacgaagtagattagtattgcataagtcctttaatttacttaagattttcctaagagggagcaaagagttattacatattctgttatatcgatttgtgtaataagaagaggaggaagaagggtagggatggctggataaggaagataaacccctctagcttgatgttggatccatccccgacacacgatcccgtctatattaagcatgaagaaaaaaacccgtaaatatcaatgtattagcatcttaattaatctgagcattttgatattcgtaaatcgtaacaggaaattgaatatattaatttggcatttctatacaggacaagattactcgcctggcttggcacagaggtcaaaaaagaaagatgaacgtccattatccatgaccatgagcatagaagcttacatgatcaattacaattaggaaccaagtatataactcagtatctctgtggaacagtacaaagattgaaaaaatggatatcactgagagtaataacaacattgttagctagcaggcctcacagttaagtatcccagtatccacataaatgtcccagtgtttctatatgacaagaggagagcatgttagctcttgtttgcatggtagcaacgggagcagccgatcaactatgtaccgtcttcaataattaatggggtgtcaacgactactaaacagaagtttctctatatacttgcgctggtgcaaagagtggacacattattgccgaatatgtcattgcaaccaacccatttcctctgctcccttgcctcccagtaacctccgacataacggaatgttccatcctctgtgtccctttggaaccatcttggcttccaaccactctcctgcatcttccttgcctgtagaggaagagataaccgctgcagttagagcagataataactgcatttttccatgaaggaaataggtgttctggctgcactttgtaacgagaatcaagattctccggggcagtgattcactcccatcagatggtggacatatataaaagtgcagtgataaaagaccataaaattcagtgtagttcgatgtacgagtacagtgaagcaggtaagaatttaaaaactgtgataaaaaaaattaaggaaatttttagaacaagaatacttaccatcctctgcctcgtctccaggcgcaatttttcagagttagccttttcgtactccccattctctagatgccgctgatctggcctgagtcttgaatccgttggtggaagcttctccttaacaaatcatcaaatagtacgttaggctttgcactacaaaaaactaacaataggcgaattatatgctttgcgcataccttaagacctggtgtcaactcgttcaaagtgattgcaaatgatgacaggttatatcgagtgggattggctggaggcacatttttctcccacaataaagtggcacccgtactctgatttgcattacgggagttcactttagaagcatcatcaccaatgatgcaagacatgctctcgtcccactttcccatcaagaatgcaactttggtcccattagcatccgtaacaagtccttgaacctttcatacgaccatacattttagtaacctctacaggaagatgaaagaaacaagaacctggatggaaaattgttcatcatacctggcgaggattacgatcgaggaaggattgctctttgaaagtcagcttacatgaatattgcctgtttccacttatgttcatcgtgccatggtgatggcaatagactcggccaatgataaggttattaattgttgtcgtaacctgccatggcaaaataaataaatgataggtgtttattgacaaaaggatatccaacaccttctccagatctctagaccaagcatgcacaaacataatggaaaaaatggagagaaaatatgcataagagttttgcctccagtgaagaatttgtaccttactccactggaaagtttctccatcatcaaactgtagagttagcacaccgctaggatcgagttgaatggactgcccccaaaatttgctctttagattgctgtcaccccaaaatttccaacctttcccttcacaatggcatgccatgaccatcggatgatgactaacctggtgacaagaataaactaacaaattaactcatatgttgtgtgaaatgtagagaagaatattaatgtgcctggcatcagaacagtgtctgccacttttatgctttcaaacttcacattgcgtatctcccaattatttacagaagaatttgacagtgctagactaaatggcaacaaattctaacctgaacatgaatgggctggatgccaaactgaccttttcagagaagaaacggatccctttttcaggataatcagcttcgtatgtttcccccaacaatggattgaaaggtttgcaggggcgagaatccgtggaagcatatccagagacagcaaatgcagcaacataaagaattctcatcagcccgtttccctgatgtatatgcaaattaagatatgagtatcaactcaacacagttgaataaattgaggttaattaactgcaccaaaatactgatacagcaatttcgtgggttttttagtacgacaaagtttatgctcctcaattgtgatatacagaatgatataatatctagcagtttatttcacaataaaggtggaagttatagaaataagcatacccttgaaccatattcatatgcacgatccagtaaattggaatactccaaatcttcaaagcacttttgaagagaagacaatggttcattaaagtaaacaggaagacagactcttgtaagatccttgccaacattatctttgatcattgaccaaaggctaacacctttctccttttctattggtacgggtaactctgaacggcgttttgaagatgacaataagtattcattcgtcttgtcgatagctagtaattcaccaaacttgtgagctccactcccactatttgaacatctcattttcaagtcaggacttgcagcagtgtcactgaaactttgccttgtatcatagaaatgaaactcatcctcatctgacaactgccctacctcttgtttgccagcatcatcagaagattcagtgttgctgtactctgatataataaaaataaaaatatcagaaaatagccatgtttcaaacctctcgtgaaacaagaacacaaaaaggagcatgtagttgtgggcaaaatgcggcaacacagaactaaaggaagtggtttatttcaagctgtttccatcctttcattttcagattaatccaaggagaataacataaagtgcaatgatgtaccaggaccagatatagacaagtaaagcaatataaatatgcttggaaagtgcaaccaacaccatttcatgcacatggagcatctgatataatgctaatcaaaacagtcaaaagaaaacaggacaactaaaataaaatcaagtaccactacattttccagagctggaacagtcatgtttgaacaactccgactgtggcttctcaatagcagatgcatctcccgaattaactacctaaaagaacataatacaatcagcagacagtttcagaccaccagataacatacaatcaatttattacttgactttcaggctagattcaaaagtcctaacaacctatataaatcccattaaattggaatatattcagaattactatcagaaatgggaacttaatgagttgcttatataaatcactaaatgagctctaagaacgaattacctcaagttcccttggaagactgccaatgaagtttaaatagtcttcacaccgttgcttcatctgagtgtgatactgtgaaaattctgagtgaatgatctgttcacagtctttaatagttgcctctccaacaccttcagcatgcaagcgattcctaagcttttcagtggaaaatgatccctcattctggtcacacggtacacccccgttaagagaatattcactcctcgcagaaacaagtgcttcaatccaagccacacggtccttagcagagccagtcctcagctgaagcgtcttggttggggtaatgatgtagaaccgtttatcatccgatttactttcgctaaatgatgagatctacaaacaattcaaaagaattacagaatcagcaaccagagtagcaacagtacaccaaaatgcaatctcttcatcaaatgcacatctagtattcgtctgtgctggcaatccactatcccagaaatagattttttacaaacctatagcagtacacttaaatctcgacagtctcctgcattgtaaaaaacccataactgagcactgtaaaaaaaaacagatgcctaaaagacaagcgaacataaagcccgctgactgaagcaggagccaagaggaagaggggggaaaagctcccaggccatataaatggctatagacagtgtggtccgtaccaccttacattcccaacaactcacggacatgcaatgccatccaagtggaggcgccatgccatcaatcctttctgaacaaagtccagctggtgatnnnnnnnnnnnnnnnnnnnnnnnnnnnnnnnnnnnnnnataagacattcaggcacagt

SEQ ID NO: 6678 - DNA, 3979 bp, Oryza sativa
  unsure (1)..(3979): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataaatggctatagacagtgtggtccgtaccaccttacattcccaacaactcacggacatgcaatgccatccaagtggaggcgccatgccatcaatcctttctgaacaaagtccagctggtgatccggtcgttcccgtgccctaatcctctccttcccctgagcacgccatgacaaagatcgccactgtagctcgctaaaagtcgatgcgaagactgctctttcacagtgagtgagctttgcttgcgcttgagaaatgccagctcccagctgctccagctccgatccaagcaaggcatctctttatccgacaagcgttaggcagcagcagcagcagccattgtactatgctactactaccagtgtggatgtgatgctgctgctgttgcttgctagcgatctcggccgtagatcttggcgaacgtacggctcgtggcgcggccacgccgcgtcgggctttgcgagatgcagcatcggttggactggactgttccgatctgtgcgcggaaaccggcgcaccaaactcgtgggagatatttgattcgcggaagcaaatgcgcaactaaaatttggctggagaaattggtgctctactaccggtaaacagatcaggtgatgaaatgcgtgcggttgaattgaattgaacgagcgatttaatttcgtcgatcgtaagcagtaggggctcgagatcgatcgaaatagacggaacacaaaaacaaaatgcgagaggaggcgcgtcaccttgagagggacgaatccgatgggctggtccccgacgccgccgcggggcacgccgatgagcctgacgccgttggctgcggcggcggcggcggcctcgggaggcggctcggcggcgacgcggcggcggatcttggagtaggccaggacgccgccccggatcgcgaaccaccgcggccgccaccccttcccgatgttggtccacttgtacagcacccccgccaccggcaccaccttcttcttttcccccaccggcggcttcgtcggcgagcagtctcctccttcccccttaccacctccccctccggcgccttcacccaacgcgcagtcggagacgaggcagcacagcgggtgcatctccctggcccgcatcgcgcctccctcccccgatctcgagcaccgacgacctagttagctcctagctaggtggtaggaggcagagtacgcgtggtgatgctcctcgtcgtcctcgcggtggtggtggatgcggtggcggccaccatttggaattgtttattcgcggcgagggtcgccgtcttcctcctcctccccccacgcggcgtccgaatccgggcgccgagttggcctcttcgccttcgcctttatgcgaacccccccccccccccccccccttgtgcctaacgcttccgcgcggcttccatccatcccctgtgggccccacatggcagcggctgggctgggccgggcgggtggtccccacgtgtccgtcaccgcgtcaggctcagctgcctccggcctgtactcgtgctgtccggcggggcccacctcgcgttgactttttcaaagcaccggatggggttttttagatgggccgggtgggaggacatgttgggccggaaggcgaggcggcccagagatgtgggagtcaacatcaccgggttcttgttcttgttcttccttgagattgggttggtgtgtgtgtgcattgcattggcatatggaatggcatattttgtttgggttttgggcatgggattcccctgataatttggacagcaacaggtagcttagccaaaaaaacgttgttaatccttcaccttccaatgtgcgatccagtacacattaggatggccggcaactagtagtggacggacagcattagcccagcagcagcagcagcatcgaactctcttgaaaatcacctgaatttttgaagcagattactactactatcatatctccatctctctgagtaaaatttggcgttcctccgcatgatttcctgaaaaaagtttgtatctgttcattgcaatagctagctagcttcgtccaagaacgtgaggttgttgctgtcttgctctgtcgacgatgtgcactgaacattgcatgttttagatgagctgcaatctctgacggggggcttttgtacagcatatgcaggcgaaaggagagctgcttttttggttgctggcaggcagatcagtgacagaattggtggccagctctctgctcgcatgtaaaaagatgacaagtccgtagtatgaactcggttttggtgttaccatgcacgcgtgctgctgaattttgcagtagcacaaatgcaacaataggttatcagttcacctatgagcaaaggaggagagatctagtatttcacatgggacgttttctatgagatgcaagaaagaaaaagagaagagtatggtggtgttcttttcttaagataaatattaatttttttacgtaaaacgaggtgtttttaatgtaagattgattgagttttaattattataaacttaaaaaatagattaatatgatattttagagcgactttcatataaaaagttttcgcacgaaacagcagtttgaaaagcgtgccacgaaaatcttaatcttcaacacaaaatgcgtactctctcccactaaaaatagtattagatattttgtagtattacgaattagaaagcactagggattatcctatccaatctgatactaggtttttatactttttgtacagagagtactagtggtgatcagaaatgatgtctgggagtgatgatctgatcaagccaaactagacagtactattagcactagaaaaggctttaggcagcccaatgcgtgcaggcaaggtgcaaactaagctttattacgagtggtagctgggccaaccaaaacaccaacaaaaaaagccagctcggcccgaattccgaggcgatccccccaccaatccgcgtgccggccggaggagctcgcctgtcgccttcaaattcaggccgccgccggcccactggccggccgtcgtcgtcctccttggaatccccagttacatatatccttctccatttccatacgtactcctactactgttgctgccactatttgtagtagaagaagaagtattctgatgctctccaatggcggcagccactgcatggctgggtcagtgagacagtggcacgaaatctaaagcacatttttggttctggagtccattcacaaggagggctatctttggtctttagctggcgttgctgtttttgggacttgttgagagtatagcgtagctcagccccttcccgctgcttggagtttgtatttagccgctgtagttttctaagcttcagctttttattttgccttttctctctttctctgacataagccggtctagctgattgcgttgtgtaactataacttttttttagtgtaatttttttacgcgttcacggaaaaataaagcacattttatttttcattacatgtacagatgctgtactgtaggatacactcctctttaacaatctgtgctggtagttggttccaaattctgatgctttcttttctgttctgaagactgaagagtagtactatagctgcagctgctgctgctgcctttgctcgcatcttttgatctttccttccaggctctgcttttgttgccatctcacaatctcttccttttccattctctctctttttttatattacttgtgtatcttttgaatattcccatcccatctgctgccctctagcatttgctccctcttccctctcgaatctctctctgtgtgtgtcaaaaaatgcaaaagttggtgctttctcgtggccttttgcaacttgccttgttctgaaatga

SEQ ID NO: 6679 - DNA, 725 bp, Oryza sativa
  unsure (1)..(725): unsure at all n locations
gcggattgagttcganatgataaacctcattnnnnnnnnnnnnnnnnnnnnnnnnnnnnnnnnnnnagatcgagaaaaaactggcaacatggagatgtggttctttgtcttaccggggtaaatctatattaataaattcttgcctgagcagcattcctatgtacatgatggggttatacctgttgccaacttaaacacattataagatggatgcaattacagctagatttttctgggaaagactatagggtgaaaaaaaatatcacatgcttagatgggaggctttatgcagacctagagaggatgggggtcttggctttgtcaacacaaaaatgatgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6680 - DNA, 1664 bp, Oryza sativa
  unsure (1)..(1664): unsure at all n locations
cgcgncttgtttgcactggtacccggcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggtagctggactctgggagtccgagaaaatgaaaaaggctctgggagccgattaatcaagtggaatggctctgggagccgaaaagtaatgatctgacccgggaggtcggtacattgccaaatgagctgttgaaaaacatctcttaaagtcgaatcgagacgcaagtctcttttcggccctaacttagaaagaaataaatcacttagtgttttcaaaatgtcttcaaataaaagatttgcaaaacaaccttgcctctcttccaagcttgcattaaacacctaagttcccgtgacttgctgagtacgaaagtactcacccttgctctatataaatatatatatatagttcctccgccctgaagagaagataaagtgaagtgaagattagggtttcgtcctggttcccagccgtcgcctgtggtgttgggtattagaccggtggttccgctgctgctgttgttggtgttcgcctcgtccgtgtcgtcggttgtattctcgggctgtctgagctgcaacctaagttaaggtaaataagtcctctatttattttaaagattgctatgattcatatttgtcaccgtgggtaccagcactatgtcctgggactggtaccgagatcgcggtttcgtaggaagcggttcgcgccgttttccctacgacacgctcctgttaggtgccgttgtacggcggtatcagattggggtgtgacaataagggtccctactgtttcaaaaacgacagagctttttgagaaagtgaggcaacattattcagcagcttatcattaaacacccaatcattccgcacaagccaaattgcccaagccccagcagcaaacaggtaccaaagacatctatttctaactcccctttggttttagattaaatcaagaaggtcatttctagaagtagggatcaaatcccagtgaaaggcgtctctgtagcagcaccaaagaaattgagctggagggcatctaaaaattatgtgatcagcatctttctccactccacacagtttgcacagtgggctccctgaccaattcatcttcttaagttgtttggctgcctgtattctcccctttagcattagccacataaaaattttaatttttaaatggatgaaagacttccaaagatcctgcagttttatgtctttaatccccccaaaaatcatctccctatataaggacttagtggtaaactgtcccgactgatttagtttccaaatcataacatcttttcctaagtgtagcttaataagagccagtttttcctgcagctccacccactcctccaactcattttggtccaaagcccttctcgagtcaatttccactcccggctaagtacatctttttacaatattgttaggcttagagcagatgctgtgtatgtatggaaactgtgttcttagtggaacatcttcttaacca

SEQ ID NO: 6681 - DNA, 8575 bp, Oryza sativa
  unsure (1)..(8575): unsure at all n locations
agggaacggcctganaactgatancttnnnnnnnnnnnnnnnnnnnnnnnnnnnnnnnnnnnnnaacatgtttgtttttttctttgagtaaaacaagatgatatcgataatttaatattctactactgtggtagttccaggaaatgtgtagttgtatacagtcacatcttgcagtacttctttgcccactgtgcaagtatgtgtttccacaaaatggaacctaatgttggggagatcaggataggctttagtgctttacatatatgtccccctagctaaattaatcttctcacaccaagataagagttgctgatcaattgaaggaggcattgaaatggagatttgagcgtatctcaatgtttaatcccttccaatttattggctcacaatacattatctaaatcccttaaaatttacattatctaaaaaaaatggctcacaattggccatgagcacataatctcccactggtcaaatccaatgcacctccacaaaagcatcacacaaattactttataaattccctccattgtttgcgccaacaggcatgtgacagcctatattgcttaattccctgctaaagaaaaggcaatgcatcaaactctgaaattgcaagtaactcccactagccccattttgcagtatattgacctgaagatttgccaggttgatcctgcattgaattgtggccagttttacagaccaattttccgtttctgaaacagtgccattgacaggtgggcccaccccatctttagcagttaattactttggatcttcggttttgcaaatctcagggaaaacccttgagcaacttctgcttctctcaccctgccattgctgtgtatttaagtggcattgtctgtcacctccttctcccacttgttttctttcagtctttctttcttcttcttgtttgctgatcttgttccttggtggaaggatgcttgtcacctactcctttttgagttccccactctcctcacacttgttctacctctcttccccataaaactattatcatctttggagccaaaagccaaccaagaggagaaagcaaagggaggagaaaagaagcaagcaaagcaaagcaagaagcaagaagcagctgctcagctcagctcaagcaagtaagtgaattcttgcttgatcgatccatcgatcgatcgatcggtttgctggtgatggacaagcacacttgcaagctctgcttccgccgattccacaatggccgcgctctcggcggccacatgcgctcccatgtcatggccgccgccgcggccgccgcgtactgtccgtcgtcgccggcgatgtcactggcgtccacgtcgtcgacggagatcgagatggatgagaagaaggagatgacgaagaagacggagcaggagaagacgctgacgtcgtacgtgttgcgcgagaatcccaagaggagctacaaggtgagcgccggtgaattctccggtggtggtggtggtggtggtggccgcggcaaatcctccgtcgtgcaggacggcgagagcgacacggagtcgtccccgccgcgcggcggagcggggtcgttcttcgccgtgagccggaggcggtcgaagcgggcgcggcggcggcgtccgcgccggatcccgaaccggcgagcagcgtcttcgacgcgacgacggaggaggacgtggccatgtcgctcttgatgctgtctcgggactcgtggacgcgttccagatccgagcacgagacccaccaccgcgggggcgagctcggaggcgagcaagaacacaacaaacgtcgtcaacgtgttcgacgaagaagacgagtacgcccgcgacgtggccggcgaggatcacgacgaggagctcatctacgtcgtcgncaagacgcgggcggcgcgccaccgcaccagcaggttccagtgcggcgcatgcaggaaggtgttccggtcgtacaaggcgctcggcggccaccgcgcgagcctcaagagaggcaagggcggcggctgcgtgccaccgccacgtccggcgccggcgagctccgccgccgcgccggccatccacgagtgcccattctgcttccgcgtgttcgactccggccaggccctgggcggccacaagcgcgcccacatgccatccggcggcgcgcggccctcgccctcgccgtctccggcgaaatgcggcgagagctccggctccatcgatctcaacatgccggcgacaatggaggacgacttcgagctctccgccgtgtacgacgccgagttcgccagcacgagacagtgaccacacaccaccaaccagctgatcatccatggctgccaactccagatcaccaagaaatcggtaggacaaactgcttcctagctgcatgcaaggatggattcattcgaggtaagaagctctgcatctcttgcaagaaccagaataccagatcatggagaattctctgtcttgttgcttaagcttcagttactgttgctgttgctgctattgctagagctgaaaattcagttgagcagctgaaaattctttttttcattttgggcgctctgtatctaaatcaaattgatatttttgctccatttatctcattgaacgcattcattcgtttcttaacctgtcttaccattaacctctgctactctgaacttcacattaccagtaacagtttacttattcctctaacttgatcagattaaaaaatgctcattgataagtactaaaaaaaccaaaatttatagctcagatttctctgtgccttccatgtttccagaggtggtggtcacactgtccttttgcctaacaccagtacaccccatcactcatgacacaactcatgctcatgccacaccgtttttttgttcgatagtgaatcacaaagtcatgcactgtgcacacacttcacttaattatgctcagtggcccggtacctgcactgggccccacaatgtcagtgagagattagctgttgtagtttatcttagcttctttttttttttggttagtggtagtggattaaactagaatttagctggttggagctttgcttctgtgatactctgatgcagctgggcagcaggcagcaggagagcagctgtgcctgtctctgttggctgccaatgcaaaaaaggctctcctgctcgcactagtacttgttcgttccagcgtgtcagggcgtgtggcccacatggcacgggcgtgacgatgaatggtggggccatggaagcctggctctgccagtgggcccgggctggcagtggctcagatgagcttgccaactgctcgccgttgctttggagcctagctagcgcgactctcgattttgctccttttcgtttggttcttcatacactccctcacctttctatcaagatcaaccatgcaaatcaggcaactagtactaggtaactactcgttccatctacaaaaacaatctaatattgtatgtgacacatcctaatactacgaatttaaacatacctctgtcatatccagattcgttgtagtaaaatatgtcacatttagttctatatttatctttttggtccgaaaaattactactagtatcatctcagtgaaaggtaggagtctggtgggtgggccgaaatgtcagtgtagtgtgagcacatactccctccgtcccataaaaaacgaaactagaaccggatatgacacgttctagtactacgaatctggacaaatgtacaaattcatagtactacaatgtgtcacatccaatactaggttagctttttatgggacggagggagtagaaagcagtagcagtaggaatcttcttctaccatgcattgcagatcgatctccatcttctagaatttttttttcttcagaattttcagtggagcgatcacttggcttggttcccgtggagagccatagcttccaacacacacattacagatttgacgtttagttaggccttaataaggggatcttctacattgactcgcacgtacacttcacccatggactggagaccaactaatttaggggtgtggtgccatgcctaatgcattgctgccacggtggcagtcaagattgaacccggtcaacgtcgtggtgggccccattcccttttggacggagttcgtacgtccgatcattcagttggacggccgatgattcggtggacaaagtaggtaagtcgcatgcatgcatgtcaataatctcaattgggcggatgcattcgagtgtatgcttgcgtagggagtcgagtagatcgacccgtgaatcgatttataggtaaaattagtggataattaacttgtgtattgatcccggatcacctgataatttgatctataagtaggtatagagttaatccacttgtatccctatgtgcaacaagtcaggctataacgcgggaacacacaagttacccacttatttatataagtagattcacgtgtcggttcacttacatttctaagttctaacgtgtatgcatggtggctcggtgccaactagatctaccatgtcatgagagatttctctcgcatgctgagccatgcatctcgatcgatcaattaatccacgatcgatgtatatcaggtggtggtgttgattgcttgctgatcgatcgattgatgtattttatctcggcggcaaattggagaatagaattctgtcgcacaggtgggtcgtcgtcgcgtgcacaacatgcaactggggaaatataaaaggtttttggaagtgtggtggccactgtctgatctcacttggtcagtggtgcgtgcatggtgtaatgttggatgatgaaatctaggctttgtcaatgggggtaatcattaattagggattggtcttattaatttatccactctagtttgacatctttctaattggtgtatggtgctcatgctagatgctttttaaacttgctgggagcaaattaaaaggattctgtataaacttggctgaaaaaatgtacaggaaatccccatcagatatattgacaggaaacttgcttccaaattgaagtctcatctgctagctgcagagagtgtagaagaaagcatgcaggcaggcatatgcaatgttcggttgctggtacggcagcgtcgacattactacctaccctggctaacccagcaccaacccccaattcctgacacgacaattaatcatctgattagagtttcccaattgtataatcttcctcgatcttgttgtactgggtcaacgatcgatctgtacgtagccgacgacgatcgacgatctgcaattctgcatgcaaggatgcatatgctgccttctctgaagaatcgatctcgatcggctctgtacgagattcccccctccatttgttagctccaaccaagaagaggaccagctagctagcagaagtaaccgtagtttccaagtcaagctatgtgtataatgttcagagctatagcttaattagctactcctcgatcttcgcttcactcatctgtggtactaactgaactttactttagctttgtccccccctgtgcagttacaataataatcaaagatcatgcatccacagtgcagtaccagatgcattgcaatgccaatgcaatgctaccaaatcgtgggccatgcatgccaaacaagatcggagctaagcacactgtcagttgtcactcgactaatgatactgaactgtctgaaccctgctcgatctgctacaagcagaaagcaatcaagctcttcagatgatcagcggttgcttcagtatatgctttggaattcaggttgctggtaggtgaattaacccagaaaaaaaaagggaaagcaaacgttgcataaatacagtcatgaaggtaacatgacaaagttaaaagacaaggtagtggtactgacagtatgatgaaatgcagcccagccagccaggtaggctctacagatgacctacaatagtactacatatacgtgccaaattagttggctgtcgggtgatcgaacagtgaaaggggtgaagcgaaatcgaatgtagcttgtggctgcaggcatctccctgtacattattgtattacacaaatcagtagctagtagctcagcattggatggatgcttgcctgatacaaaagatgaactctttcggctggccattcccagatgttgctaatgtagatgtgcaatcacatgctgtaaattatccgaacagtgctgcattagggtgagatcaagatgcttgacagtgaaagcagtagcagcagcagctagcagcaactggtccatccacacagacaaacagtggctcaagatgctttgctagagaggaaaaaaaggttgcattgctgttaaactgatatgatctttcggtggaaaaacaggagatcgatgggttggaaaacttggaatctttgcaagcaaaatatactttacgcgctatcgattttagatgggccatctagtagtatgattagtttctcatggtgggaaatcagtatctcatgattcactgggcaacaaagatgggatgtttgtgacattggatgacaaaattgatcatgtgcgatagcagtgaactcttctttagagaggaaaaatatcagcgaaattgacaagttgagggtttcagttggctggtcaactgaatcttagtagcagtaatagtagtatttctgacaaagaatgttgacttcgtgagtagaagtaagatttttgcagtgtggaaggaaatgttcagaagtcagaagcacttaccactctcttcatctgtgcttcacttccaagttccttttacgctggatgcagacagatcactagcaccagattctgaatgtcgatcttgtgatcttgtctgtagctgaaaacacaaatgcgaagtcaaacattcagaatcagcatagttcatttatttagataggcaatcacacatggaacagatgtacttgcagcagaaagctcggagataatctccatcagaatcagttaatttttcccgcatactccgtaccaagttcacgaatgtagtagtactccctccgtcccataatataacaatctaggggtctgttcactttgatgccattttcaaccttaccaaattttggtaaagttgccaaaaaagtggctacatttagtttgctgccaaattttgataactatataagaaatcctgctaaaattttggcaagcacagttgccaaaatttcagcaataacaaaatttggtaaggttttttctggcatcaaagtgaataggccctagaactagatgggacatcacctgttacaggctccatgtccatgtccagatgcatcgtattagatgatgtcccatctagttttaggttgctatatttttagatggagggagtagtatttagtgggttgatgtggggtaattgctatgtttttatgttgaggtttgtaataactttttattagggtctacgtgtcagcgaccctaaatagtctgatgcgatcttgttgggcctgctcgaatctcagccggtttacttcccggcccagtatggcccaaaaacttccctatccacaacgaccgaagcgctttcctccccgcggctccgcctccgcaatccgccatggcagccgcgaagccggtggagccgctgccgctgctacgagccggcgcggataccgccgccgccgccgctctccggagattccagcttccgccgcagccaccacgcagtgtcagagccaacgctatcagggcctctcctccttcgaacggcgccgggagccccgacgagctacccgccgcgctcctgcccaacgcggcgcggcggcgggacggctgcgggttcagcctcggcgtggacctgggagaagcacgcaccggagtcgccgtcggcaggggcatcaccctcccccgtcccctcaccgtacgcattctcgctcgaaccccctctcgtttgctgcgtcgtcttgggtgggcgatctgaaatcggagtcctctgcttaggttctgaagctgcgtgggcagaagctggagctgatgctgcttgacatagctcagcagcaggtgcagatgaatgatcaaactcaacgcgtattttgattattatttcctccccaaatgtggcggcggtttgtgaatttgccgctcgtttttctcccctcttctgcaggaggcggacgagctgatcgtggggctccccgtctccgccgacgggagcgagacgccgcagtccaacaaggttcggagcgtcgtcgggaggctcgccgtccaagcggccgacaggtgcgttgcattgcgtgtggctgcaaagctgcagactgcactgcactgttcaatgttcagtcagtcagtgtggttgccctgcatcaatatattagaagaaaaagagtttttgttacacaacgcaattagccggaccggcttatgctaggggaagggagaaaaggcaaaataaaaactgaaactatgaaaagacttacgccggcaaaatgcaactccgaaaggttgccctgcaatgtgcaatgttcagtgtcgtgttcataatcatgcgtctatctgaaaatgtgcaggggattgcgggtgtatctgcaggatgagtacgggacaacgatcgacgccctcgagttcatgatctccaggtaaatgagtacgaagctccaattcaaaacctctcg

SEQ ID NO: 6682 - DNA, 1045 bp, Oryza sativa
  unsure (1)..(1045): unsure at all n locations
gagaacgagtgctcaatccaagcacacggtccttagcagagcaagtcctcagctaaagcgtcttggttggggtaatgatgtagaaccgttattcatccgatttactttcgctaaatgatgagatctacaaacattcaaaagaattacagatcagcaacccagagtagcaacagtacaccaaaatgcaatctcttcatcaaatgcacatctagtattcgtctgtgctggcaatccactatcccagaaatagattttttacaaacctatagcagtacacttaaatctcgacagtctcctgcattgtaaaaaacccataactgagcactgtaaaaaaaaacagatgcctaaaagacaagcgaacataaagcccgctgactgaagcaggagccaagaggaagaggggggaaaagctcccaggccatataaatggctatagacagtgtggtccgtaccaccttacattcccaacaactcacggacatgcaatgccatccaagtggaggcgccatgccatcaatcctttctgaacaaagtccagctggtgatccggtcgttcccgtgccctaatcctctccttcccctgagcacgccatgacaaagatcgccactgtagctcgctaaaagtcgatgcgaagactgctctttcacagtgagtgagctttgcttgcgcttgagaaatgccagctcccagctgctccagctccgatccaagcaaggcatctctttatccgacaagcgttaggcagcagcagcagcagccattgtactatgctactactaccagtgtggatgtgatgctgctgctgttgcttgctagcgatctcggccgtagatcttggcgaacgtacggctcgtggcgcggccacgccgcgtcgggctttgcgagatgcagcatcggttggactggactggtccgatctgtgcgcggaaaccggcgcaccaaactcgtgggagatatttgattcgcggaagcaaatgcgcaactaaaatttggctggagaaattggtgctctactaccngtnaacagatcangtgatgaaatgc

SEQ ID NO: 6683 - DNA, 5216 bp, Oryza sativa
  unsure (1)..(5216): unsure at all n locations
atgctccnnattgaaatgctcactcggtaccacggcgaacgcacacacgcccaggacacggacctcgccggcgacgtcgtcggcagcggcggcggttgagctcggcgtggacggattggtggtgatggccgcgagctctggcttagctctgggcgttattatgggggagggtggatttatttgcttcctaccctgtgctgggtcactgtgccactggcattgcactgcttgcctccaagctccctcccctatcacacccacacactcccaacctcacccccaatgacaggtgggtcccaccactgaagctacattgtgggacccagtggcagtgagtgggcatttttgcaataaggtttgtactgcagctttgggttgggtactcttttgagctgtggtgtggtgtactgaatgagagagatttgatttgggataaatcttttcgaaatttgttttcatttgggctcatgatttggggggaatgggcccatttttcttttttttgagtgaagtgtggcaatgatcatttggatttggatgcctttaggacctgtttagatcccctagtaaaatttttcatcctgtcatattgaatgtttggatacatatgtaaagtattaaatataaaaaaaataactaattgcacagattgcgtgtaaattgcgaaacaaatcttttaagcctaattgctcaatgattggacaatgtgatactatagtaaatatttgctaatgacggattaattaggcttaataaattcatctcacggtttacaggcgaattctataatttgttttgttattagactacgtttaatatttcaaatgtatgtctgtaaattcgatgtgacacgccaaaactttttacctctagatctaaacacagtcttagtccaagaatttcttctcagtacactctctttctactggttttctttcttttcctttttgtttccttcttttgtatctttctatttttcttttgtgtttttcagagctccttttttgtgatgaagctgtgtgtgtgtttgtgtggtcggtgtctttcaccttttttctgtgtgtggatgtggagtccagtttctcccttggttgcaggcacgcgtttgatctgtctgttcgttcgttcgtggtgcttctgatttctcgtcagaatttgcaaaaaagatgcatctctttttgttatctgtctctttttttcttgccatgctagtgaccaccactttttgttatttatttcacaactattaattttgtaggagcaagaagaggacatgaactctttttatgtttttttcaacgaaaaactttgaattgaagaggtacatatcacctaaatgctcatcatttgcatttacagcgcgtccaaaattcagcttcgaacagctcgtcaattgaaagtagttaaagtttcagttcgaatacgcctgcatttttccggggtttctttattaacttctaccgtgtaatcatttctgcatatgcggctcattaaaattgtcagcaacgcggcaatatgattaatttgacggttagcatgtgttagcgctgaccagcaaaataaaaattcccccaaaatcgcacacctattttgttttttcctccgaatattcgcattattcacgttacaaacaatatgttcaacacgcatgattaattaattggttaactaatcgggtcagattttctgagattacgtacacaaagattcgatctctctgaatcgaattaatttccctattgcccagcatgcagctgcgacatcccattcgtcaacaaccacttggccaactgatcaaatcgtgtactaataatagtttattaattttcctatttttctctgaattaattgtgtgttaaagagttgacgtagttgacaaatggaggtctcgaactgcatgtgtaacatgacactgaattaccagtccacattactaagcttattagttaacttctataccttgcaattaacaagtgcctggagtctctgaaccgacgacaacctaattgcatcgccaatataatgtacttctactcaacatataacatgcaattgcatacatgttttcagatttgcgacccgatcatctctgctgcttatgcatagaaaactgacgagatgtttctgcagctaaccaacgcgttaattagtagtttaagctgaccctgataagatgcaacttaacttatgagacgcatttggacatggagcagttgccatcattccatggctctgcaactgctagtaccgagaaagctcatttcaagggaagacattgctgcatggatgcatgatcaatatcgtcagaaaaactcactcactcactcacttcgactcgatcaatcgatcgaatcctcctccaatgcctcgccgcaaagatctcaccgaatcattgcggcatcaagaacaggagaaaatgcacgcagtgttctcagcacggttctatcatctcgaatcctcaatataattgtccgagttcagtaaagcttcagtacgattctactgcaatttgtttttagttgttgctaattcaattggttggtatctttgccattggagacatgttttaatgcagtgataggctctgaaagtggtcttccaacttatgccacacctaacatcgatcacttctttacaattccttcagaattcaggctcatcttgacacctcaaaaaaaaaaaaacactgaccaaaacatgtcggtctctgaacaccacaagctaaaagaacctgtcctcttgcagattggatggcatctctcttattactaatcttttgccctcttgtagactgattggctgatgtgcaagtcagatgatgatcacctgcatttgccaacgacgacctaatcaagagtttttcctagcagggcaagtattcttcagaaaagagaatgtgtgcaagtgttaacatcaggatgttgtggtctgaccaaacaaaccaatatatgtatacaagattgattccagccaatgtgctacacttgtacagcatcccagctgcctttgcttatgcttggtatccaagagaagtgtactgtgctagctagctagctgatgtacatgtaccagcatatctaatctaatctactgtttgatcagcttctttgtatacaatgcactggtcttattgtagtagagtactcctccgtttcgaaatgtttgacgccattgacttttttaaatatatttaaccgttcgtcttatttaaaaaatttaagtaattcttaattcttttcctatcatttgattcattgttaaatatatttttatgtaggcatataattttacatatttcacaaaattttttgaataagacgaacggtcaaacatgtgctaaaaagtcaacggtgtcaaacatttcgaaacggagggagtactaacactacaagacaattgtgtgtcaatgccttggggtagttggattggatggatggttctgcacttcagcttctccgtggatactgtagtttaacgaggtttgcttactgctccccagattatcacactctgattgtcgctttcagatatggataaccagaggtaaacagtcaggaaaagtaactaattgaagtagtactgtagtacataatggccgttgcttagacagagaattggagcggttagcgaaagcgtcgatgtcaggtaagacaagaggcatccgtcatctatcggtaaacggggagcaagtgcatgcatatgcttcaactcctttcacggtaagtaaattagatatgggctggtaaaaacgaagcaaaagttggcatacacttgcatttcagaagcaggccaggttgcaaaaggccaacgagaaaggcaccaacttttgcattttttgacacacacagagagagattcgagagggaagagggagcaaatgctagagggcagcagatgggatgggaatattcaaaagatacacaagtaatataaaaaaagagagagaatggaaaaggaagagattgtgagatggcaacaaaagcagagcctggaaggaaagatcaaaagatgcgagcaaaggcagcagcagcagctgcagctatagtactactcttcagtcttcagaacagaaaagaaagcatcagaatttggaaccaactaccagcacagattgttaaagaggagtgtatcctacagtacagcatctgtacatgtaatgaaaaataaaatgtgctttatttttccgtgaacgcgtaaaaaaattacactaaaaaaaagttatagttacacaacgcaatcagctagaccggcttatgtcagagaaagagagaaaaggcaaaataaaaagctgaagcttagaaaactacagcggctaaatacaaactccaagcagcgggaaggggctgagctacgctatactctcaacaagtcccaaaaacagcaacgccagctaaagaccaaagatagccctccttgtgaatggactccagaaccaaaaatgtgctttagatttcgtgccactgtctcactgacccagccatgcagtggctgccgccattggagagcatcagaatacttcttcttctactacaaatagtggcagcaacagtagtaggagtacgtatggaaatggagaaggatatatgtaactggggattccgaggaggacgacgacggccgggcagtgggccggcggcggcctgaatttggaggcgacaggcgagctcctccggccggcacgcggattggtggggggatcgcctcggaattcgggccgagctggctttttttgttggtgttttggttggcccagctaccactcgtaataaagcttagtttgcaccttgcctgcacgcattgggctgcctaaagccttttctagtgctaatagtactgtctagtttggcttgatcagatcatcactcccagacatcatttctgatcaccactagtactctctgtacaaaaagtataaaaacctagtatcagattggataggataatccctagtgctttctaattcgtaatactacaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 6684 - DNA, 717 bp, Oryza sativa
  unsure (1)..(717): unsure at all n locations
gcagtgnnatganancattttgaanctagctggccccttgccggtctagctcgctcgctcgctcggtttgtccccttgtgatctctgcttccaaaacgggctgacccaagtttgaattgaatcgcgacaccaaccacgcgctgcgcgggcacgcacgccgcgattgacttgtagagtcgtacgtccatgcaatatattgcagccaccaatccaccgcccggttaggcgcagcggcgtattggcatcatattggagtagcggattagccgtgctgcgtcggatgcgcgttggcagcagttgccagttgaacccaccgtgaccatggccgtggtcagaggtagccagcgccacggtcactctcttccaactctcaaagctactagtgcaccgtacgtcagtgggccggccaacgcccatgatcgctactgctacttggcacttgcagagtgagtactactgttccaggttgcagatgcagatgcaggcaagaagatactttggggtttcacgaaactgcaggctgcagcttcccttcagacctcctcttctcttctactactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 6685 - DNA, 5747 bp, Oryza sativa
  unsure (1)..(5747): unsure at all n locations
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataggttacgagccccggaaaactcgatctaggaaaacttttggggctcaaggttcatcttcaactagaggaaggccgcccaaacatcgtcccactgccaggaaatgatcaacagcatttcaagttcatactaggatgccacgagacgagcaattcagaagatgaaatataattttaaccttgtgaatattcatgtgtgttgtgcgcatcttcaaactcggtttgttactagtcactaaattgaggatattttctttattccttttacctcttgggagtgctgtgggccgttagcttcaaatttgagttcagcattggcaatgaaggcatagtcataccattataaaatctcagaattttgatcttttaagtattaaccctttcttaagaatcttaagtactcgtgatctgattccgatgaggattttaattttaaaagtcaaactttgtatgcttaaataaacagtagttaatatacaggtatatttgctgtatataaaaataaaaattgtaccaatagattcatatttcaaaacgcattcacacaatattggttttgtagatattaagaattacattttatgagaaatcattgggcaaagtttagttttcaagactttctacaattaaaatacaccttataaaaatgaacggaggcactgtttgtttttttgatcataatatgcctttttttttctcttgaaacatatgtggagttactgagtcagtgagagtattgtttctcaggtaatatgcatcactgccctgtggatcaattctaatgctgtctgttacagcttgcaatgatgagacctgggctcgggctgtgctgatggtcccaaatttcctgtgcaagacattactaatcagtttttgcatgcaaatttcacactccagaagaaagcaaaagcatttgtttctcctgtggttcatttgatctttgaccccattgatgagcaagtgcagagatcataatgcccggtgtcacgggacatcagatcgaaggtcagttctatgagaccagcagcaattgagtaaaatttatgatgcatccagttatatttaacaccatgctcaccagtgttcagctagaatctgagtgacctcatacacctactgcctttacaattcaccccaaatccccaagaatccaggttgcagcagctatggtggtacataatccagcctgcaacaaacagaagctttgctgattgttctaaaatttgggtagatcacccagaatcttctaaccctatcgtttggcctaaacagccaaagaataagccaaaatttaaatttttaaacttgattttgaagttaattttgaaatgcttttaacataatttttgttaatgttggcttttaagtcgctacgaacaaatctacaaaagttttacttataaattaattttaattttctaataagccaaataagccattttgggccaaatgggcaaccgatgagagccttcttatctcgatttagaggatgaattgatcccattatccaaaaaaaaaaagcttcacaagtatatatctccctccgtctcgtatcctaaaataactatgttttgggatggaggaagtatatccgtacacaaggcttaagcttcatgttcagtaaactgatcagtgcaagaaaacttcagaaagtgtgacatacattagtgccactggtgtgcacaaggaagaagaaatgatttgctactgttggagaagacctaagatctcaccatgatggcctgagctacttgtagaagtagaagtatactaaagcctttatgacctttgcattggccatctagtcggtctagtaataaaggtttggccatggtcggtgggcaaaggcaagtgcttgcacatcctgcatcattgttagatttactcctgttgtcagatggacatgcatcccctctcactccccatgatcatcatcacatcagatgatcagatcggattcagagctagcccaatcttcagggagacctgatatggccaagctagtcaaacagccaaagcatagtactccctccatccacaaatataaggatttcgttcacaagtacaatatttttttggtcatgcacgtcgattgccctccgtccttaaatacaaggaatttgttcataaatataaggatttctacacaaatcgttatatttgtgtatagaggtagcactatctcaggttttctttgaataaaaggtagtatagtagtactagtatttcagcaaggacattcactgttaaggcagtcaaatgatcaaggagccatacatctagaatacctataaaatgtgcagatagatagtgtatatacggctgtttgctgcaaattgtaccagcaacagtagcaatgtggcatgatgattgcagaggaggaataactggtgtgggctccagagatcaatacagagacaccggtaggcttggattgaaacaaaagcaagcccaatgtttattactgcatctgtttgaccacatggagatgttcagttgaggcaggcagttaaccagccattcaggagccctagtatctgaatcctttttaatggcaggtcaaagctacagtcttacctgtactggcaacaattaggcaacaatttatacagacatcagctgcagcaattacagtgttgcttgctgaaatgctagcaacatgcatgcatggcgaccttaatggcatgttgccatgttcccaaccggcaatacacaaaatgaccttcttccctcttttggacgcatgaattttacaggattttcgtaagatttagttcgtcagctcagactggaatatactggaattacaataatttataggatttagttcatttgttatgagttatgactgaatatactggaaatgtagtaatcttattactgtatttctatcatcttagtaccggcttactgctttactgcatgcagtgccacggggctactggaccattcttttcaggcctggagtttctgagtgtcagttaggtctagtattcatggcattgcagcattcactgtttccaaaggtgagttctccctcgcaaaaaatgctgcaatattcagaacacacataaaaaacactccttgagaaaacaagaagaaaattcagaactcgtcctattcaccattcccgaaaattgacgcaagaacaacagtgcaaaatacacttctgtcttactccgaaaataccctctctctccattcaaaaaactcatgtgtactcccttcatcccaaaatatatgaaattttagttggatgtaaattatcccagtactacaaatctagatagggatgtgtcacatacaaccaaaataccttttttaggatggaggaattatttcttatgtaattaagactaaggagaaattaactcatccaacgtgtatacaagtaataattcgatacataaacttaaaatgaaaaatgaattgtatgcctgcatgcaacgagtattaagatgcatgcttgggttctgatgaataatttaatctagaactataaaacgaaaacacaatctcttcatttaagttttggaataaatatgattattttatttgaaaaacaaactataccttagctaacacttttgggcgaagataatagcatttttttgttaacatagaaaaaatcactatatttttggatggactaggatatataccaaaaagttagacggaggtagtacctgtaaccatccaatcaatcatccatttggagggagagaaagagaacgatggtccagtagtgttggctacagtgagctggctaatggccatgtcctgagtactctctcactcttgttaggtgctttgatcacaagagacattgtaacatgccaatataatccacagccacccctaccctgcagccctactacatgcaacaagatccaaattaaagagacaaagtgtgaaaatgttgtggcagtatgctggggcgggtcccacctgtcagctatgggacgcaaccatgagaggaaaaatcatgtcctctaaataactgctcacaagtcatgatcagaagaataatgacaactatgggctaacaactcaggacatggatattacagtactggcttgtcatgaaaaaagcatcaatcaattaatagaaatcgttatagcattaggggatggtctcctgttcctgcacaattaaggctgtcaacttctgatggtcgtgtcagatctttttaagctttggtgttaattagcatcttataccatgcgtgcacaagatcttgcagagtttccttttagctcttccgaacaatgaaggtttctcatgcaagcaagtaatgttactgatggggattttttttgttgtttcctacagtagttttcagctgcattgtcaagcaagagtactcctttctgttgcttctacctcgcacattcaatccgtattaacatctataaccaatctgttggtagttaacacagcagatgtactccatccttatcagaagaaccctcttatcacaatcaatgattttttttctttaacttggccatgttctttcaatatttatccttccagatttttctacagattatttgctccacgtttctaaaaatacaatttttcaaaaaaaaaaaactttcttctaccatattgctatctattctaagctatttgcaaactttttttaaaaaaataattaattgtgttaatcattgaacaatccgtgtcaataatctagggaaaggttgcatcaaaatagttgagcaaggccttttcttgacgcgacactttttccaattcctacgaaaattgaattgattcctaaaaaataccctgcagagtggaatttcctgttccataaacattataatcattggctgtgtgcgcccgcagaggccggaaatataagattttccattatcaaaaaaaaaacaaatacaatgcctgaacattatgcacaatatatcactattatatagtatatactaaagtcagcatcttgtacagcaatgcatgagcataaggtagcatagcaagcaaagccaaaacaggggttggaagaggaagacaacaaatacaatagcaagggtccaagaagctagcatccaagaagtacattttcctcttatctcccccctctccaaaaaaccagagagagcagccacgagaccggaaacttttgctgcggctggcttctcaagatgttgccaacatccttttataccctacctgccaaaaaaaaaatttctctgcaattgcatgcagatgcaaacaagcaagccctcccatggcattggcaatcatacattcataccagtacatgtttccattggttgagaggagaagagaacacacatgctgtaacaagaacacttcaaacctacggcgacaaatctctctgcctctctgtctgtctctgcctgtgagggnnnnnnnnnnnnnnnnnnnnnnnnnnnnnnnnnnnnnnnnngatntatcatatnngaaaatcaaaanccccgg

SEQ ID NO: 6686 - DNA, 737 bp, Oryza sativa
  unsure (1)..(737): unsure at all n locations
ttggccctttgtgaataacttctcnnnnnnnnnnnnnnnnnnnnnnnnnnnnnnnnnnnnatgatatgaaaagaattaataattacttaaattttttaaatgggtaccgagctctgatgaatcccctaatgattttggtaaaaatcattaagttaaggtggatacacatcttgtcatatgatcaaatggtttcgcgaaaaatcaataatcagacaacaaaatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgtttccgctttcagagcaatgttcaaaagaaagctcatgaccaatttctagccgaccttgcgagcattctaccgagtaacaccacaccgctcattgtcagngatgcttggctttaagctgccatgtataaatccgtg

SEQ ID NO: 6687 - DNA, 757 bp, Oryza sativa
  unsure (1)..(757): unsure at all n locations
ggatgggntttnnattggaaattcgagctcggtacccgagatgatactagtagtaatttttcggaccaaaaagataaatatagaactaaatgtgacatattttactacaacgaatctggatatgacagaggtatgtttaaattcgtagtattaggatgtgtcacatacaatattagattgtttttgtagatggaacgagtagttacctagtactagttgcctgatttgcatggttgatcttgatagaaaggtgagggagtgtatgaagaaccaaacgaaaaggagcaaaatcgagagtcgcgctagctaggctccaaagcaacggcgagcagttggcaagctcatctgagccactacggtcaccaacttcatcggcacctccttcatgctctgcctcctcggcggcttcgtcgccgacacctacctcggccgctacctcaccatcgccatcttcgaggccgtccaggccaccggcgtgatgatactcacgatctccacggcggcgccggggctgcggccgccggcgtgcggcgacccgaaaggggcgagcgcggagtgcgtggcggcggacgggacgcagctcggggtgctctacctggggctctacctgacggcgctgggcacgggggggctcaagtccagcgtcttcggcttcggctccgaccagttcgacgagttcgacgtcgacggcgagaagaagaagatgatgcgcttcttcaactggntctacttcttcgtcagcctcggcgcgctgctt

SEQ ID NO: 6688 - DNA, 42687 bp, Oryza sativa
  unsure (1)..(42687): unsure at all n locations
aggcttgattgcacntcgcnntnnnnnnnnnnnnnnnnnnnnnnnnnnnnnnncttaggagtatcctagaaaaccatgtcggccaagttgagcacagttaagaactgatgcagacatgacactaacgttcagagcttcctaaaggacactgatagtaaattttgaagagatctgtccatctaacccacatttattcacaccttccttttgtttggttagcatgaatgcaatgcttatgtatgtgtacgtcgacgaaatgccatggtcccaatccaccataattcatattcgaattccagcaatattacctgtagaactgcgtcaaatttaatagccaaactgcgtactacctagcacatgttatattgaagggaccaaatcctaatgataatgaatacccctattccacacaagatctcttcttctcctagccttctactactactgtattcaattcagttcaaagttcaaatcatcactgcagcctgcaaggtaaaccaatgcaggaatacaggagcagtacaaaagtgcaacgaggatggaaggcagtaacttgtcgaggcagtaacttcgctgacggttactgaatgtttacaaatccctcctgcatcccagtgctcagaccaaggcagggaagtaaatgtgctacagaattgtcatcaataattttgcctcttgcaatgccattgggagctgttcctcgtggggggcagagaagcctgtggcattgcgggctcactactctaccttcttggcccaaatttaagcacaaccaaactgctcatctacctgcaaaccttttgcaggatctcttaatgcagaaaaatttaattgatgaatgccattataatccatgtatttatgcaagttccagttgatgaaggattgaaagccacatttgccagtgccactacattgatgaaatttgcaggcacataatttcttttttaggcagaaaatgggcatctgcccaacgaattcttgtgcagtgcggctaaaccataaggatgtaacctgaaatgttgtatacctaaagaaggcagtagcccagccacagtgaatctatgagcactgtctttttggtgcaaggaaaaatgcacagtaactaatgtgagttactcccttccctttcttaccatcacaagaaacgtatgaccagatggatgtggactgatcatgcattgccatccgtccgtttctatccagccggacccgtattaatttgccatgaataatttgtttctaacagaagacatgcagctgcagcatgatctattacactattcaatttttaaaaactgccaggactgcaggacatcactaacgcagcaggttagaaaattcagtcacattctaatcggtaataatatccttcaaaaaaaatcggtaataataagatactatgtgtggtaaaaattcgataaaggacggcgttcgaaatcagaaagaaggactgaatttttaccctgtgcagaaagaaagcaagtgttcaagaaaggaagggtctttcttaccctgtgcagagcgaagcaatgttcttggacacggacgatcacatccggcttgcacggcccattcgcccgcgacctttcgccgatgcatcatcagaacagagaggaaacaaaattcaacaccgatctcccagtcagattgcgaaattcaccaccaccaccacaagaaccaatcaaccgaaaagatcaacaactgaaactgcagcaaacgtttacgtaccactcgcgcaccgcgttcctgagcgccgccggcatggcgaactcctccgccgccggaggcggcgagcacgaccgcgacgtggccgccggagaagacgacatggtgggcgaatcgaagcactcctcttcttcttcttcttcctcctcctcctcctcttcctcttcctcctcggggtcgtcctcgtagatggtgtccacgacgccgagctcttgccagcttctgctcatctccatctccatgacgccttcgaaatctctctcgccttcaccttcttgtcctatctaccgcgtcaccgctgcgcttctagtaccgggcgacgccattacaattacggggagggggtggtgttaaatcggggcggcaatgaatgcgtgcatgtggatgataaatgctgtggcaccctcatccatcttcttcttcctcttctctctcactcccagtggtggtgtccttcaggctgcactgcaactgcagtgctgcagctggtgcttatatgaggttcttttgtttttgaacactgtgtcttgtgaggggtggatggagaggaggatcagagatagctgcagccagtggtgtactggtgtggctgtttggttggtagcctgataggtggtgtggttgcaaggtttgcgcgagatctggaccgttggatcgggcaatggatggttcagattaggcgagcccatcttgttaccgaggttttgtagggctttatggcagtttaatggtttaacatatgttacgcatcattgctgaggaagtacggtgcgaaaaaaaaacctagaatcttaaaagaattaagagatggcaattcctactatagtgagcaaaattcaggaagtaatcaacatatggagagttttttttttctaaaacatatatatggatcatgtgtagggctaaagatttggcgaaattattgtaagcgtcttgagctgatcttttcttttctttgtttttattttcagcttctgagcaggttggttttgtgggtaatacctatccaaccagcttatgcacaaaattgctacttttcctaactatatataacacaagcagtttgctggctcaaatttaaaaatatattttccttttaaagttttgtttatatatttccttcggaatggggaaaaataaactaaaacaccaatatatatgaacatggtctattagatttagaggttatttttaaggctgcattcgatctgcacttttaaagatagatttttagtgcactcaaaacaagaaaccttattatcacatgattaattaagtattaataattataaattttaaaaagatttgtttgaattttgtaaataacttctatacattttttaaaaaaaacacatcgtttaacaatttaaaaagtgtgctaacgaaaaacgtgaaaattgaagtttggagttgaagaaaagaattagacctaagtctgtttagcaattgttagatctatcttgacacgtgctagctcatctcaaaacataatccaaggttgataaaaaaaaagaatgccctagtttggagagtgatcgacctagaagattcatcctagtttggagagtgatcgacctagaagattcattcatgcacatttgtcgagcataaatctatggtaaaaatatcgattagattgcagacgtgagtaagttagcacttagcacggattcgttatacttgtcatgtacagtttgagtaactacaacattttctatgtcagtactataatgacatagatgtattgttgacatatgcggtttgttcgtccattgcatttgtcgtatggactatggacagatgaaaggctgtcgtcggtttaatttgtcttcatgggcggatgggcctctccttctgtacgtagaacaatcacatggttgatggttggtcagcatagcagatctcgctgaattaaaagatgtaactgttgtttttgctgacacgctgttccaagggtgcttagcacgcaagagcgctggaggtgcgtcgagattcgtgcggtgttaggccacacgctgatgccgaaacgatatgcgttgtacacgactaccacgtagtacatgcttcagcaatactccctccagtcacgtgatggaatttatcctttgaacttattcaaaaatttgttttattgttaaatataatttaaacgtgacttatgtttttttttctaaattacacagtaccacgcagacactcacaacgcacgcacgctcacccctatgaacgcacgcacgcacgcacctactcctatgaggatcttcgaagactgggccggcaaatccatcttggagatcgcacgcagctcacccctatgaacgcacacacgcacgcaaatcctactcctatgaggatcttcgaagactgggccggcaaatccatcttggagattgatgaagtcaccgcaggcgcttcgccgtcgcctaccgctgaaagcacaagccgttaaatcctaaaaaaatatgcccccacggaaagtcgaacccaggatttaaagtgctactgagactcttgtaaccactgagctacatgctcatgtgacttatgtttgtatacatttgcattaaaactttgaataacatacatggtaaaatctcgtgatcaaagttaactgtgtatatttatgaccagtgagagtatatgtttgataattttggagttcgtaattcttgttctgtacgtgtttgtgttgttctcgatctccttttttgttggatgcacctaacctagtattagttttccgtccacttaattatagggaaaaatcagtacacaaatttaattacacgtgagataccacgaaagcttgcactccttgcttttttttcaatgtgttggttaattaaggatcagggagcaacaaaagtcaggcgcattaagatgaacagtaggaggaacagtgtattctgttagacagttagagaaggatactttgcagctggaagccttcacttaaggacagaagttgcaacttgcaaccgtgccatccatgttcagatacaactttttgaaaccttccatctcaaaagaaatacggagcagtaaaattctgaaacttgaccaaagcaaagaagaacatggtgggcatggctgatggctctctcatgtcatgcgacgaaacgcaagttacggagctgttgaattcttcccgaattggatgcggtttctcggcgtgttttttttttctttttgttctgttcaacctgacgctagcagaagttcagaactaggaactcgccgtggcagacttagggcctattcactttaatgccaaaaaaaaccttaccaaattttagcaacttgctaaaaattttgcaggatttcttatatagttaccaaaatttggcaagaaattaaatgtaaccactttttttgtaactttaccaaaatttaatagggttgaaaatggcatcaaagtgaacagacccctacgtaagctactcatagatatacaaatcacgaggatgatcattgagttgacaattcgttattggtttttttctccattttatatgtatggtcatgtacattttcgaatacaagtcaaaagataaatgtaggcgaatgattggcagaactagtgaaaatatgagcggtgatcaccttcatcttacgctcgtaggtagaatcggaactttgtttcttacatggctaacaacaaatcaagcaaattaaaccaaagtaacaaaacctaataaatcaataacggtgcaaatttgcaaaaccatccttcaaacttaatggtcctcctcccgtgttgctcatttccggcgataagctgacccggcggcaaccacggcggccggcggccggcttcgctcgtcctcggcagcaccggtctcctggacggagcccggccgtgcgtcctccgccgccgatccggcgagctcccagtagtcgatcaggtgcctcctgctgccgccgccgccgccgtgggagctcccgtcctgcgacgacacgccgcggtagccgccgcgctgatcgttgctcctcctgatcgcgtcgatcacgaacgggatcagcccctccatttttgccacaaaacccctctcctctttagtaatcttctctcccccttcgtctcgcggtcgcggctgcttgtgttgctgtggttggttacttgggttggttggtgttacgttcatggctgtggcttgtgtatttgtagaggccacgaggtcgtggcggcgcgggcgaaacggggtcgcgcctggagaaggtggcttccggtgggcggtcgttgattggggtggagtacgaagatttccttcgtgttcgtcgtcgtcgtcgggctcatcttctcatccggaattcaggattccgttctgcttcacattttcttttctgtatagatgcgtgggactctggaataggggaaaggatgagagggatcttgtttttcagggggcgcgtacacacgaaaccggagcacagcagtgcgtttgctgccgtaggttgggttctgggttctgttcttttattacttgtcattctggaaggcgtgcgaatttgcaaatgttttttcacatgaaaatgtttttctattcacaaggagttagcttttgatgtttttcacacgaaaatgttttttttttcacaccaaaatgttgttgcttcataacaacaaacacaaattcattttagttactctttttgacctatgtggtactcagaaaagaacagagtattcctttaaaatccttcaagaggtttcagaaaagagagaggtcggtttgtgccttttggcataaacaaaagaacatgttggtcacgtgctcgataatgcgagaaaaaaaagattttagtgtccatgtttgatgggctcgctattacgattagaaggtgcaattaacccaccattagtttagaaagactgggccacccccttatcagcatgacacatcacgcttaacaatccgaagcatatgccgttcgtcatgagtcgcgtgtattaattccatctgcttggctgcttcttcgcctgtcaaaatctgcagggcaatgcaaaaccaccacccacttgcatgcacagcgcaacaatccgcggcccgccggcgcagcaacagcgaagtctgcgacctcgagtcgcccagcgagaatttctaaaaccccatcggaattcggaagtggcgacgagcactgcaaatcacgtggtttgcgaccatgacgtggaaaattcaacgagaacggcggtttttttgaccgatctgacgtgcaaggctcaacagcctttgttacttttgacacgccttgattcattctccccagcagctatacagagagggcaccaaccaactctgattttgttgagttgaaagtgatttttatcactgcttctgcattgccatcaagcaaatccccacggcaattgggtgtaacataagggagtcattgccagaaaatgcgagaaatatcggcatccggcttgaccaaacagctatggaaccacggggcacgggagaaacgtagtatagacatagcaggcaagatccaaccaactgacgtcaaaataaagccatgggggagcccagcaataagaggagcaaactagcataacagtaacttcattgcaaaaactgcaaaagtagcagattacaccatatagtcacgagcgcgtccagcgtgctcaatttcaagcagacactagaattcagaacttgcgaatatagttgcaaaaagcagacaatagacaaccagtacgaccttggcaacagcatgccttttaagttcgataacttcttgacacattactatcatgatgatgtgactcagtaatcctttcgccttaatcccttccagcataggatgaggctggcccacgcccatcaatttctggatctgaaacagaggagaggaatagtcaagtttacattatagcatgagaaagtaaccaaaataatttgagcaagaccaaagaattaatatgcatacagctgctttcgaagtgttcctgcgtaagtagagcgaatcagactcgttgcagctgcggcgtccttccctgggccagcacagtcatgtgattggctgattgctaatcagagtcttcatacaatccctcatcgtcagaaagctcatcaaatgaccggatatctagctggtaacgcaagataccaccaatgccaccgaatcctctacaaaactgagatccctcttgagatttattagtgacaaactcaagcgagcaaccaaacttcttgtattcattagcaaaccattccagaagagacattttttcctgaacttccaactcagcattactagccggatcacggaaattactctggtcagcttcctgctctttgttaaaatgtttgatcacagtttcaccagatgcactgttcttaagcacatatctgttggtttcaaggttctcccacactattagagtctcaacagcacccatctcaagagctttaagagtgtcatcaaccccaaagacatatttcccagtatcttgactgatctcttcaaaatacttgccaattagcttcttctcctgtatgaacttgacatttgctagaatctcagctgacaattcaatagcttggttgaaaccattctcgccaccataagaaacatcaaccacattaagtatcttggcttgaagtcgttgatcaaacatgtcagactgactcaattctgtcttaaaatcagcagaaccagcgaggattaggcctgaaacattaggctgacttgtagcaggattaatgaagaactgagtagcaagctcagctgttttccggacataattatggcgtttctccatccgaagacgagcaaaacgcaaagcagattgtcctcctctaccatgcttctttgggagatcaacagtgaatttgtgaagcacctcacgtgtgttgccacttagtgtgccaaaaagagtaccattaccatccataacaatgaacccaaacttgtcatcagattccaagagctcattcaaagcttcagtgtggaacttgttatcacaaagatacagtgatacattgataggcttgaagggttcaaaatcaatggtaaccttcttttccttcccatcttcagtaacaatggttccagtgtagagaaccaatccatttggaggaactttgttatagagcttcagcctctgctgagctgaggtaatggcagccaaaacagactgacgattgactctactcttgatgtttgaggcggtaccatattcatcacccaacatcttagccactcgcgcaatctggtcacgtggaggcataataagagagatcatgcttgtgccatttcctctagctgactccagagccttgattagcttcttaatcttccagatctcaatgttcctatcagtttcatggctgtcagacatcttgacagagcttggatgactggctcacctgtacaatgccaaaacacagggatataagggatttgaagggaacattaaccagacagttcactcaagaaaaacttgcaaacagattaaaaaaaaacacagaacaaagacaagtcatattattgttatatagtacattcaactttcttgttgacacaagctctgttcatgataccaaattggacatggacatgctaaataagaaatgatacctgtctcctgtacaaattaatcaataatgagactgatttcttcaaagcagcatgctctattactttatacgtaacacagtgaaagaacaagaaaaacaaccaccgtttatcttactaaatatctcacaacaaaatttcggcagcaaaggtactatcaaataaccacaacactcagcagacaaggttaaaattaaaccacaacactcagcagacaaggttaatattgcccaatgggtggcaaattttggtttggtttaggaaaaggtaggttacgaaatgtgaaaaaggttttcatttgcatatactcaaatgatttttgcagctaacatgaaacaatcatgaacacatacgatgttatcactaggttacaggtacttggtaacattttttatgtgggacaaacatactgaaataaaataaagcatggagttaacccccaagacaaatgaaggacctgcatagccatgtaaaattttcagaatcggaatgtcacccagataaaataataaaaccaacataaaatctaaattatatccaagaaacagaatttagtttcaataatcacaaaaccgaaatagagagtacactcatgaaacaaacggaaagtacaattagtactagtcaactagatatcaacttggaaaatcacaaaacaatgaaatatggaatataatcagtcaataaagttaaaacagcacatcttagatgtatttatcttctgccaacaatgtaataaaaaattaactataggcaatcaatataattaaagtaaatcattgtaagaccaaacatgcatctgtcaccaagactaagatagaagataagaactaaacctcaggctaacattttaagatcgaatggcataaatttatagaagttgcattgacattgacatggtcagtgttttgtctttacaagctaccagagtcatagaagatcaagaaaccttcttaacttcttgattgccatgttcatcaaggggtattccttctagttcatgttctactagcagtccagcacatacattttcagttaccagttacttccaaaatcaataaggcaaacgtgcagcaatctacagatttcagaatgtttgaatctttaaaatcatgtaaattcagaaaaaaaacacatagtttgctcaatgctcactactacttcaagttaacctaaatgatacatcaccaatgaaaaggaaactattagcgcaacaaaacatacaagagcagaatgcaaccatgaagaagacatataacatgtaattttcaaaccaacaacgctaaaaagagcgccgtgaacttgagtaaccgcatgtccgcatggcaccatagcaggaaggctcgtctaatatgacaataactccaagcattaaggaatcaaaataacccgattaatatccacgatggaaaatagcatgtattcctatgttaatacacatcccagtacgctacttcaaatagccaacaaacaaagccatctcctggcaggcaattacaacttacaaacacagcatggatccaaatacatccacctaaattagtggcctaaatcaggaaaatcgcgcggaacagccatctagagtacttcccgcacagatcccgagaccgggaggcgaaggatcactacacgccctagaaatttcgccacagaactaggtcccaatcactcccgatccacctcgcgctaccagtacaccggatccagactctaatctcgaccaaatctgacgaccacacgaaccatgaaaacaacacaacccgcgacgattcaacagatccaacctgctcccgatccgccgcacccacgcagctccgaacgatcgggggagaagaagcacgagacgggatcggatcgagggggcgcaggagggaggaagaggaggaggggctagggtttccttaccgaggaggagggaggaggaggaagaggggagcgccgacttctcgcgggtgggaaaccctcgcctctgaacttctggtgtggtcggctgtttcggagagagagagagataaggccccggaattgaaccacgcgatataaccctcggttccgtggggcccacctgtaagccggggtgcggcttggtgggggggggtggggctttggagacgacgggatcggaatgggtcccatccggcggctttcccaggatctggatggacggttggatcgtcaccgcccagaggcgaacggaccggattgggccgaatttttctgcaccaatgattaacaagtgggcctagtttctagttttgttgtccccaacgaatttcttctaccctttctttttcaaatatccatgttattattcacacgtttcaaacatcttcttgttacatttttattaaaattaataaattttttttgcaaaaatataaagtacttactttagctaatactcctataccataaattttatggatttaaaaaagtatcttatacagagttatttggttcactaccaaagttttatggatttaaaaaagtagcttatttggttcactaccaaagtttatctcaccatgtcatagcttagattaggcaaggtgtctatttagtttgtgccacgcttatggcatgattcctccatcgtgacgtgggtccgatatatcattttgcatataaaagtgtggcaaggttttatatggtgttgcttcagagaaatgttccaataggacagagtgcccttacatagagttgacttaataaatcttatgttgtaacgtttatatgttgtatttgtttgttgcaggtttctggtccatttgactaacaagaaacgattgggtgtgttaatagtaaactaatgtcgaatgttctatacttgcctcacaaagttgcgtcgttttttatacagtggagaagtttgactcctcataagcttttgggggccttggatgcttaaaggagtcactgcttaccaatgtccacgatgagaggaccaaaaaacttcttaagtttagaggactggaggaaggtggaatttagtcgacctagcccatgagaagatcaatgtgtttctaaaaacatggttgaagatcttttgtggtggtagtttgctagtgtttttagaggttttttagttatggattgttaagttatgccaacagctagggttcttcgcccgccgggacattgtgtttcatttcgcgctggcatccttagttttgttcttttattttgttatatggatctttaagttgggtgaaaacctttttgtctaaaagtgtagcaagcttattctcttttatggctgaagtatgatttcaattttgttggccacgtgttggacatgttagctaacataagtatgacaaattttcagtaatgtgggtacgccaatcaaacagtcctcggaagtacccaaaaccatgttagttgtatccactattacataacacgtagaatccacttgtagtctcgaattatgcctagtatgaaaggtgacctggaaagaagatgatgtataaaatggttattggaaccataggtaaccagaaaggctagaagttatagttttatgatagaacatccgtaaaatgtgtaattttttaattaatcatgttattaaatttgtagctttacgataaattggatagagcatctatagttttacaaaatttactcaaataaatgttggatgcacaaggaggtaaataatttcgttgatgtgtgcgtgtttttgtgttctaggtttggtttgtggtggaggacttgactgttaggttttaacattaagcttagacacagcaacttaagtacttaaccacaaaaaatgacgcacaatgggaaaaaaaatataagtcaagcaagtcatggcaagatgacccgtgcggttcacatagagataggataaaacgagtcgatttgtgtggaaaaagaagaaaatggcgcgtgctttgacgctttgtagcattgaccctccttcctagggtcttttcctgcaaattccaaattggagcacatgattttggtgcatgagtatctaaaaacatcagtagtattctatattcttaagtcttaaccccgtcgaaatcaacgtatcaacactcaagatcttaccactgtacaacctggctccatcacgtgtgatttgttgggctcagaagcaatagcagctgttattggatggctccgcagtacaaacgcccatgcttttatccatcgccgctcgtccgagcacgtctcattaactaactcactcactcaagtgaggtcaaattacagaagctcaagtcaaatgcttatctaatctgccgatactgtcgccggatgatgccattacaccccttcactctcacgcagaggctgtccaaaaccatcaaatcgtcgtgacgacgcgagacctctcgctagcctgacagactggtccaacccaaccatcttctcctccgactcgagccggaaatccaagaaccgagtccaccgcgctcctccccttccacggtcgctgacaagtggggcccaggtggaccggcccgcacgcgtccctgccgccctcacgtgcgggcctcggtcgcacgtgtcgcgcgcggaacttgtcgcgcccacacaccaccgtcgctccgtgctaacgaagatgcggcacgcgcggaccgtcggattcgcatcgtgcgggtgaggggtgcgtgccgcgtgccccgtcgccccggacgcgtccaggtggcgggcgtgcggacagccgttggattggatccagcggcggtggttggatagcgcgggaagggaggaaaaagggttaggaaaaggtcattaattaattcgattaattatttttcgcggtgattaatacctcgccccactcctcctcttcgcttatttcattcgctcgtcgcgtcgcctttgccttgcctcgctcggttccaaacgcaaagcacccaattccatttccgttcccctctcggcgaacagcctcgcctcctcctcctcctcgccgccgacgccgacgccgacgcctccccggcatttggttcgcgcgggtggtgccgtgagatacgtggtggacggggtagggatggagtcggacgcctccacctcgccgcgccggcggagcaccagctgctacagcgacagcggcgattcgtcatgctccgagccgttcagcgagtgcggcagcgacgacctctcgttcacgccggctgccgccgcgggaatccaccggctgctgctgtcgtgcgcggcggaggcgtcggacgggacgatctcgtcgctcgtcgcggagctggagtcgccgtcgtcgtcgctggactcgctacggcgcgccgcgatggagctccggctgctggcgaagcacaacccggacaaccggattcgcatcgcggcggccggggcggtgcgtccgctcgtcgcgctgctgtcgcacgccgacccgctcctgcaggagcacggcgtcacggcgctgctcaacctgtcgatctgcgacgagaacaaggcgatcatcgtggaggccggcgcgatacggccgctcgtccacgcgctcaagtcggccgcgtcgccggccgcgcgggagaacgcggcgtgcgcgctgctccgcctgtcccagctcgacggctccgccgcggcctccatcggccgcgcgggcgccatcccgctgctggtctccctcctcgagaccggcggcgcgcgcggcaagaaggacgccgctacggccctctacgcgctctgcagcggcgcgcgcgagaaccgcctccgcgccgtggaggccggtgccgtgcgcccactgctcgacctcatggccgacccggagaccggcatggtggacaaggccgcctacgtcttgcactccctcgtcggcatcgccgagggccgctccgccgccgtcgaggaaggcggcatccccgtcctcgtcgagatggtggaggtcggctccccgcggcagaaggagatcgccaccctctccctcctacagatctgcgaggacagcgctgcctaccgcaccatggtcgcccgcgagggcgccatccctcccctcgtcgccctctcccaatcctcctccgcccgccccaagctcaaaaccaaggtaatcatcaatcacatttcctcatcaaaacacaatcgttttacacgttcttgcaaattacaaattgggaaatcgtgtgttgatcggttttatgattacacaggcggaggcgctgatcgagatgctacggcagccacggagcgcgagcctgcgcgcgaggccaacggcggtcgttgcggcggagtgaccctgacctcgttcaattcaagtccccaacttggcggtgccccaggtgttgtgctttgcttcccctattccggcggcgaccggggccggcgccggccgccggcgcgcgcgtgtaaatataccaatcagcgtgtttgcgtccgcgagcgagtgtacattttcctcaagcgagatgacgacgaaggcgatggtggagcgaagaaaagtctcttgtaatttcattcttccccaccacttgttttttttttcacttcacttttatcccctaccttgcttggttgtttcctcctcgtcaaacgaggagaaggttgtgcaaaaaaaaaaaaaaagctacaaaaatttcatgtgtgagcgtgtggtatcaaacagtgagaatttgtgctatgtgtgtgttttagttggggaaaaggaaattttttggtgtcacatcgaacgtttgaccggacgtcggaaggggttttcggacacgaatgaaaaaactaatttcagaattcgcctggaaactggaaaccgcgagacgaatctttttagactaattaagccgtcattagcacatgtgagttactgtagcacttagagcaagtttaatagcatagcccactacaaactccaattcacttatagccgatctaatagccaatttatataatagttgcttactatactaatatatagtcccatctatcatacacacattgtgtcttggagtccgtgctgcagctggctacaaatctatagcctgctatttctctctaattttttatctcattaaaatatgtttatagctggctaatagtctgctattgtacctgctcttatggctaatcacggactaattaggcttaaaagattcgtctcgcgatttcccccgtaactgtgcaattagtttttctttttatctatatttaatgttttatacatgtgtccaaagattcaatatgatgtctttgggaaaaaattttggggaactaaacggccctatgtcactgtgtgtgcgctacgtcaggaatctcatgcaggtctatgtgaaatacaacagaaaaacctcctgtctctgaaagcaccagccagtcggaatttcagctggaatgaatgaccatgctgctccattcagttcctaccgtgtctgcaccgtttttacgagtggttacagtgaaaccaccgtgagatcaaggttaggtccgttgtaggaacggcgagttcgttggccgtgagtgcgtgtgcgtgcatgacttggtaaaccagcaaaccttttactacctgttcaaaccaacagggaaagcacaaaatatttttccagtgaccatccttgtcatctactgctactcacttcttctgcgtctttcttcttctgctgcttgtggattgtggtctagaagacgcaggaggacggattggtggagagtggcgtgggggcccgggagcggtaaaggcgagagatcgatcttgcccgtgcccggtaggtcgatcattcgttcgcctgcagctgaaaacgaccctgttctctggctgaatctagcctctgctggtagttttcagtttctggagctctcgtttcccgagccatggaagaaaagcatataccgttgcctacgccaacgtggctactgttgctaggacggtatttctacgtgtcttttttacgggtgtgtttaattcacgttaaaattgaaagtttatttggaattggaacggtgtaacggaaaagttagaagtttgtgtatgtagaaaaattttgatgtgatgaaaaagttggaaatttgaagaaaatttccaaactaaacaatggctacgtctcctgatatgggtagggatagtaggagttgtatgacgagattgagcacatcgtttcgttcacttgtcgtttgtcgcttgtcgttgcatgtctatgctacggatgatgtattgtacgagtactggaagtacatgcttgtgtggacacgactgccttttttggatgacgtggagacacacacccggcgagcggcaaaggtgcttccaatactagcatgagatttttctcttttctatctgaaaaacatgcggtttcctgctccaaccacacgaccttgtttgtgcacaacgcaacgcgtggacaagttctcggtggagtgttcgtaaccctgatgtgacagtgactgtccttggcattttttgttactttgtcaagtgcagtgcagctaagagaaaaagaagagtgtcaactgttactacctaccatacggtgtattgctcgtgcatcgaccaaattaatcgtcaatgcccttccaaaaaaacaaatatttgactcggacggcggggcgattgacttttgccctgttcaaagcagcgcagcagaatccttcaaaacagaaggggaaaagaagcagagctggttgtcaacttcaaccatgaacaataccacggcaccccattcgtagcaaccgatgacctaaaaagtcacccacggaaaaaagcacacaaaacccacatctacacgcacgcaaacattcctgcaggagaaaaaaaacaaaaacaaaacgtattcaccactatacgcacatctcggatgccaaatgcttggcataattgcgttaattaatctagccccctgccaatcatcgccaccccggtagcaacggtgcgttgtggttgcccccgcctccgctgcgctgcgctgcgcacccacacatgcgctgccggctcggccggctgccgcgcgaactgacacgtgagctctccccctcgccccaatcggatcgtgaactcgtgagacgaccacccccgcgcgcgccacgcgtcgtgcgcggccggcgcgggggtgggccatcggacggatggcggggggacacatgtggtcgtgtggtggcgccgcgggtggatgccgcccccgcctccctcctccgcgcgcgcagccgcgcccccacttcgtgcgtgcgcgcggctgcgtttgcgttgcctttccgccgctgggagcggagccacagccgaacgaacggaacgaacgaacgtgttgcggttgatggggtgcaaagcgggggtggcatggagacgggcggctagcatgatgattgctgatgggggtggggccgtggtggtgcgagatgccgctgcctccgctgctgccacacacgaccacacatgcaaaataaaacggggatcatgtgacggcacatgagcgtactgtgcggcggtttgattgatctctctggctaaaaagaaaacgtttccttgcctgacgtctttctttgatgattgagtgtagaggtagcagcacaagtaatccctccgtaaaaaaaaaacaaaccctgatttcgtgtccaaagtttgaccgtctgtatatttaaaaaattataaaaaaattaaaaatataagtcacgcataaagtattaatcatgttttatcatttaacatcaatgaaaatactaattataaaaaaaattcatataagacggccagtcaaacgttggcacgagaatccatggtctgtcttttttttttgacggagcgagtatatatgattagcatatgcctgttgtttctgcctggttgttgtagttttgcagggatcggtacgtacggtaccgcattccgcatgtgtgcgtatcgtcggagtaaattttattcccaacatgtcatttttgttatcggtggagtatattgtaccatgtggagtggtgtggtggaaattaaaccaaaggtggttgactgcgatcgatcgatcgagattttgtactagtggtactgttcgtacagagttgacaatctactactactactacctttgtttttatctgcattgacttgccatcgattttcttccatgcgctgcgcgtgtttcttttcctccgatcttatacgtacgtattagcgtatatcttcacgaagatctgcgcgtgacagaggtgtggcaccatggcatgggcgggacgccggaacagggtagggtttggtgtggggtgaccgtgacaggagcgtgtgtgtgcatggtgcgtcgagctgtacgtacgtccgacctttgtagtagtggttgagaccagccgcgaatccccgacgcgtggcagccgagcgcggcccacgctggaccgcgaccctcacacgatgcatgcaccggcggatggatcgggcaggcaccacccccccgtgcggacgatgcggccggtggcgaaagcgagacatggccgccgcaagcagcccagccagcgcgccaccaccaaccactggatacacaaaaacacttcgcgcgcgcgcgcccggcacgccggcgtgggagacgttcgccgtaaggcgtaacccaggcggtgtcctccgatccggaccttcgattcgacgagcatttgccggatttctcccgtgatatttgcggtgtatacatgcatgtggcgtgtgctcggttcgatcgggagctagttggcgacttgcctaaccccgatcgcattcaaataaattgccgtcgctatcaccaaatgatgcgtgcccatccccaataatcccgagctaatcaagccgcggtcacctttccggaatcgaggtccaggcagtagcagttaagcgttgcctttttgaaaaactcgatgaagttacggccatgtacgcaacgataagcatcagttttcgtactccattcgttagttcggcgtacgaccactgataattttggagtcacatcagatcatcattttgcccgtgcaaaagcgagtaaatccaatccaaaatactcaagtatccaagggatggagtactatttatttttcctactcttcacatctcggtacagtaataaaatgagagtgggtcaagttgattagtagtactcctattttcctactatgaagtactatggtttaaaattctgactgtttgaagcgatacttgtctctggagttttggactgggcacaatttgacgttcgagcatttctttgctctgatttgatttttttccccttatgtatgcttgagttgattgaccaaatgaattacgatgtataggctcccaacaataccaaaaagacagattccttttcgcgtatttcgttgaacgttgattccatactctactatgcaacttgcatttatatacggacccattcgtgcatcgttcctattttattttttgaatatcaaacgcaccggatttgatatgttcttttcttcttcttttgagtacttgttagacaaaaccgaaagcacataataactccatatccgataatgtagaccgagcacagcctctgaattattggagggaaaaagaaaaagcagaaccttttgagttcagtttggtcatgggctaacctcgcatgaaattcagatacatctgctggcattttgcctggcggatgtatctgaattttgcctggcaggaacaggaagaaccaattgcattcggacatcccgtccggcaatctgaatctaaaatttgttcctcagttcaattatctatcttccccaggtgctactgctacatctgctggcatgaaagaaaaagctgtactactgtttgtgatttgtatgaggaattgaggtggtgtttggatccagggacttaactttagtctctatatttaaacactaattttgagtattaaatatagattacttacaaaactaattacataaataaaagctaatttgcgagacaatttttttagcctaattaatctataattagagaatgtttactgtagcatcacataggctaatcatggattaattaggctcaatagattcgtctcgcgaattagtccaagattatagatgtgttttattaatagtctacgtttaatatttataattagtgtccaaacatccgatgtgatagggactaaaagttttagtcccatctaaacaggttctaaggatacttccagggagctgcagagcaaataagaaaaagaatcaaacccaagaagattcccactatttgatattgatattccaattttcctgtttccctagctaagatttctgagctgtcattgatgtgcatgtcccttggtagaccaacaaatggagctgtcatgtcagcttaagaaactagctggagaaaataatatttggacagaatcataagttgttcatgtcatttggccttggccgcgacacgcacggttaaaatatagaggattgggttgcctttgtagctttctcagaagctgttgcatgagaatgctggggttcttttttcgccattgtaagctgaaaccaacaatttggttgcatcagataagtctttgcagtagttgggataacaagatatctcccaagatagtgatctctctttaaaataccatgtactgctaccatctctgtgacgaactcgtgttgtaaatctgcccgtacaattccgtttccatttagtaccaggatctcttcaattattttgtaggatttggtttgtcggtgtgagagacttgagctgagacaagtagagattttagtaatgtgctagtcatgtgtcatgaatggtcatcctgacatctttgcaatgatgcatcaaatattcaaacccgaagctctgctcagagctaagaatgttattttcagtacaccgaattcctgaaacattattattgtagtatacaagtatctgacgcaaggtgccttggattatcaaagatgaagtgatctaagaaacttaatatatagaccaccagaaacaaagtgatctaagaaagccgcgaggaaaggcaggattgtcttttgtgagaacaagcctctctcttattttcttttcttttgttttttcttgagaggatgaacaaagcatttcagctgagcaatatgtgaaccaaaacaatgctgcaatgctactcaatgatcaatattccaaagccattagcttctttcaggacaaaaaaaaaagaaaaaaaaagtgggcaccagatagcacctgcactgcactattcctaaacaaatccgccacagaatacttggggagaagttgaccaacgcatagcaacacaacaaaattaagcactactatttcgtatcatcatcatcatcatttttgcgttaattaatctccaagacgcggttgagaggagtagtggtcatgatcagaacagctagagcgtgtgaccgaaatgagggatacggatttgtgttatcttttggagaaagaaaagaagaaaacaaaagaaaaggcgcgcagatgcagccactcgtgtgacgcactttagttgttcgggaagcaacatccctgcttctcccctcgagcagttgttgagcagtagctgctgcttgtgtcacgaacaagacactccaaactaatccgagggagatagatggagatggagatggagatttgatattagctaggaatttttgtagtggtgggaggaggaaggtgacagtggaaagctgcccggcaactgaggcgaccggtctctcgctctgcagcatgcgatgcatgcacagtgcgtttaacaacaataatggaaatggtttatatctccggcctctgccattaagcacacaccgtagcacggtgcgtttaactgcaatcatagagagtggccatggctgtatgatctatgatctatcagacttttgatcgatcattgtagtttctactgatgaagagagctagtgcatgggaaatgtgatgcactgatgctgatgctttctgatcagttcttggacttgtggtgatggtggtggtagtctccatccatgatttggacaagttaaattgtgtgtgtgtgtgtgctgtaaagtaagtaaagcatgggtgcttcctgttcttcacctcgaggaaatgtggagaaagcaggctagctgctctgttcaggctgtgtttgtcttcgctgccatcgtagtcgtgtcgtttggctctctctttctgagaaattttcaggtcgcgcatcacttcagctgctcctgccgacttccatttccatttcagttttatggttcctgtacgggtacacatttaattgtcctaggagttgtatgatttgatggtgcagacaaatcctctcgtcggctggaatggatgcttctgaaaatggccatctcgattcttggataagcaagcaacttgtgctgtagagcactggtgtattggattctatcgttcagcctgttgcccagccgccatcgagaaggaccaggggtcacatccagccattatcgccagcagattattgtgtggctgtatcagacagcaacttggatctaaccaaaatacttccaaaccttttgacgagcgcctgcaagactatttttcaagcctcggctgcaacgagagaatttcacactgaacagttcgattatagagggagaacggcagaattgccgcgcgtttcgaacttagcccggttacttttggataacaaccagtacggctaacgatctcagaaacttcagtacctttggtgctcactgaagttgctggaagtctgaaacacatttaagaaaggttgatgctgtcttgtgctgaaacatacagtacatgtctcaaaatgatcggagagtatagttgggcctcatctgatttgtgcaagcacttgaattatcagccaatgctcttcttatgcaaggtagagaaggaaatcaagccttgtgttcgggagctcataatcattggcccatcccaggcctttccacgggtgggccaattattatgggcctccaagtgaggccttagagattaaaaaaggaataagttcaccaggcatccctcaactttacgtcaaggttgtttcacatccattatctcgaataccagaatttttcaccactaaactatacaaaactgtgcaattttggtcctatagcagtaggaatctttgatttcgctgatgtggcatcctagtcaacaaaaaaaaaagggccacatgtaagtgagaaggaaaaaaaatatgggttggcatctcatatttcttctcttttctcttctcttctcttcttttcttcagcagttcaacaagtttggggaggccaccgacgacagagggcggagcggcggcgagcgagcgcagcaacaagtgatagaggaggtagacatcgggtgggtcggtggtgggcgatgagcgttggagggggcatgaacggtggaggtggtcggaggaggaacagagcggagccgagcccgccaccgctttgcctgcctgctttgcccgccaccgctccacacccctcctcctccggctagggatgcaagcggggtgggcaaacgggttttttaccccgcttatctcacttctagtttagtttttcttctaaattttgtactaccatatgggaaatgacctaacaagcgggtttttatataggtagcgggactatccacttgcatccctacctccgggcaccttttgccgttgcaacattgaggttgtggcagtggggcttgggcgcattcgagtcggcggacctcgggcgccgggcacgggagaagcttgtccttggggatgcagagcaggtgctcaaggttgagcgcctcctccagcaagcagttcgcctcggcctcgatgaaccacaccccttccccgtgtgcagtatatctagggctccccgaggaccggctccgtgatgtgtcggcgacggggtagtagtggacgagcaccttggcgaaaccctcccacatggcaaagatcgatacggccttgtcctcgacgatttcagcgaatgcgaatggaaagacctggatgaagtcgacaaagacacggacggcggcggtcttgtcaatggaggatagtggaagggagccgcccggggtaggccctggctctatcgattaggaggaggaaggaaacaggggtagttgtcagttgagctcgcgtgcgtgtaatgccaccaccaacgtcgtgtagttgacggggagggttggtaacgcctcaactacacactgacatgtggggcccgatgtatgctaggatccttcaaaacttcaagtttatatgaaactcaagaaaggcgtttatgtaaaatttaaggtgtttatgcaaaggcagggtccgtcccaagtttaagtcaaaatttaagtgagcgaggtcggctggtatctctaacagtctctctatgtctatttggctagttagccaacaaaattaagtagttaaatttacctttcacttcaaaagcctctcctaattacacttttaatacgatggtgggtcctatatgttagcctctcttgttcccctacccttcttcttcacccttctctctcctcttcttttcctctttgtccccactttctttttccaatctccctcgatgttgctgtccctcgtctttttccttgtgccgttgctgcccaatacttcttccacccaaatagagctccccagtgttcggaccgacttctccactggctgaattcgaccttgagtggtggtcttggctgcctgtgatgagcggtgctcgtgaggggagtagcaacggctgcactcaagagctcttcttcggcagaggcaatgacgctcgcggcctacggcggcagctttgtctcacccatcgaatccttgacagttgcggtggcgcttgtgaacggagcagcgacaacaacaacatttgtgggaaggtttgccagcgcccgccggggggggggggggagggtggagagagagagtggttgggccatggttgacaagtgattttggttggctaaatttggttaccaagtggaaggttggagaggctattagagcataatttttcgctataattgtcaaaatttgtggaaggttggagaggctattaaaacataatttgtcgctacaattgtcaaaatttgacttgagagattactggagcatgatttttcgatataattgtcaaaatttgacataggagactactggagatgctatgacagaatccgtagggtgtgttcgcatacactggttcccaacccggaatagtaacacggaaaatggagcagtctagtagcacgtgattaattaagtatttgctatttttttcaaaaatggattaatgtgatttttaagtaacttttgtatataatctttttacaaaaaatacaccgtttaatagtttaaaaagcgtgcacgcagaaaacgaggctgatgggttgggaaaaggggtgccgaacacacgcgtagaaatgctagagacgtcacggttgggcgtttccttccacgcgttcacagtgttcactggttcagtttagagtttgaaccaaaattttgtgcgatgcgaggccccacgtcgttgcagaatccagtatggaatgctatatgtccattgcgatttgtgtacgatccacgcactcgcattggcataccataccataccaaaggcaaggtcgcccgtagccacgtattactccctctgtccacgtcactagcggctcggccccgcgaaacgtcgcgcaccttcccaccgttccactccaccacgcgcccgtgcgccacacagccgcgtacgagccgttgtgtgagcggaccgccctcgcgcgcaggcgcgcgtcgcgaccagagcaggacggcgcagcggccgtgaaatgaaaaaataaacaaaacaaaacaccgggagcccagctacccgcaccaccggcacacgcgtaacgcatgtttggacttggtgctcgtcgtcgcagtcggtgtgcgccaccacgcgcggaggtgggggcgtggggctcgcgcacggcgcacctgccgcgcgcgtcgcggtacggcgctcgggcagagtggccccgtgtgcctgtggctctgctggagcctacacgggcggttcagccagcacgcaccgaactgccaaaacgtccccacaaaactgatggaactgaagcttgtagagaatatccggtgaacgattcgggcgcagaggtatctcacccatcgaaattcctcgtcagatgccgatccttttgctatttcgtagccaactttgctaatttgatcgattattaattagtaattgattaattctctttgcttagctgctaaagatatatgaagtggctcgcttgaagggaagggcgtactaaacacacgttatctcgtcttcttttcttgcacatatggacacgccaatgagtattgaatagtgcacttgcttttgtgtgaaatggtccaataaacctaagttgctcgtggcaccaatcgcctctctccttttccaattcaaagagataggctcgcactgttgcaattggaatgacgttggtccaagttgctctacaaaacatcggcgacattctacagtaacctgaatgtgactttggcacccattctatcaaacacaaaatacgctctaatgatttaacacaattggattactagttttttttttaaaaaaaactacatactagtttatgtgcttaccgttgacgataacaacacaacaccatataaaaggccactgatttaaggccacacattcttgttgaacgaaaaacacgttcctgtttctccaaagagaaccaaatgtggctaatgaaaatgcagacaagtcacaataaaaaacagaggctactatagaaccaaaataaacgctgttccgctattatccttgtaagcacaacagcgaaaaatgcctaaaataaaccagagaaccaaaagcaaaacgggcaaggaaacaaaaagaacagcttaggtttattttagcaaattagtaaacctaagctagggcaaggaaatagcgcgaaaaagaactaaaaaaatgccaaaaagaagagcacgaaaatgacaaaaagaaattagtaaaaacaaaaaaaaggggaacagaattggagaggaaacagcttccgtgccctagcttcccacccttccagcgagagaacagcgccgcatccatcctccaccgcctctcgtttatatttctgcgaggaaacgaagcgaagcgaagcgaaggcaaaaacatccgccgccgccgccgccgccgccgccgccagttcgtcgtcgtctcgtcccctttccttcctccatccctcgctcgcgagcatcgcacgcgctctccccatcctcacatggcagctctgcgactccacgcacaacccgaacccctcaagaacaacccctgcttctgcttctgctgcttctcctaccccgatcccgactccctctcccgtctcggcctcgccgccgcgcccatccgcgcccaccgcactagctcctgattcgagcccgagtcgagccgagctgaccctccccccgcgtcgcgtctcctcctccgtcttcttgcggccgcctcgcctgttcttgctgtggttggttcttgggatcaggttctctgattcttgctgcgcggcctctttcgccatggggaagagtgagttcctctcttcgagttggttgtttggtggtgttggtgttttttttttttctggttgtgtgatgattttttggtgatttcttcaggtaagaagagcaaggtccgtggcgttggcggcggggacgacctgatcgacagcagcgacgccgacagcgtgggctcgtcgtcgacggcgctgtcggatctatccatgtcgtacgctaccgagcacgtcggctcgcaggagttcgtcctcgacaagtacatcgatgctctctatgagaagaggtgaagtttctgtctcgccatctctagtttctactacccctgttgccatttcggtattgtgtgcgcggtaccttgatttaattcgcgtagaaattgtgtgatcggcttctttccgtaggctttgcttcgatgaatttgtttcttatgcaactatgctgtcagtatggattgttattggcgtggtatgatattaccttgtttgaaatacatgagggcttgacacctgctcttaattggctgagatatttgattccatagatagctttggataatatttataatccgtcaaattatacgttactatgaacttttggattttagtttgcaagttgttcttatagctataaattaatgggatggttggagtttttttgctggattactgaatagtagacttcttaatgttgttctgtttcatgtgtactaaaagcattgtgagttcaagttccctgtatactatacttgtacagttactatggcccattatgataaactaagctagacaaatttattgtgatgtgttgcatcaatttttcagagcaacgtttcgtgacatttttaaaaccaactgtgatttcattggaaacttttgtaactgcaagttaccgatagttgtgcctgacttgctggtttacttacaaccacattatgtctgatgatgcgaagtcctgattgtttactgatgagggctaaggagctctatcgtttgcattcttctcacccttgcatccttctgatcagtgatattgaacagtcttatctatattcaattaatggtcttcacaataattttacgatctatcattgcatgtcttattctacaaaagaggatatttgggggtagaagtacaacatttatggaacttgtcttttgattatctcttgccactttgtatgtgacaaggccaccctgtatcatgtattgtatttagggtgatacttttattttttcgttaattgttgagaacctttgatgttacatgatggtgccaccctatattatggcacaaggtccacaatgcttctgcttacgtcatagttgctttttttccctgaaaaaacttgcttagctccattgttgttgtgaatgttgaatcctgtttatcaaatatggatctgacaaataagtagcaccatcatgttggatgttgaaattatcaagcttgctcttttttattgtacttaatattttaccatttgtgttggtgcagggggtctaccagggaagccgcactctctcaactggttgatgcttttgaaagcttcattcttcatggtcttgtggagaacaagtaagctaatacttccaccagtcaatcttacagttgcatctagagataatagttacttagttgtcagcaatatggatattatatagtactagtgattattgtaaacatgaaagacttatatgacaatcaagtccaacctagtcagatgtcagactaacacacttctcagtgaagatggactatatattaattcattctgttccattgtgaggacgtgttactgactttattttttccctctttcgaagatatgccaccctgctgagtctgttcaacagttcgataaagaagggatctacaaaagaggcttgtttagcatcccgtgccattggtatgtgccctgtaacactaaatactcatttccgttcattgcagctattgtttactcaccctatctattgggtgttttttggacttgtaggtcttttagcccttacagttggtgctgggagcagctcacatgaaataatggaggagtcacatgcacaactttctagggtccttcaaacttggccagatgcttccaagatgatttcggtatgtcaagtattttttttttctttagctttcaaactttctttgcacttccattcaagtgaatctatattgaaatgttgtaggcacttgattgcttggctgtggtgacatttgttggtgctgctgatttagctgaaactgagttatctttgaaagctatgtgggatgtgattcatccaaaatcaggttcaaatgtatgtataggtctcgttgacttttaaaaataatataaagtatttggacaaaggcatattttttttaggacaaactacaatcaaatgtactttggaatttttgtaggtgggaattatccgtaaaccaaggccccctgtgttagcagctgctatatctgcctgggcatttcttcttacaactattggttcatggaggataaatgctgatagttggaaagagtaagtgatacatcccacccaactctgtgtgcttgtgatgtagtaagctattcatgttcgtgaaattatttactttcttttttcttcatttgctaggcctattgcatttctctctactcttcttggtgcggaggatcgtgctgttcgaatggctgcgggtgaagcattagctttgtgctttgagctaaatttgcttgacgtttcctttggagaagatgatgatgttgagaatggaggaactgttggttctaagagtaaacttttcctggatatgcaagctttgaaagccaaaatatcaagtcttgcctccaatctctcaatggaggcagggggtaaaggtgcagataagaaaaatcttactgaccaaagagatctgtttcaacggatcttggattttgttaaggtctgcctcattttttcatgtttatgtttgaatgtttggttccgtttatttgctgccaataatgttgatctttctttccttttcagtatggtgagtgccctgaagaatctgttaagatttcaggaaagcgtgacgttttaagggtgtcatcatggtctgaattgattcaggtgcttacctaaccactttctctactgaattcctgaatttctgcatttttttttgtccctgcctaattttttataatgctatagttgaacttcttgaggcggtttcttgggagaggcttcctcaagcatgtgcaggtactgttttccagagtgaagccatttttgtattgtactaatttatctggtatattaatgtgacaaaagttggttctgtttttgatgcaggagaatggacttcttcaagatgtgtttgacattaagactgacaaagctgaaactctgtcatccactgataaggtgagaaactgagattttagctcccaccaccaattgaaagcccataattgcaaagtgcttttgaactggtaacttgttacatgataaccaaaagtcaatggttggatatatatttaaaaaagaacttgggaagtatggtacataaaatgcagtaaaccatgattgatggtaatccgctttaggtttagggttttgacttgaagctaccaattcagagtaaacaaaactgcaaaagtgggcactctatccttagcagcatttgcttccctgaggacaaggggagaaatgtttttagcattttcatgcacacgagccttgactactcatcaaactgctgaatcagttagtcttcatcttcttaggcccctgcatggatagttattccttttcttgaaaatcaaggggagctgtgtgatttttatcaggtcattaaattgttcaaacatgcacgagcttgcttacacgatcttccatgagcagcccctgctcgtcttttttcaaagtttatcctgcttgttttcacgtttcactggatttgctaattccttttgcgtatttctcatatacttttggattgctgatcacaaacaatcgcaaaacacttgcagaaaatcttcaggtctggtgaagagaaaggaagagctctaaagttgaacaaggaccgccgtttagcccaggtgagctgacctgttgctttctgttaacactagttctgttctgtgtggtgtgtgacccactttgttaccttgtttttcttcagttttgcttaagacatgatcaaaacagggtttgtttagaaagtagcttatttaactgacatgaaaatggatgctaaaagcagtgtctttttgggtccttggaggaaatgagagggagaactatatcctagtgttaatcataaaaggtacgaagaggtatcaagaaatgtttttaaaaaaagaatatataaagagatacctgtacctcaagtaccataaacaaaatcctcaagcgcaaaattaaaatgcttatgtttcttactttaccagtgcaccacaagaacagtggtggtgttacgtgtgtctgactataatagtatatttgatcttctggacttcatttcaggagaggaagaatgccgttatgttggacttggacgagtagcctagtgaaactgcagccgttcgtcctcttctccgtttagctggacttatctgtaacgagtgtttggaagtcgcgatttgttatcacgacgctatgcaaagcaatactgcagaaatactactactatactagatccaaaccagttcgtgtttatcaactcagcagtgcctttacatgtaaaggtctaaaccagtttctgttgtccggtcgctcagagtgcctttacatgtggaaacaaacgtgctgaaatgaaatctgattcctattggggtctatttatgcatgtcgttgctcgtgtttcctgtgattcttaagtactctcttgctcgtgtttcctgtgattcttaagtactatctctccgtctcagaatataagaaatctagtcctgttgagatacgtagctgaactgctcgtgaacgttggccaccgggcaacagctgaactgtctcaactctcaactgcctaccgtcatatggtcggaccggcgcgcagcatgaggacgttggcctcgtgcgctgtgtaccttcacaggctggtcggcgcaggcccgtggatgtggaacctgatatgttttgtggcatggctgtgtgtaattcaatcttttttttcatacggaggaagtaacttctaatatcaccaagtcctttaatagttaaacccggtataaagtgtatcctaacttttaggaccggagcaaaccgagtcctttgacaatattgaggggtccttcgataatttttttttagaactcttcgataatattgagatgtggttctatcggtgttctcatttttagttttacttctagtactacgtaggtgttacatgaaacaaataccgtactatgttattaagccatgtagacatcacaatagttgaacccatctttaataatatcgaggaacttcggtgttaaaatttttgaacttttacggtaacaatgaatgtcatctctccactcagatactttataaaataaatgaaacataaatttctgagccttacagattatgcaaagacaattcatgtacataatgtggatcgatctatattgttataatttagatccatgtttcagcattgttataatttagatctacatttacaaaaattcatgttttacatacaacaatatcgatcaatctatcttagtattataatttagatccatgtgacaatatagtggtgtaaatgtttccttatgtctctgctaatgggaagaaaagacaaagttgcggagtgcaaatgtttctctttttctctaactagcaagaagttggaagtaaaacataatatttgatagttaccatagtctttaatgtattggctttaatggatggtgcagcaaaattgcttgggaattcactcaaacaagccatctgtttcttgttccctaaaaacaggatctaaaggctcattaccgattatctggcctgcagagtgcacagatcctaaagtggttcattcttgcaaaatgaggggaaaagggttattttaacaaaagaaaaactgtgcggatgttcagctataccagcgttgtgaaaacgaccgaaaatctcatgtgacgtccaaccccccaaaagttcccattgctgattgagcttctccttcaccatttagtcactcaatataacatcagtacagaacctgaaactgtcatgatgggaaaaattttaaccgaagagaagacggttacttggtttgcacattcacactagcttcagaaacttgagctggtgcaaactgattatggaatatcaaatatgcatgattatgacatgataatgctactggatgccaaagaaatcatcgattgatcattgatgcttacctaaaagggatttgtggaagataatcattgacagccctgtaaccttgatacccattgtaccattaaacacatcaatatgtcagctatttatgaatatgatcttaatggatcaaatataagatcacaactgacatgtccctcatgaaatgccaagtttctccacgactttgccagcaatctgaattagtccattctcggattctcctggattcatattcaatccctctgtttgagtcagggacctcacgaacaactgtcagaagtcatgctgctgtgaccgcagaaaaaaatattcaccaataattaccacatgaacattctccatccttgaaatgatgaaaccgcctgacatctctaacaacaatttcccgtccaaccgcctttgacatgaacatcattgcagtatgacagtcaccacatattctcaagttttttaaaacagtaactgtagctccaggaggcaactttagaagtccaaatccaactgccagcttctcactatgtgcaaataatatgtattccttttcatgaggctccatatcatgcaacacaaactttgtatcaggaacatatcccagctttctcatcctagcaccaatcacttcaaggaattggtagacttcctgtgcttctggatgttttgtatcaccaacaagaaacacatggattttacttcctacttctatccaactgcacccaggctccttcttgaccccacgatcacgcattagctttctaactcttgcagcatcgacccaacgtccagcagctgaatatgtgttagacagtaggatgtatgttccatcatgctgtggtatcatccgaaacagctggtcagctgcataagcaccaaattccatatctccattagtccgacagccagagagaatcgcctcccaaatggacggggtaggctcaaaaggcattgtcttgatcaaatctctagcttctccaattcttccagagcgaccaagtaaatctatcagccgtgcataatgatcttctccaggactaatgccaaagtccctcttcatggactcaaaataatggaagccttcatctaccaaaccagcatggttacatgctgtcaaaattgtgaggaaagaaattcggtcaggatctatgccttcagcaaccatctggtcaaatagctcaagtgcctctctaccgtgtccatgttgcccaagagctgaaatcatggcattccacgagacagagtctaaattgggcatcacaaggaacacaagacgagcatcgttcacagcgccacatttggcatacattgttagaagtgcatttccggcagaattgcttgcctcaaatccacactgtacaagatgtgcgtggagctgccttccatgcttcagcgctccaagttcaccacaggcagctattgcacccgcataggtgtagtcgcatggtttgacatcctcagctctcatctggttaaacagtttcagagcatcttctgaaagccctccgtggacatatcctgagaccatcaccatccatgacaaatcgtttttatatggcatcaccttaaatacctcaactgctttgtccaaacagccgctgtcaatgtatcccgacaaaatggtgttccaagaaacaacatccttcagattcatagtgtcaaatatcctcttcgcaatcacaatctttccacccttcgagtacaaagtcactaacgcattgttaacaggcaatgctgcctcaggaacgaaattcggctgtaaccgaataatctgaccatggactgacttcccatgcacaaagaatccagcatttgcacacgcactcaggacgctagtaaaagtgaactcatcaagcggaaccttttccgacaccatcctcctgaatagctcaaaggcgtctgcacacattcccgattggacataccctgagatcatcgcattccacacgacatcaaacttaccatcaacctcctcaaaaactgatctagcagcattgacatcgcctctcctgacatagccgacgaccatagtggtccatgtgaggtcatccttatccggcatttcgtcgagcaccttccgtgcgtcccaggaggcctcaggcgtgtcgcacttcatgtacagagcaatgagcgcattggacacagacaagacagccgccgcgccggacttgagcacggagcaatgcatctgcgtgcagtgtggcgcggcgaggttgtgcatctggccgacggcgctgatgagcgcggagaaagagtaatcgtcggggcggagtgagccggagcccagcagggcgtggaacacggagaccgcgggcgcggcgagggacgccctcgcgaacgcggacatcatggcgttgtggagcacggtgtcgcggcgggcgggcgggacggcgtctaaaaagccgccggcgtcccggagccggccggcggcggcgtgcgcggcgactagggaggtggcggcgacggggcccgggtcggggtccgagcggaagagagccgcgggggtggcgaggtcgggggaaagggtgtagaggtggattaggcggagggtgaggtgggggtggtacggggcgtgaagaaggtcgtcggtaagaaggcgggcgtggaggcagcggagggcgcggagtaagtagaagtaggggcaggtcggggccggcgagtggcgctcggcgagtcggcggagaagaagggagcattggtgggcgaggaaggcgacggcggtcgccggcggccgccatggccgcatcgcgcgttggcgtggtggtcggggcaattcggagcgcgcgccgcgcggcccagtgttcaattgggcgtgggcctttggttgggttcaggcgtttggcgggttagcggatttctgaacattactttcaggtgttcaaatgtttctgagcatagcaatgttctatggagtattgaagagcaagaggaggcacctctagcagggtttacattaccggttgaccactaaatttcgagccacatcgatatcacggttttcgataaattttgatcggtttttgataaatttcgactgaatttcgaccaaatctaatgtttaaccttcgaaattctaatcgaaacttaattccaaaccgtgtcaaaacgtcgaaattttgcggaatttgaccggttttcatcggaattgtgaaccctgacctctagagcatttttttttggattacacggtagtacacaagcacatatgttattacacacaacactatacttacacgctcataaatatgtctttagcttaaaagatactacctactttctagaatgtagcaatctagaatgggatgacatgttctaggatgggtcttattcaattataggttaatacgttctgaaatggagggagtagaaaccagcgacacgtttccgacctgatatttaattatgtgttttactgtaccggctcttacgtatctatgacagagaatctcacaattcttctccatgccactttctctcctgtaactggaggtacactgaagatttctaatctactactacctactaacataatatgtttagcctaaacacgatcaccctagaatcagattggcagcgcaccgttgcatccactgcatctactgatctactacgtactaacataatatagtacactgccggtttgattacaaaggagtcactgacgatcaggtgtgacgtggcagcatccctcatccaatcccttcacttgcattgatcaaggactgcactacgaacaccctccaacatttagcttaggatagagatggttaacgttttttggacaagaagaatgtgaagtgatcgctaaaaaaacatgaatactagggaagaacctaatatcaaataattagaatgggtgaggcttcaaatccaggtcgtaatccaccatcttgtgaaactagtcggatgatccctgtgcgtttctctgaagtgattgttaccatgacacggtgttggcatcttttgttaatatcacgttgtggatgtcgaggataataaaaagaaacatcggcgtgaccgatcaatgcacaaaaattgggaaaacatagcgttgattcgcggtgatcgtgtaagcaacgagtggaaacggccctaatgtggttgactcccagttttccatgctgagagtcaattttcccaataatcaccgttttctaaccacctctgaacttccttccaacctcgaaaacctgatgcaacaaagcttgctaaaaggtggggttctttgttgaaattcgttattataggaccatgtttggtttatgattaactaatgtcacagactcacatacagccttaattagttatgttttggcacaaagtgaccaatggaatggtttccacaagttcggaaccacatggctaaggaagtcaaaatagggtcaatgaaccaaataactaaccacctaaaagtgtcaagccacatcataaagaaacatgtgcaattgtcaactttggcattttaatctcgatcggcgtgtcagagcatgtcactggttttatgtcctcctacatgctccaagtcccaaaccgtgatccaacaaagtacagctttataaattgtaagctgaaccgttttaagcaaggaatcgatgccaaagaagcaggatcaaaccctaccaaagaatgtgactttaaaagagtggtacttctgtcaccactaaaccatgtcgtcgaatgcactccatcaatccatatgtagccatgattgatgcccacaggatggaatgtatgtaaaggcaacgcctaaagatgataattatcgcctgaagatcgatcgatcgatcgatctcgctaattaacgggccatctgcccgttattacataccaaatggtactcagatcacactgatctgaccaacacactagctgtcagtctgtcacccgttacaagtgaattattgagctccaggctagtcagaccaacggattctggctagcacaaagaacaaatcttcagcgattccggcggcagcagcagcgagaacctgacgaaacggtcgccatctcccaaccgcaaccatcgcgcgggccgggcatgcgcactcggcgtctgcgtcggcgacgcagctgagctagctgtggacgacaggcatgtggaaatatggaataaaccaaacgacgtatttacaaatgaaaagtaatttgtaaataaaactttcatatacgtgctaataacaaactaaaggaggagtccctccagttgtggtggaccgtcctatcgagccttgagctcctacattgcttcctctctgacgatgtttccttccacgagtggcactgctcttgccaactcaacgttccgcaggagcatcgttatggattcgacacggtcgtgacccttggtgcgcgttccatttggaaggaacggaacaatcgtgtgttcaataactgttctctgccctggtccgatgtggtaataggcatggcgcaagaggccgccctttggtatcttgcccatcccctgtcgccaacactgccttcctagcgtattaggtcttttagtcgtcccattgtaatcgcaagaataggtttaagttctcgtttttctctttttcctccttttattcccaacccctcctcccccaccccttctttttttttcgtcatctgtgtaaattttattcctctgtgtaatccttttacgtattccaaaaagagcaaactaaagcagaatgctaaaaaataaattttgatgaaaaaaatttctaaaatcagctacaaatttaaggttgaaaatttaaaatttggttgataaacataatgaagccggacgcttcagtgtgcgcgctgagacagctagaggatagaaacaaccaagcagcaaagctaccttcctaccgcacactagctacctttgaggcataggtcgcctctcgcctttcagaattttcagggcctcatgattctgccatggatgtaacagcgagacgtcgatcccgatcgatcgacggtgtaacttccgatcaaatctcagcagcacgcattccgttctcgagtagtaggatccgcgagcacggcgacaacggacggacggaagcttgcgttcttgatttccttggcgccattatccttgcttgattagtgagcgtacgtgcgagattagttgcattgcacaatcgcgcatatgcaacgggtgaagcgacaaaaaaaaatctgcgtgtcaaaagcggaatgaattgatcctgaaaagtttcaggttcacacgtgaatcatgaacggcttggccattttcgtatcccactggattgcatgctggcactcgcgcgctcgtccatcacaacgtcagatagcacgctgcatatgctgtccattttctagtacgctggccgctgggccgtcgtcgtactgaagagcgagcacggtagctgatgcttactcgtagacttacctccgtcacattataagtgcagccgtggtttttcgcacccaactttaaccgtccgtcttatttgaaaaaattttgaaaaaaatttaaaaacataagttacgagtaaagtactattcatgttttatcatctcataacaataaaaatacaaattataaaaaatttttaaataagacgaacgattaaagttggatgcggaaacttatggttgcgcttataatgagacggagtgagtacacgccaaggccagcagagaacgtactgtccgtccgtttctcatgccacagtcgcggttccagtcaaagttttttctcgtcacggcgtctgaaatcttctctctgtgtgtcccctatctccggcacggtttatgtcacaattttcatgccagcttgacaatgttggcgatgcgccgatgccacgtttgtgccaaggcccattgtccccaccagagttttccaaaccgccgataatcgcgcagttatagggtactaaggactcgtacaacggtttttattagtggtctttctatttctatacaagtaaatttaataacatagaaaaaagaaaaaagagtatggttgttgtaacaccctaaaaattcgacgacaaaatctaaactctaaaaatacggatcttcaaaaactttttaaataaagttgcatcatgccaattttgttcgattattttattgaattttgatttcggagtttataaatcgcgaataatggataattagttaggaataaaccctgaaaagtaaattgactaagtaaataattaaagtacaatttaaaataatatttagtgaggatagaaatgagtaaaatattattacgactatatttgtatcaattaaattgaaaagtgtcggaataagaattaactctaattaaattcaagaaaattatataaaaataaaatatgggtaaaattaatcaaggatggacccattggatggaataacacaaatattgagtgaacttcatttgtacaaaaattaaggtttatagaatcaattttaaataaataaataggcttaaatcgggtaaatagaaaacggcactattcatcggcccgccaggtgttcgacgaggtcccctagtctaaccctagccctttgccgagccgacgacgtgcgccatgcaccacgcctcgagcctgggtaccggacgtaacagttgtagccgtcgtcgatctgacgtaacatcgactttgcacctcgtgtcg

SEQ ID NO: 6689 - DNA, 5268 bp, Oryza sativa
agctcgggaataaaatcacagtttccggcggggtccgataagtggagtgggggccaacccgatttgggaaaggttacaatcgctgtccagtcggttcattggttttggggggtaaaagcccagcctctattttttctcagggggtttgtccgacatgtaaaatgtcgcgaggggccggtacccgagggtggccccgtacgggttcgtgcttggttcatgtgagcggcagaagccttttgtgcatatgcagatgcaaccctttcccccatctcgcgcccaacatttccctccagcccttcttttctcccccacacccattcccctccatcacctccctttttaccgcgccgccgccgtagtgccgccgcaccgccgccttcgtgctgccgcgccgccgttcccgtgccgccgcgccgccgttcccgtgcccccgcaccgccgttctcgtgccgccactcccgcgccgccgtgcgccaccgtcgctgccgccgtcgtcgccgctgctgccgccggtgagccgccctccgttcccctcgcgtccaccgccgccaccgctcgggtgggagagagagccgagagagagagggagaggaaaagagaggctggcagagagagagagggagaggaaaagagaggccggcagagagagagaaaaagaaagagaggaaaagaaaaagagacaaaaaaaggaaattagagggagattagggaagtttagaaaatttaaaataattggaattttataggttaattatagtcatagaattgcaaaatttaatataaattatggattattcttggcaatttctataagaaatcaattcgcggtaataatttagatgtagttaataactaaacaaatagatgaattcttatggattattatagattatttttttgggtaatccctataagtaatcaattcacggtagaaattcggatttaattcctagggattttagccgtgtattatatttaatcatctagtcatagactaaattaaatcatataatatttctaggatttcgtccgatatttagctcgcgatagaaatctctaacctattatatggatataatgctcgggtagattaaattaaaaacttatgacaacaaaacatttatacccgcaaaatagtttgaatcgaaattgggtttgccttagttcgcgaataataaagttaaaataaaggaatcgactttcgcattcgactttcatttggatttatttggattttgtttgaattctaatcgaattcaaattgttctttcgcacataattatagagaccgagggagccgcggatccgggtgaaggccaagacccgcaagaccttgagcaaggcaagtcatcactattccttgaacatgttgatcccaattgcgaagttgttttgtttacaaataaaattgcatgcaattatgaatatcctacttgtaattatgccatgccttgattattgtttaccccttattccttcgtaaccatgtttacgtatgagtctctagtcaattatgacaattgcttagaaatgctattctagaatcatgcatactcatatttatcaaatgctatatgcttgggcaattacctttgggaaggtaattgagatgcggcatgtggagacatgagcgccacattgccatgatattgatgacatgatttgtgaaaggaaaaaaaagttaaacaactgttttcgactggggcggctggaggatttgggtggtgtccggaaaaggctagtgccgtccctggtcaattaaggaacgagccatgaagttaagcatgaaacgaccccccgtacaaccgcacttctcgtatgggtatagacctagcggagtggatagctgagcggaggcagtatccatgcgtagtggtcttcttttagctgtgtgatgtggcagcagtctgctggcagatgcccggttcggatggccaggtgaatggcggatgcctattccggatggtcagaggctggcttggcaatactacatgaggatacccataagagaacaatcatgatggactgggttcaacgacaagaagcaacgtaggagtgtgtgtttttcccttcccgggagcgccagaactcctctcactgctagaaacgtatgacgcctagagtgcatgaggatgtaaagttcatggagcgggtactgccaatgcgaggttatcgaaaagctttgccgtgacgcgtctcatgtgttgggatgaggctcatgtgttgggcagtcacggagtgcgggtaaagtgtacatccactacagtgtgagtaaaccaaatctattcgaatagccgtgctcgcggttaatgagcactgggacatgtattacacttggctagactctaaattctttaacttgagtgggatggaatattgcatgataatttttatgctgatggagccacttcctgagaggcgggaatgtggacgtcctcagaaaatcataacgactctatggcgggaagctatccttgggatcacaatggatggtggacagaaccgtcattgtttaatatgaacaatggtattaaaacttgattagtctttgctaggtcttaggcttgtgaaaagaattataaaacttgctttgcgcaaatgaaccatagccatcctttgaaatcctctgtcatgtgcatcattgctgtggtggcttgctgagtacggttggtactcacccttgcaaatataaaatttatcagaagcgggagatgaagcttcggaggatccctatgcctactaccaggagggagatgaagacgaaggcgcccaataggtcttagtacggtcgttgcctgtggcaatggcatgccgctgcttaaattctgctgccttacctatttctgcttttggatgtattccggaccgcttggtccgatgatttaagactatgcctgcaggcttatgatgtaataattcgtactagacattcgtgtatgtgtatttggtatttcagctatgaattcgtgtgtaccagactacttgatccagggaaatggtactgtttacacgattgattcctgttataaaaacgggggtccacagttgttatgcatgataacggctcagagtcgactcttagtatttatttgagcaaattttgttgcatggtagtgaaagaaaggaaagaagagtaagaaaaaatatttttgatacattaatgattagagatcatattgtctctatctgctgtagaatgctactctctagataacgtagagcttatatctgactctatctttatacatgtcctaaaagaaaccgcaataacctccttaaatttaactaaatttaaaaattaatttaaaattttgataaattttatacgatttgtcatggttactatgggtaccgcttatcgtcgggacacgataatcccggtccggtggtctgagaaacgctggtcccgcaactcgcgatttgacgatttgtcttgcacagatcaccggctacaattcgcgagctccatcaatcccatacctgtgcaagctacctgccactgtacagactccatacatgttacttctactactagtactagatgctacaccgtgtagcagcgcactgtttcgccgctatgtagagtgaaacggccactccgctttcaggccgcacgtaacatcgcgcggaactcgccacgtcagccggaacccactgatgacacgcacgcaccaacagtgtgtcaccgcagacgacaagaccgtcgcgcaggggacactcccacatctcacgtcgtctcagccccccaaagcatccgctaccttcactgacatatgggacccacctttggtggggtagctggtgccagcggaaggggggaagcaccggcgccagcgtggccgcttcttccccactgggcctccgcgtttggttgtttctggagcccctggaattcctcttcatttattattgttcccccctgaagctgacgtctggggcccacctggggatgtggcccacgtctcattgggtaggtgctgatggccaggcgtttcgcgtgtttttgtgaccgcgccccggttcaacacgccgaagtggcggcttgcggttagtcgctggctggtggggcatgcgagatacccgggcccacgtgtcggtgagaggaggatttctggaagagaggagcgcttcgcttcgcgtgggggggggggggggggggcaaacgctcgcatttgccactcctggcgaggcaaagcctctccaactttctcctaacgaaaaccacgccacgagaaggaagtgagccaacgacgctggaattttttgaaaatttcagagaaaatttaccggaggagttcgaatttctttcgggtatgaggaggagagttgcactgagcacggcgattgcgttgttagtgggtgctcaattatgtgtggcggcggaggtggaggtcgccggcgccggcggtggggttgtgcggcggcggtcgctccaccagccgttcttcccaatcgagtggtcgccgccgccgccgatgtccgggagcgaggccgtcccgccgccgccgcctgcggccgcggcgtcggccaccaccggcggggggcggtcgacgaccaccgtcatgaacaccgtcgccatcgcgctctcggcgggcctcgtggcgctcgcggtggcgtcctactcctgctgcctcctgctgcggcgacgacgacgcgaggaggaggacgacggcgaccgcgccgcgaagcgggcggtgggggcggcattttctgtggcggcgagagtccctagcgatgtcgggagcagcttccgccagcaccggtcgccgtcgccgagcttgacggcgtcggacgcgatatacctcgacccgcttacgacgctggtggaggtgcgccagcacgaaaagagcccggaccttcgcccgctaccgctgctgaagcagccgagccctgacctccggccggtgccgccgctgaagcggccggaatcgcaacccccgactacgacaccgttcacttcgccgttgaccaccacggggtattccaccgacgaggaggaccatgccacgtactacaccgggccgaaaaccgacatggcctcgttcagccggagcacgagccaggacagtacgctggaacaaacagtcatgtcgtccatggacgcgcctgcacccgtcgaaactaataccccacgacctgttagttcagcaccgccgtcgttccctcgaggtaaatgctgatccggccgctcccggcagaattgccggccgtccgccggcttgccaatcttggaactaaccggatcctcctttaaacccgctgctgaag

SEQ ID NO: 6690 - DNA, 7828 bp, Oryza sativa
  unsure (1)..(7828): unsure at all n locations
gcatgctannnttttgattgatcattctctnnnnnnnnnnnnnnnnnnnnnnnnnnnnnnnnnnnnnnnaattccggggccgggcggccgcccaagccgccgaacctgaagccgctgcactgggacaagctccgggcaatctccggccgcaccaccgtgtgggatcaggtcaagaactccgacacattccggtgcgcccccctcttttcaccccccccccctccattcttccacattacccccatctctctgtttcaactgagctgtctatcgatggcgcggcagcgtcgacgaggaggcgatggagagcttgttcctgaacaacggcggcggcggcgcggggagctcggacccggcggcgaggagggggggatccgggaagcaggagaggcggttgcttgacccgaagcggctgcagaacgtcgcgatcatgctcaaatcgctcaacgtggccgccgacgaagtgattggtgcactcgtgcgtggtgagattgtgctctcaatttcttacttctcgcatgacgtatgtggtgtttggtcccctactactgtgtcattgtggaatttatcaattactactactgttatgtgctatgctctctgcaattccggtggccacatgtcattgcacagtagtacaatctagtcactgttaaattaagcacacaaacatatagtacctgacaagtgatttggtttgtttttttttttggaagatgagtaagcctgtttggtttctggggcaaaaaaaattctcagaattaccttactgctatcagagaaggaaatgaaagatgagctaaatgggagaaattccagctttttgactgtacttaattttctactagatgctaggttagcataatttatcaattcactctgtgctaccgttgaatttctgactcttctattcatctgaaatcgacaatgaaagtcggggcatctgtatgccacaaatcataaatcacatgtcagtatgccaccaagacctcaatgtccttacaaaatcatatttttagtaatcttgttgactgaacggcagtttttgagatatttaactctgtactcatcactataatcagtaaatatttctagaagtgtcacactgttctacaccaacgcacaaattatacctgaaggttctcgaaatttcaggcataagcaattgtcgtattgctcacctaacaaatatgggagtacatgcctagcataccagggaatctctctccctctccaatcccccaacatgacaccttttcctttaattttgatgtgaactgatagagaaggctcctatacttgtcctgcattttgacctccattgtcacattcaattatatttttggtggggggttactttcataatcaaattttctggatgtaatgcgttccaacaaggataatttgtgcaccataagtccgatgattacatggcaatgctgtgtttgttccaaataagcttctattggttgatgttaagtttctagagctgagatcctgggactgtgggtgcaagtgactggactggagtatcactatgcgatgaaacatggacgttttctttttgttatgtaacttttaatttgttggtacatatacttttgtgaatagccagtgatacagtctgttgccaaaaatatatttttaaagaaacagtgatgtagcatcattggtcatgtcatgttaggccatggtgagatcagtaggcagattgtgacatggatagaataggcgagatgcatctttcacaaagacactagtgctttaccttttcgtgtctgttctgtattgggataatgttatattacatgtctgtattttcaatgtgataatagctgcatttactagtggcatgcacacagatgagctgtcagttgctttagaacttctgcactattagtttgtagaacgtagattatgaggacttccttgccaattttcattatccaaattaaacttacatcttcatttcaaggtttgttttctcattttattcatcacaaaccatcaacttctctcttatattggcctacagacgtgtcactcgtttatcgtttgagctggaaataattggtgatataatttctattattttttattgtgaatatgttaacacaatattcttgagtttatcatgtccaatttgtgaaccaggattctataggttttgtgagttactaatccattcttaaagtaattgaataacaaattaacttggttgatattacatacattgctcattgttaaaaaaggacagttgaaattcttgtacaccgaaacaaatctggttgaattatagaagtggttgtagtaggtctaaacgtctagtttcatcaatgccttactgtcaagggacatcccttaccaaacttaggtgttttattgcctgatcttgaatagtacaatcatctttcaggttgttatttgaccatctatatatgctaagaaatatgttttctttttgtagataaaggcatattgcattccgtactaaaaactacatatgtcatcatgataagcatgtcacattccgtgctataaactccatcatatgtcatgagtgataagttgtcagagatcacgactgtgttgggaggctaactaccagtgaacgctattgattattgttgttggtgtacaaataaaattcagtagaaaccataactgaattgttgcttctttacccatgcacagtgacttatatccccagattttcctattatttctattgttaggcgtctcgcccggcgaaaaaaatttttgcccggcgaaaattgttaggcgtctctgtatgtggttggtatacatcaactagaattatgaatgctgtgaacctttgtgggattatttaatcatcactgttacgtgcatgcacggtttccttagggaattcctattatagaaaaggttaatgctgtgtatgctacagtagtgggcctatgatgcagttgttttcttatgatgtcacatggaaacattcattggctatgttggatacttggatccaacaacttccattccaactggagtatttgtttattgtccagagccaacatatctcatcaatagttcaatacatttggcgtgatatttaaaacatagttgacagtactcagtgaaaactcttgcataactgcattactttttggagtatgaatgatgcaacttttgcctgatttagttataaatgttttaatctgtgttaccaggaaatcctgaagatttaggatctgagttctatgaaacactagctaagatggcaccaacaaaagaagaagaattgaaactaaaaggttatagtggcgatttgtcaaaaattgatccagcagagcgctttctgaaagatgtacttggagttccttttgccttcgagagagtggatgcgatgctgtacagagcaaattttgacaatgaagtgaattatttaaggaaatcttttggaacattggaggtaaaatagctatgatgatcttatcattccatgaagcttacaatacttcctccattttacctaccaattatatcaaattaccaactgtttagatattattctcttctcttaaaaaatgtaaatttaagataggtgttttcatgcttcacaaaagatatgccacacattctaagtttctcacccgtgatctgtccccaaaaaaaaaaaaatcaaatagatcacttatcaaacttctgaattctcaattattttggagtaaaatgtaatattccttcagaaatctttcaggcagcctgtgaagagttaagaagcagcaaactttttttgaagctgctagatgcagttctaaaaaccgggaaccgcatgaatgatggaaccaatcgaggcgaggcgagggctttcaagcttgatactctcctaaagcttgcagacatcaagtcaacagatggtagaacgacattgcttcacttcgtggttaaagagatcatccgatcagaaggcttcgattctgatcagagcgcggttaatcctggcagcggcagcaaggaacagttcaaaagggacggcttgaaattacttgcagggctcagcagtgagctctccaacgtgaagagagcggccacactggagatggacacactgagcggcaacatcctgaggctcgaagccgatctcgagaaggtgaagcttgtcctacagctcaaggagacttgctcagatcaaggcgcgagcgagaacttcttccaggcaatggttgtcttcctcagaagagcagaggcagagatcaagaacatgaaaaccgcagaggagaacgcgttgcgcctcgtgaaggagacgacggagtacttccatggcgacgccaccaaggaggagcctcaccctctgaggatattcgtggtggtggatgaattcctcctgatactggaccgtgtttgcagggacgtcggcaggacgccggagagggtgatgatgggctccggtaagtcgttccgcgtccctgcaggtacctcattgccgcctcatcggaatgagaaccggcgagttcttagctcctccgatgaggacagctcgtcatcttaggagcaaacatttttggtgcataggttagctgataagatttgagagtagtgattcttccggagctgaacattgtggtgtatagactgtaatcaccgtcagaaataagggagtcgtcactgtctgtcactgttaaaagtagatgtttaccaaagctaaagaaaggtagctgtacaaactacaaaggcattcagtattatggtagtatgttcttaccattcagctcaaatagcatctgtttgagaattatcatattaagagaaaatatatttgttggaagtgtaacttcagttttcttttcaatatagtcatgttaccgctgaacaaatctatgcaacctttgaacaagtcatgaacagatttcgtggtcgaaagtgacaattcaattatcagctcggtagcgtcattttagagaaactagctgttgcgcggccactacccaaacaaaatcatatattttttagtatgattttacttaaaatttattaaatagctatctcattgtcttaagactttaaaagaccaaaccttatcatcctcgcgtttctaattatatagtttttaaaagtcacaccatttgctaccccttatgtcatctcattctttatttgcttgctcgatctaccactatttctattcattcttcttggaacctttaaaaattggattttatagtttttagagtttattgtcatgttgggtttcgtttttataatttctatatgtcccatcaaatgttgccattatattcctctacggcccgtccactgtttcttctctttgttgttattgagattttaaaaatcgaacataattatcgtttgggttcatttttactttctagaagtcccgccaaatcatcagcggctttgccattgtactcctctacggcttgcccgctgcctcccctctttattgtcattgagattttaaaattgaacatgattatcattgggtttttttttacttttttggaagttccaaacctttaaaaattggacttgtagttttttttataatttttagaagttccatcaaacgatgccactatgcccctctacagcccgtccatcgcctactctttattgtcattgtgattctaaaaatcaaacataactatcgttggaatttattttttattttctagaagtcccgtcaatcgtcggcggctctacaactatactcttatacaccccgcccgctgcttctcctttttattgtcattgagattttaaaaatcgaatatgattatcaatagggtttattttttttactttctagaagtcccaacaactgctttacttgtttgcttcatggcatgcctggcgcccctccttttaatcgtcattaggattctatttggtgttttattaataatttttatatgtcgtatcaaccgccaccactctactcctttataggtatattacttaatttatctcgtcatgtgttttatatggttttttctttcaatagtctttatttttatcacaaattttagttatttataaattgtattcctaattgaaatcttatttttcttttttctaatttcagaatttattttttaaaaaattagttaataccgtattgtgttcttttaatgtttttattttttattttcaatttcagttgtttcaaaattgtattcctacttgaactctcttttaatttttctaattttggatattattttattttttattcaaaattttaattaatttcatattgggttcttatatggattcttctttcaatattgcttatttttaattccgaatttcagctaattttaaattgtattcctacttaaactcttcttttattttattttgctaattttggatttatttttatttttattctgaattttaattaatcttgtattgggttcttatatgggctcttcttttaatattctttatttttaattccgaatttcagctatttttaaattgtattcctacttggactctcctttccttttctaattttagattttattttatttttatttcaaattttgattaatctcgtattgggttcttatatggaaacttctttcaatattgcttatttttaattccgaatttcagttatttttaggttgtattcctacttggactctccttttcttttctaattttggattttattttatttttatttcgaattttgattaatcctatattgggttattatatagaaacttctttcaatattgcttatttttaattccgaattttagctatttttagattgtattcctacttggactttccttttattttttttctttttctccgattaatgtgggaatttctagcctccatagcgaatgtggtgcctccttttcgagctgtcttaataatataatagattttcagtcagttagtgctatttggagaaattttcagttgaaagaaggattggggtgcgtttggttctttgccaaacctaaccaggtaaccaaaatttaagcattgctatttttttcggtttggttgattttattgagttacatttaccgatcactacaatccaaaagattaaggaattaaatttgaaaatatactattcatttaattttttctcagtaatattcgggatgtaaaattttttagggaaatataccgtcggcctctaaaagatctgcgatttattttttccaaatcttcgcaaaagctttgccactgtgcctccatggaactgcaaacctgcgatagtagtacaacaaatgcataatttatccacttcaagccctgggaaaatcccatattacaaaagggtccctcccttcttttcgatgcccataccggggcttcccctcctcctcaagatcgcctacgcgactgccgccggcgcgttggcgctcattgtcgcggcggggctccggcgggatgacgccgtcgcctccctccggcgggagatacgcgacgccgtcgccgccctcgtggcgagcaacgaggactgcttagtcatggggtaggtccaaggacaagaaacctcctctgacccatcctcttcactacgttagattcagtattgcaacacgaggaagatcgttctagtgattatctacgtaaaatctcttcctactacttttgttaaataacttgtacacaactcagccgcttctaaaagatacttccttctataccactactagtggactcgtggtaatatctttaaaactactactgtactctccaatttctcaattccttgtcttcagccataatactgtattacttctataaacatctttatttccccttcttcaacctcacacaactcact

SEQ ID NO: 6691 - DNA, 22657 bp, Oryza sativa
  unsure (1)..(22657): unsure at all n locations
gtgtcccttgataatcgnnnnnnnnnnnnnnnnnnnnnnnnnnnnnnnnnnnnnnnnaaaaaatttgtatcccgaatattcgtgagaaaaaaaatcgaatgaccaatatattttcaaatttaatgcaaagattaagttgatgagaaacgacgagcaatttattttatatcctaacactaacacacgtgaggcaaacaatttattttgtactcagttactttcccaaaactttggcaatagccaactcttgccattgccaaaaaaaattggctaagactacaaacgacaccaaaccaacaggctgttggagatgtttggacttgacctgaaccgtccacatcttatgggcctctatatttgggccttacattttcccaaccaaaataacaatacgaatcttgatgggaagtttagacggctgagatttcgcggtaaccgccattcaaacccgccaccgagttccccgccccaaactccgccccgctctctccgaaccatcaaacaatctcgcaccactttctctctctctctctctctctctctctcgtcgcgtgtcgtgtcgtccggaaatgccgccggtgtcgtcgtcgacgtcgaggccggcgtcgctgccgtcgtcgccgcacaggccggcgctccggccgggcagcctgcagcggctgctccggccgccggacccctccgacgacgacggcgccgcccccacggcgccccgctcctcccgcggcggcggccgcgtcctgctccaggtcaccaacatcacccccgcgctctccggcgccaaccctttctccggccaccacggcttctacctccgcctctccgactccgcgcgctcctgttacgtctccctccacgccgaccacgacgacctcatcctcaccaacggcctccacatcggccaggtcatcgaggtcgagcacctggtgccgtccgtcccggcgcccgtgctccgccatttccgcgtcctccccggccgctacccctgcatccagcaggaacccgccgacgacgccgccgccggcggcgccgcggcggagatcaaggaggtcgtgtccgagcgcccgcgccgctcgtcgccgacgccccccatcccgggcgagaggagggcgcggcaggcgggcggcggcggctccccctcttcgatcagctaccgccacaggtcacggtcgatatcgaacttgtcggaggcgggcgcggcggcgaggaggagcggcgccgccgtcctggggaagctgaggaaggtcagcgtcacgtccatcgacggcaccagcaccgacgacgacgacgaggagtccgacgtgtcgtcgctgtcctcggcgaggaggaactgggatttcaccggaggcgtcaaggacaggaggcccgtcgctccacggagacgcgggaacagcgtaaatccatttctttgaatctcccaaaatttcgcgccaaataacacacaaattgcaacaaatcaaagctgattcggtcaatttttggtctatcatttaggtttctccaagtaaatccggcccaaactctactatcacgcagaatgatgatccgatggagtcggtgaggaggaaagccgagaaggcattcaacgtgctctccaagagggcgtctgctaagatgaccagagaaagctctaattgcacggtggcgacgccgcagagcgctgcggcgtcgagcagcatcaagtggtgtgagagcaatgtgatgtggagcacactttcatcaagcttgctgaagcatggaaaggtatactggtatatctccctagttgattctactgcatttttttttgcttggttctgttctttcaacaagttaattctggtgattattgtttgcccccaattgcaggaagcagtgaagcagagagatatggcactgcaggctgtgcttgatggattgctagaggcatctaccactgagaaattgataaaatgcctgaggtgagtgatgtttagagcttatgtagaattggcgagaatgattgggtgaaaattttacatgaggattgagaaatttgggaataatacagtctgttagaacagtaaatttgattgatatctgatttcacttaattatagaattgtatgatcaagtttctatacttgtaaataacattgcaccatgtaattgatagttcatttccccctctttttgcagtacttactctgaactacaatctgacaaggaagaaaacccaaaggagctcatcgacaggttcttgaaattctctcaggaactggatcatgctatcttcatcgcccaatcacagaccaaaattaggcatgtaaaagcatgtggttccaattcaacatcctcagcttcaaccaaagctgctttgaaggctgcattggataggaagcagtctgccatcttatggatcagagaagccattgaagcagacctctcacctttttctagccatacaagacccactgaatcaccaaagctatcactggcagagtcaaagcctatgaccccattgttctgttgttccaagccaaagtgcaactgcagcaaaaggtcctcaaggaaagcatctgatggttcctctcaaggaagtaacatgagtgctgccatggacctggctgtagcactgagatcagagtgcaactgttggttcctcaagtacatcgacaagttcttggacgatatcgaaagcgagaccatgtatgcaccatgtgattcccaagttgcaggccttctgcagcagcttaaaagggtggatgactggctcaaccgtgtcgcgctacatgagaggatgctttcggttgaccgaacaaacaaggatatcatgttttctgaagaagaggagagcgatgcgtgcgagagggtacggagaaagatttatggagcccttttaaggcatgttcaatatgctgcaatggcgctagaaggtctaaatggtgtaattgatgaagagaaggacgagagaaaataacagtaactgtgcaaagagctttatcaatatatagaatgaacaaataaattttgtgtagctgcagataatataagtttaccatcgtcagaattctagctggtagaagcatgttaggcataacttccaaatgctgtctgataaatgttggatgctctgatggtattgttgcaactattgctaatcttgtctgtgatgagacatggcatccaaaaactaacaattgcctcaagtgcgactttaaggccatgaaagatctgaatagtactattggtgaacctaagtaggacattgaaacaaagctgaggatatctggtgcaatttacactctgatcaattacttgctacacttgtcattacatacttgcatacatgctcatgactgcatctcacatttcattacatgttcttcggtacatttcaatttgtgttgatgtactggtgatgtcaattgtcaagtgtactgcctttttcaaagttagggcccctttgaatcaaaagaattatgaaggaattttataggattgaaatcctataggaaattttcctatgtagccctttgattcaaaggattgaagttttccaaatcctacaaatttcctatggaatggcttatagtatataggttttggaggaaacttagcaagaggtccaacctcttggaaaaaatcctttaagtctatctctctcatccgattcctgtgtttttcctgtggtccaatcaaacgatcattcctatgtttttcctgtgttttgcaatcctctgttttacgcttacattcctgtcataatcctatgtttttcctattcctccgtcttttgcagggatgaagcaaagggtttacccctgtgtgtctctgggttagtatgtgtacaacaaattttgaattattttttagaaattagcctacctagtacctctcttttgataggattaagcttgtattattcctgtcaatgtatatttctctctcaaaaaaataaacaaggtataggattagtgttacaaatgccaacactgtgacatgaaaaatactcatctcaaatggaagtcaatcatatcacttgatctttgatcattaacatgatcatgattacttcttcttatggctttatggtaaatgccaagtagtaggaagaaaaatgaataaagttacattacatgtatgatatttgggactatatgggccagaatcaattaatctctatgcaattcaatgttagctctgtatatccgaggcgatattatttttgcagagaagagatgttcagatcaatattgctgatgttgactccattgtaagcgattggtgcatacatccacgtgtcatcagagcttagcaactgcacatgatagtttgcagcaaagttaggaaggtatttcacttactgtttatagaaaaataatttggttattaacaatccttggctagatgacaatgatatgtaatgtacccaccttaatctgaagttgcaaaaatttgacatactgcactgcttcctccagcattgtactgatgtcaacctgtcagatcatacttatcaagttacacccaaatttctttgtaccaattatcatgctcaaatgtatgaggcaaaaacttagttattgcctgtagttaagtttcatattgagcttacctttgttccattgggaaccaagttctgcaggatcctcaatctttcattgatcctctctctcctcttctgtagaacggacaaatttaacctcatcagaattccttgaatcactttgtcattttttttacacattttattttatttgtacttacccttgcatagagactctggggatcggttgccgccccacggttggccctagtacccatcttcttcgagctcggcttcgcgttgccctccaggtttccttcctctgaggtgcaactgctagaactttgcgtatcaatgtaggtgttgccgccttcgtcgctgccaataggatcttttttgccagccttcttgctcttctttgatgcctgtatcagttcatcaatccaattaggcatggaaaataaaacagcatggtaactgaagtagatcactgttctattaagttatttgcaggggcataccgtcatggcagcactagacttcctcttggtagccactggtgtaacaacctttgtagcttcttccactcttgctgatggatggttgccatgtggagggctgatcagatcctcagtaaggtaggggatggcgcaatgcgcgtcgagatcggcgatcgggaacggatccatgaccgggaactcaaagcttccatagctatgagctggatcagggaagctggtgacgctagagctatggccatgctgaggccagcattgtggaggcacatcgtagttgagacaaccagaagaagaattggagtcggtgtcaaggccaggcaagaacatcgctgccattgcctccatggactcatccatttgctcgtaggtgaagcagtgatcaccatgagctccaagaaactgcgccatcgcgtcggcctcgatcaacggcaccgctgatgtgtatgatctctccatttcagcaaggtgaaaaggcctcaaggcaaagaaaagcactagcttaattagagagatgctgccgctatagtcagctgcaatggctgagttgcttctgccatgcgtgtgatgagagggtatttgtagggtgggtgcagctgggtggccaccattgctgaccacgaggatggagacgccacacaaaaacaattaatcatcaccaattgtttcttgttcttggcaaagaaatgttatctccaatcctcagaggtcaaccccgtggggacggtgctatgtttgatggcggccggattcttgatcttgatatcgacagtccataaacaaaaccagcatgcgcaattatgtcgcggaggtacggcgagtattatttatcttccaggcaagattggtatgatggggattgtttagccttgaaccaagagatgcattggcctctggccatttgcgcaattactactctcccttgtagaacgtgggaagtggtggtgagttgaagcgagaggcggatgcaacgcaagcaaattaaagattattgggattaagctcttgtgtggcttgctcagtatctaaaaaagagttcttgtggatgctgcattattgtggtgaatgatcagtagatacaccagttcatgccgttgtgatctcgtgcttgcaatgggagctgcagaaactacatatgttgccatttcctgcaacttggatagctgtcagatcctcaagatggggggaagaacagattccattgcacggagctgatgttgcaacaaaagttcttttgtgctcatttgatcttgcataacccatgtgggttcaattataacttcaaggtgtaatgtgaagattgtggcaagtcgtttatatttacaatagggatatttggttatcatcacaattggtaagtggccaccaatctttgtactatgaactaaacagcagtaatcaaatatggatataactatgtaactgttctctttttctttttctgttgataaatgctgacttcttttttgggtggaagaatatgcaaagtacaatctccatgtgagactttcagactgaaaaagggtttgcatccgatccaggcaatgttattggaaaaacagaaaaaaaaaacttatcttagctctatagtacgggataggtggttggatctgcaaaactcaaattagtcttaacttctaaaaaaactataactaggcatcaagttgctttttgtattttctgatcactacatatgtatttttttttaattagagttctacagttgattcgttgctgtttgtgacttatttctgaacagtatatttgatatggtggtgttcttctgaatgaattgacaagagttcctacccttttgcttcaaagaaactcttgctttgcaaatgtttcataaaatcaatttaaattcgttcattctttcacttatatgagattatgagcagcagatacattttttaatgggagtattctgcacagttcaataagcctaaaaataattagcattagttccattccagacaattaaatatgcttgttcagtacagttcaataagcctaaaacaactttcaataaacataaaagaattatcactagagtgaattaaatatgaaaaatcggtgattgaatctattatactatacatccatcgaattctttagcttaccatgcatcgttatttaactaatctctgtaaatgattacaacaatcaactaacttgagctatccactgatataatttacattatataacgttattaatgatagtctaagtactttgtttgtacttatatttcaattaaccctacaactcgtttagtataatcttatcatgatagactagtagctattctgaaattttgttgcatgtacttctgaagcactcttaaggctaaaattatatctctctctccttaaaatattaagggtggctccaagaaggctagaagtcaatgtacttgcaccatctctttctccaagttatcgcttttcagtcattggtggatcaattgaggccacaatctattgtactatttctcaaaattgactcacttgatatatattctgcacccagtcttaactggcaaaaactgtactacatttgtgagaaaaattagagtatgttgtcggctagaggttaaaataggcgatattttgcaccttgaatacttgatgttagaatcaactagggaagagaacaaatggtgctgccaaaaaaaaaaaagattgtaaattgcacgcaactcttttgtctttactccagacagattacttactgctaactcattgtcagctaaggcagttgacatttgcttactatgatattagactattattatttttagattattagtaattaacagagaaatatgcatacataagggtttgttttcttcactaaaattggttgactctcggttcataaacagagaaggaagtttccttagtgtcattaaagtaggtaaacagatttctgacttgttaataaaatgtacatttggatttaattataccgacttcctcatgtgtttttcctgtcattctgagtgcattgaacctatatcaaagtatgcacctttcctcatttaattacaaaattgaataagtctaacaataaagtttatgctaaaatacactgaacattcttaattttagacaactcttacgaaagagtatttcatagttgagttaataatccaggaacaaaaaaagcttagccttggctgtcactcttgtcacaaatctaggcagcagatcttgtgttggaataaaaccacacacacggaatcggtcagcattaggcagcactcatggttcattgcattggacgataattaccctaatgctttcactactaattagcactaaaccaaactattatgtatttaatcctaccaaaggcttccctgatccatggcaattatcaaaatgataaacttagtggttttgatgctaagatgcagtactactgtactgcttaagaatcaatgacatgaattatattaacatatcaagaagatgcacgtactcccctgcagaacagaaggattatcgaaattggggtccaagttgtttaatgattattcgatccttgtcatgctttgacatgattaaactacctaaccaccaatccctaaccacctagcatctaattaaactccttgtctgatgtaactaacaggattgcataaagtaatcaatcaagtacaactccatggaccaaagcagaaacagaaaaacaattgttgagtttactaagaacactagaccaacttgcagatcttagcataacacgtaatcagacggggggaagtggctattgctggctctatcctgcttgggttctttgttttttttaggccatcctcttgttgaggttactggaatgatgatgcagagtgtgcaatattgttttatataaaaaggacgctttagtacagtattgccctttattagacaattgccctttattaagcctcgtgttgcatacgtacttaagcatactgagtacttaattagctcctgcttattatagcctaaactttttttttgaacgactcgcacgagacagtgcgaagttctattgatagagcagaaaaaaattacaagattacggtcctggagggtcgtagccaggaaaaggaaaaaaaataccaccacccacgcaccgacatcaccaacacacaagcccaggagaaggctagcaccggaccggccgccgctaagcgtgaccgaccgccactagaccgacaaagggacacagacgagattgcccccaaggggatgccagaacgacgtcttcaagaagagaagcgacggaagaccgccgccgccgtccgttgggactcaaaggagccaagattgagctttcaccaggcaaacgccctcaggaggtgagacagcacgacaatgccctcaggagggtgatcatcgttgtcggtccggccgaggccggactaggttttcacccgccgctcaccacctacgaatccacggctgacgcaccaaagctccaccaccacactagcgtcatagcctaaacttctggttagcatacaagatattctacaaagcagaaccaaaattttcatttcttgatcctatcgtcatttgtataagcaagttccaatgatcaaatcctggttctgttgaaaccacagcagttcagttcacaaacgtcagaggctgcttacaagcttcctggaacaacaataatgtaaactatgcaaaatcagcagaaaacctttttcttccttgaaaatggttggtaaaacgaaattcactgtgcagcctataacttgtccggttaatccctacaagtaaggaatcgaagatgattaatttcacacctattaagattccagcaacactattaatttatcgtcccgttcttttctctaaagatacaaattttactcggttttcgttagtatgttttttaaactactcaacagtgtatttcgtgcgaaattttttttatatgaaggttgttttaaaatattagataaatccatttctttaaaacttaattaattgatagatttcttgttttgtgtgctctaacgttatattcgtatcatatcttactataaagttattccccactaactccttaagcttaacatgcaaagatgccacatcatcatccactaattaacaagatgccacatcatcatccactaacaatcatcacatttaaacatcatgcaaacatgctatatctttatagtttttataatttaagaacttttcaaatacaaacatgttaaattatcatccaacataattcacataatgttttaatgtatatctttattatgtgttatgatatcctatatacttatatagttcatcctcacttagttagtgcttaaatgattaatctctggtacaaattatctttcttcttttttcctctaattaagtcatatcacatcaattgtttttagcatttagatgattaatctacggtccgaactatctccctacttttttttcttccataaagtcataccaccttactttttacatttgaatcaccattctacatactatttaaatttaaattatcataaaccacattaatttacttaatctgatgttatctagctatcttacacgctaatttttttattgttatcacactaaattcccgtagcaatgcgtggggtttcagctagtacattacaaaagaacatatggcggcttagacttaaactccctaaaggttaataatgacaatttcgacaaaaaatcgtccttattaattccatgttactcttgaaagcgtttaaagggaaaaaaatagtcactccccatgatcatagatataaaaaccagacagtcacttaataattcttgcagaagagaagttcataataatcccatttccttaatagcttagtcctattttgattcagtacgatcaacaatggcgatagtgtcatgatacctcattaactacaccactaatccactaactactcacaaaccgatcttgaaataaaaatgctagaaaccgaatatatataatttcgatatgtaattaatgccggttgagtagctagaaagtgggaaatcccggcttacgtaacattgctttatctaagatcctaagataaacattcttgtttttctattcagcacgtgtaatgatcattgctagctccgtttccaagaattctgatattttcacatttttctggagctctgaaattttatttagagttctcacaacaaataatctccatgttctagaatttcaatatcttcaaagcatataccaacaaataagaaaaaaaaatacagagttcttcttttgcaggaaattgccgtcaaacttagtgatgggtctttgctcataattcagtagtagacaatagtgacatttttcttagataattaatctccattacaaaaagtttgatttaaattactttagttggacaactgaagcaagttcttgggacttagcagcagtcggcatggacagcaaaccttagccacgacacacactgaagaaagacaaatcgatggtgccacctaacaacatttcgatttcttcaggtacagatattccaactggcaatatgggtagattatgcatatgagtcatatgtgacaggcaaatataatcaaattatgcgagttaatttagtttccttagaaaagtagagatgaacatatgctggcgatagttaataccactagaatcctcgagatatttcttgcttttatttattaagacagctattcatggagaactggtttttaattaagattaaagctagctttcatggggaagagaggactagctatagggagcaagaattccgagtgccactagagcaagttgaagttggtgagatctactgcattttttaaactcaatcagatcctagtattaatgaggttttagatgcagatatacaccatttgtcatgctcggcttccaggtccttgatcattgtgtttccccaggtatcatatatctgcgtggaacacatcctataaaaatatttcagttctgtggactaaaattgcttcaatgatctctgaattcctaaatgcagaattacagtatcagtcaaatcttcatcctatgaaatttgtttgtcttaattgtacatggaatttatgaactagaaatttctagttggtgaacccaagagtccaagttcaacttgtctaaaccatacggattaatctttctgtttcatatttttactaaaatgcaaaggacacaatcatgccatagaacatgatttccttgcattttcagagaccaattgaaccggtggaatatagagaattcacacaaattcgacgaatttcccctataacatatgcttatccaaatatttgaaatgcgaaaagatttttttttgtttctacaggtatttagctaattccccattatctaaaaaaaattagctaattccctcatgaaatttataggttcttatagattgcgtagctaatagaggaaggaaatgtacttatctacaccattttcaatatttttaacaaataatgttccacaagttttctacgagtacattcttagagctttattcggtttggaggaatttcaaccataaaaatagggaaaatggagaaatagaaatgcttgcacacttcaatccattggaattttttaaaaggttgaagtggatgaaaattttcctataattattcctctacaacttataaaaaaaatttccttcggttttcctatactgacattccttggtgacatttctgaaagcagcagactgagttccctttaattaggcactggattttacaaaacgggccgaatttagtcgagtgaactcgagtacaagcccattttttctaggcccaacagatataactcgcagcccatctcacggcgaggagcgagctaaaccagccggcctttccagaagcttctcctttatataaaccctcgccccgccaaatccccaccgctccaaatttcgaaaacctcctcctcccctcctctcccccaccacgagacctcgcatcgaatccttcctaccctagccaaatcatcgccgccggcatgagcaccgctcccaccggcgatccgccggtccgcgtcgccgtcgctagcggcggtggcgggatggggttggggaaggagctgcgggagccgccgtcggacggcgtctccagcctccggttctccaagcacagcgatcgcctgctcgtctcctcctgggacaaggtgagctggagcaaagcaatcacgcgctccgatcggtcggatcggcgcctcgctggtcgcgcgcgccgccgcttgctatttgtttgggaaaaaaagcaaaccctagcgtttgggttggtttgatttgatttgatgatttgatccatggggttttgatggggggagctttgcttttggttgcgggtgtgttcgccgtcccgcagacggtgcggctctacgacgcggaggccaatgtgcccaggggggtgttcatgcacgcggcgtccgtcctgggttgctgctttcacgacgactcctcggggttcagtgccagcgccgacaacaccgtgcggaggtgatgccgatctccttccagtcccgttcgattggttcttcattgagcgattcagttgagataacggttgcactcttagttcactattgttttgtgctgttctgaatggaattggggctttctgtaaactaatcctccatttcgcggacgtacactatgatgttaaaaataggatatgggggtaattttagggtttgatcatagtatgttacgaacttggatcaacgatcagtatcaaaattgtgctaattcatattttgcttttctgttagttcagatcactcatgtaagttgaagcaaaactgatggcttgtgtgttcctggaactttttttttttttgcaggttggccttcagttctggtgggaattatttcttggtacgccatgatgccgcagttagttgtgtcgagtactcctactctactggtacctgttatcgcattttcatctagctgaaaagtgtcgttgattcacccaacttgagtttttactttttagaggagtcccttccgccgacctggcagtttttagagaagtcgctagttgaattcatgattaagtttctagatgaggcaggtctatctcttggaatttgttaatttcatcctaaaaagtactagagcagtgggatcagaacatttactagttgatttcatgttttagtccctcctgagaagggtaatcctatcctagtaagctggttaatctgatttcagaatgaaattccttctttgttaaagacacataaccatcttttgtcaccgtgctacatgagtttttaaatagtttggctatgttctttaccattttaggttgaacagtttatcaaatacccattccatgtaggagtagttgcttataatatccatcttctgtagctattgcttatattctttttatggttgacatgatcattcaatcatgttgtattcaaaggtcatttgaatgtgaattcttcaattgtgtggtcccaattcactgtccagaatggtcgtcagtaactgttgaatgaatattgattaatcctagcaggatagctatctaatgggccatgttgtttactcgttatacctgcatatgtatcgttgatgaatattatagtaaacagtgcatgaatttaggcttaagaaatttgctactgtgtgaagtgatccttgcttactgctacatcacttcagtcaccactttgtgaaatgttttggtaaattctatctacctcttgaatcttccaatataacattcttaatgtatgtacacactacttttgaaattttaagcacgaagctgatgcctgatgccattatactatgatgatttataatgacatcaagttataattaactaattttacttcatgtttatttgcgtcactgcattgaagtagccacttgcatgaagatattaagaaaccaaccatatcaaagcttaaactgtctccttatatatgtggcagtcatttcctgtaaaacctcaattcagttagtgcaataattgccttacaatttgttgcttcttaatgatatcatggagcattttgtgtttacctctaccatgtttcacgccaggacaagttatcactggcagctgggataagactataatgtgctgggatccaagaggtgtcaatgggacaagtcatcatacacttgttgggacacataaccaacctgaacgtgtgtactcactttcagtatcaggatataacttggttgtcgcaacagcaggaaggcatgtgaatgtttatgatttgcgcagtatgtctaggcctgagcaacagagggagtctccactaaggtatcaaacacggtgtgttcaatgctatccgaatggaactggtaaggcactgttacttgattcgagtatttcttcgaacacttaagatctatgtgtgctaaataatgcccatgatatgttcactcttttttatttgtgagcaacataaaactgtgctaggtaaagaatgcttgtctagtttgatattgaagatccttattggtcagttggaaatagactatgaaactcaagtcatactagcttgtaataaatttctacatggttgctgttcccctagctcttgagttccatacttgcatgtatgattgaaatataaggtgcttgaaattcattcgattatattgttattgttttcgtgtgcctgacttcagctgatatacaagttgcttcaaaccatcatttttgtattggtcatttcggctctgttgcttctttacaatatacctgatgtgtttcctaatatactgaggtatgtggaggcatctcatatgtctgttattgacatatgcaattgatgtggaaatcatgaatgcacatccatgtattcttcattaccagagcatttgactgtttcatcttcccacgcctaatttctgattacatttgctgatttgcatggcagtggcaataattataaatttaataacaagagatatttttctagtttttgcaagggttctagccttaaattttatcttgcacgtaaaaaatgttacccaatagtggtcccgactactgaacatgaaggcaccatttttcaggacaaaaggcacaggatgactcatgcaatagatattttatttcgatttcaaatattcattttctaaagtaggtaatgcgaggatatcatctcttgaactaagtgacagctatcttttatttttatgccgtcttttaaatcttcttttagtttcttattaaaattcagcaaagcaccattgagtaaggttccaaagttttacttactagtttaggctttgaattccttgacataactttgatacaggatttgctttgggttctgtggaaggacgagttgctatggagttctacgatcaatctgaatctgctccctataagaagtatgcacctaagctgctgaaggaaaactctttcctgatagctatttacttaagctgatattattagctttgccggagatcatctttttaatctacatattctgctgtgttccatttatatacgtagttacatgcctttattctatccaggtatagtttcaagtgtcatcgagtgcctgaggatggagagaccaaagtctatcctgtcaacgcaatttccttccacccagtgtaatgaaatccccactgatccctcacaaacggttgattattttccgtttctttaatggcctcatctaacatatgcagacacggcacatttgccactggtggatgtgatagatttgtgaacctttgggatggcgctaacagaaggaaactgtttcaagtaatagtcccgcgaactattttttgaagatctctaattctctattctgtatcacaaattcacatcagaatgccttagttcttttttttttcatcttttggttgcagtttcccagatacccatccagcatcgctgctctgtctttcagtagggatggccgtctgcttgctgttgcatccagttacacttacgaggagggagacataccgtaagaccagaatttgtctaacccaactattctctgtcagtattaagtattaacagttgaaactggttctcaccagcattattttgtacaatgcagccatccgcctgacgcaatctttatccgtgatgtcaacgaagtacaagtaaagcccaggcccaagatcacattcactgatccgccatcagtagcgtccccatcagtttgagatgaagcaatgctagtgaggtgcgtgtcttcccccaattcgcctgcttccttcgttagttctgacgctttccaaacttgagtgctcagcgttaaccgttaggtgaaactgtggattatgttcttgatagtaacactggccatgtgacagactaagacagtatacactatccttgtgcggtagtatgtgcattgcgaaagacagaagacggtatagcttggggttattaaatcactaaaattcccaaaggtacaaactgctggtaattctcaacgtataaactcagttcagtacgtagttcgcctcaccctgccatgtcgagtccaaatccctcttgatcgtctttaataaaggagaaaaggatcagctcatttatgacagatccaactggatcgagcagcgagacccacaaacctagtattatactgctaataatattatggaattccaccaacatatgtagacagcaactcgtggggattattctccacggagacgattagggaggcaccgtgcggatctgctcccctatcgagcgcacttaaagcgttcgtgagcgagcatgtgggaagaagctagcaatcaaggcacagctaatgttgcttccaattgaaaattaatgccctgagtaaagtattagcttttgattctgcgaaatactaataccccacgtcgagagtgagtggcacagctgcaggctgcagctagttacagcagcagttgtatatatatgcctttgtcgatctgcctttgtgttttagattctggtacccgtgtggttattaaagcgcgaagcgagatcatcactgatctaagtgatcagctatggctatactgccatactggggcgcaactaagtgtgctaatgattgagccatgccgccaaattgtgctacaaagtataattgagcacgccgctgcacgggcacgcggtaccaaccgtccgttgtgcacacgttggctcacgttttgtcccaaattaatgctagtgttagtgtttctgtagtctcaggagcagaattaatgagtttgtactttgtactagtccttattttaccaaaccaaggttttgaccttttatatgacgtacgtattgcatactgacgacggaatgctcttgcttccaagccgaaatagctgtggatttgttagtgtttaattcttggacagaaaaagatgatttgaacgtcatatattgtggattagaactttcctgcgtgaacattttaataaaggttcttcaaaccgtccattttaatgttgccagaaaacaacagttcagagttcagatatgtatcaactggttaaatcattgttgttcatggggcggcctgtgatcaccgtatacgtgtggagctctctcccctgcgaaggctctcgtggcaggtgaggtgtctcgcccgtgcggcacacctggggcgaccacgcccaataacgtgcctgctcccccggcgtgcccagtagctagcggcacgccgttgtcgctgtcctggcagttgatcgatcgccggttggtcgagccctgggccgtcggtgcacccagcgtccgccgcgtggcaagtgcctgtgagtactggccagtgtcttgctgctcgagtactgaagcgtgttcagttcccattggtagcctggggaccaagtagcaaggaatcaggagtctcaggactgcaaggtgctagtagcagatggatctggtctggtgccatgtacacggcacacgtgcatacgctttgcaaggattcgcaacgagaattttgcggtggtgccgtggagctatacgtgacaaatgtggggccagcttccttttctgcgccgggcatatgctagcttgagtgtgaaaaatattactactccctcctttccttgttatatgatgttggacgtcaaacaaataaaatcagataaagaatacatcactaaacagattttagaagagaaaattacacgaacaatggtcagggatcaagtcgttctcaagctcgggatgaggtgaatggagagaaagtgtaacttacccatgacagcaacggtaaggagtaaggacaactatcttcttatattaataacgagctcttccgctccttcgatgctagtgacacataaactttggtatagagtatctatgaatcagggttttgggactaggagataatggagaggggacgatgaggatatcttatgagacaatggaatgggtggactgcgagatgagacataagcgttggtgctggagttgtgaggatagtgaagggtgctagggttgtgaaagagtggtcagatggcgggttggtggtggcgtctctagtggcttactccctccgtcacaaaaaaagacaaaccctggtttccgtgtcgaacgtttgaccgtccgtcttatttgaaaaaaatatgaaaaaaatttaaaagacaagtcacgcataaaatattaatcatattttatcatctaacaacaataaaaatacgaattataaaaaaattcatataagacggatagttaaagttggacacggaaacccagagtttgcctttttttttttttgggacggagggagtacatcgttggacatatagaaaagatgatgggaacgggacatctcaatgttacctggtttagggaggaaaggacgatggtccggtgagccttgccagcatcattggtaacttttgtgctgatgaggatgaggtagagtagggaggagcaccgtgacggtatgagtgagctttgtatggggattaggggaaatatacggtcgaggagtattgtattggcacttattttgatacgatttcagcctttcaggtgtctaaaattcatgtgatttttgaagaaaagaaatgtgtgaagtaatgcattgattgataaatagctaaaaaaaatcggttatttgatccacaatggataacctagatagaacatccgttgctattgtgctttactgcagtatatacgaccaccgcttcatcccaatgactcgatttgttcatccctgtattaggctgtattccatcggaagcaagccatcacatcccaatcgaccgtctcagatcctacaacccggaaccccgcaaaccaccaaccattgtatcatttcacacagacctggatgacacgttggacttcgcctcgccctccgactcggagtcgtgctgctgctgtgggtcccacccacccttcccgcgcgccccgccgccggccgccactccgcatccccgcaccagtcactccaccgcgccccgcacccccctatatatatggccacccgaacccacgcctctctccacttcgcccacgcacaccaccaccactctcccctggttacttgtccaccccaatctcatcgctcttagtcaactccgccgagagagactgatcgttctcgttcagctctgctctgcccatggcgctcgacgggaagccaccggtgccgccgccgtccacgccgccgatggactcgtgggcctgcggtggtcgccgctccaagcgccgcggcggcggcggcgggagcagcgggagtagtggcagctccggcggcggcggcggcggcgagtccaagaaggagtacctcgcggcctgcctcttgatgctcgcgcatggcgtccgcgacgaggccgaggtcgtcggcgtcgcggcggcgacggcgaagccacagcatgggtacgagtgctcggtgtgcggcaaggtgtacgggtcctaccaggcgctgggcgggcacaagacgagccaccgcaagccgccgtcgccggcggccgaaccggcggccggcgaagagccgtcctccggcggggtggccggcgaggcgaaggtgcaccgttgctccatctgcctccgcacgttcccgtccgggcaggcgctgggcgggcacaagcggctgcactacgagggcggcgccgtcggagacgccgtcaaggagaagaactccctgaagaccaaggcggcggtggcgacagcggtgctgaaggacttcgacctgaacctgccggccgcggcgacgacggcgggggacgaggccgagagctcaccaccggaggccaagagagcacgtctgctgcttctcgtctaacccgcggcggtggcggcggcggcggcgncggcttgtggttttgatggtttaggtgcttagccgttccggtttaggtttcagattgataccgggttgttaatttcattgattgatttattttagttcacttctggttgggcgatggagacgggtggcatgataaacatgccgtgtttagatggtttactgcaattctagggagctagaaattgtcctgggctccattttttaaatttttaccatgtataccagtacataatttgatacttaaatcaattcgattatgaaacccaaggcggactgataccattgacgacaagtttgctgccaatacggtgattgtgatttctatgaatcgccctctcggcctctcaatcgctctttctgcttgtttgggaataggaaaccctagttgtttcttttggtccacgtacgggtcgtcagcgacggcgccgcttgtgaaggtgacggcggtctccttgtccgtcccgtcccgttcgacttcgattggtttttggatgagcgattcaattggggcaagactactgcaagtgtaatcaagtattgtttgcgactttgcgttgctctgaatagaattgggttctctgaaaattctcttctccattctggagacgcacatttataatgagaaaagttggatatgaatatagtttcaggacatttgtgagttataaaaccagcgagcaccattgaaaattcggagttgtgctaattcatctttctcttttctgttaggtctgatcagtaacaaaaatcgaagtgaaactgatgcttatgtgttcctgaaactgtgttttttcaggttggccagcagttctggtggaaataatataatggggccccatgattccccagctcgctgtgtcgaatactcctacagtcctacatgcaggtaggtactcgttattgcgttttcgtgtggctagaaagtgttgtttgactttgtaaaattcattttttttagaagtcgctagttggaattcatgatatagtttctagatggggtaggtcttctaaaccctgccaataaaaaatgtctatcttctgaaatttgtcaattcgacctcataatgtgctagctgagttcaggttttactggtaaggaggataatcctatctagtatcttagaaggaacttccttcttggtttaagacaaacttttatcacagtgctacaacagattaaattgtttagttgtggtttttatccattttaggccgaacatttatccttctgtagttactgtttatatttctgtatagtcgatctgatcatggaatatatttcacgttgtgttatgcgatcattagaaagtaaagtagggtgcgtaccagctggatcacaactctg

SEQ ID NO: 6692 - DNA, 741 bp, Oryza sativa
  unsure (1)..(741): unsure at all n locations
gagtggttttggatcctagctggtacccgagacgcagcggttccacatcctcgacctgagcaacacgttccttgtcagcgaccgtggaaggggaggagcgcggtggactcggttcttggatttccggctcgagtcggaggagaagatggttgggttggaccagtctgtcaggctagcgagaggtctcgcgtcgtcacgacgatttgatggttttggacagcctctgcgtgagagtgaaggggtgtaatggcatcatccggcgacagtatcggcagattagataagcatttgacttgagcttctgtaatttgacctcacttgagtgagtgagttagttaatgagacgtgctcggacgagcggcgatggataaaagcatgggcgtttgtactgcggagccatccaataacagctgctattgcttctgagcccaacaaatcacacgtgatggagccaggttgtacagtggtaagatcttgagtgttgatacgttgatttcgacggggttaagacttaagaatatagaatactactgatgtttttagatactcatgcaccaaaatcatgtgctccaatttggaatttgcaggaaaagaccctaggaaggagggtcaatgctacaaagcgtcaaagcacgcgccattttcttctttttccacacaaatcgactcgttttatcctatctctatgtgaaccgcacgggtcatcttgccatgacttgcttgacttatatttnnttttcn

SEQ ID NO: 6693 - DNA, 13721 bp, Oryza sativa
  unsure (1)..(13721): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnagcaagcaagggaataattttcttttcctctcaactcatatcagcatgcagctgatgcctgacaaagcctccaaggtaggttgctgtcgtcctggcctgaacggtcatttcaggcgcgcactagctggtctttgatgtatcccaggattgttggggcgacgggggaatcgcttttgtccagaaattggaacggccaaaatgtgcggtgttagtttttgatcagatgttggagttgcgctgcttaagagagcatgattagtgagattaaaggccctgttttcaacgtggggttcttacaggaattttggagagtttggaacagagagaagacataaatttctgagaagatctatatacgatactaccttcgtttcataacatatggatcaatacaaacagtacattttattagtatgaatgatcagatggtgtagattaactggcctaccaacttaaattaattgtagtataaaattgaaaaggggataattgtctttctaaatgtttgcttgcagacaactgttgtacataaatgcacaatgctagacgtgttcctcacttgatttcattccccagtcccgtagttgtcgtccatcataggccataccgccatagagagacgccacacgcactgcaagttcacgcgcaccacgctattgtgcctgcctgcctgtaaattaattcgaattgcctttctttcgtcttctcaatttccgacccacccaaaaccctagctagttcctctacctggaggaggcagcagcaatgatgcccaactccccactctccaccatgctcacgcgaacttgtacatggaaattcctagtgtatctttgtatatgccaaaaatatatattgctagtgtattgtaccgtagaagtccttcaatttctttaatcaatcccttccaaaattctacttgttctcaacagaattttcataggattctcctagggtctattggctaacaccacaatctgattagccaacccagctcacatccctcctatcttaagggtttattcgattgaaggggtgtgggattaatctccttaatctcatgtgaaattaattgattgcccaataccctccaattgccatgtgaaaaggattaatcgaacaacatgtaaatagggtatatggggaataagtcttgttcatatgtactaatttgatcaagattttagtgacatttcaagatttgcgactcatatcccaaatgccgtagcacatgactacatgagcaataaatcctgatttttttcccttttaaaacaaccttaatttcatatatgaaacacgtctctttagtagaaacaattaattttaccattctagataaaaatgggtaaatggttttgtagttgttttcttacgttaaaaaattagaaatgtaacagtttttacgattgtgtgcaatattaggtctggcatggagtatagaggcacgaagcatatgttcacgcactccattctagagggagtataagagcagggttcgtgtttccaaagggaacgggtcaaaacccatgaaattatgaggtttccacgtaggataaagtatattgtgattgaaaatttgaatggtcttttataaattcaaatttcaaacaatatatatgagcaaaatttcatcaaaatttgacaaaaccattgcaccgccgaggttgggatccaacaatccatcgaaaaaataaaccatgtactagagtaaatgttacaacatttcttaataatctattacataggattttgatttgtacttctaccataggactatcacattgagtaaaaaaaacaaaaggaaaagacataagtcaaacctaaccaaagcaagcaagaggagttcatccaaaagagaaaaaaaaaagaattaggatacaagataatattggatgcttgaaatgtgttttacactagattcttacacatggtaaaagacaaatgctctagctaaatgtccgtcatagttgtgagagagccacaaccaataaactttttatagattgcgtgtttaatggatttattgtctctattactttagtcctacagaagactatttctctaggtctagatcatgtagcggtggggccaaaaaaaatttagagagtatttgttatgaaaatcttattccctatagtaacagtaacataacgattttataatgtgttcgtcgatgggtcaggtagccgcctagggttatcgagcggtggctccaccactgagatcatgtacgctcgcatagtaactcgcggtatttgaatcgattggacactattgtgtctctctcttccactaactaaaggcgataaattgaatttttaaaacaatggtgataaattgaattgagagtggtggggaaataataaacagtgctcctacttgcagggtgacagtaccggtccacctccaccatccatcccctacactgtcgcgagcgctctctctctctctctctctctgagttcgttagcaaagccaaccaaaaaaaacctaaaagcaaggcgagcctcggcagtgagatcgagatggagaaagcaagcaaagcaaaggcagaggcagcaaaaggcgcccacacccactgccgctgcctgctgctgctgcccccggtaaatttaaagaacccctccaatcagagcgaggcatcatcgatccccctccctctcatcctctccctctccaccctcctctccttctctcatcgatccggccaaaagctactcaaatgttatcgatctcaccaaaagagaagcaaagagaaagagagcatcaaaagcacaaacaccaagccactcaccacacctcgcaatttacatggctcctactaggttgtgtagctgctactagctagctcagctcggctcggctcggctcgccattaaaatccccttgttaccgcgcgttgtttggttgtaccgcgccatatgttgccgcctcctcctcgtcgccgttgcttagatggatacgctgtttaggttggttagcctccaagccgcctccgagcagcagcagcagcagcagcagtcggcgtcctacaactcgaggagcacgacgtcgagcgggtccaggtcgtcgtcgcaccagacgaacgcgtcctacagctactaccaccacagcagcaacagcggcggcggcggcggaggcggcggagggtactactacggcggccagcagccgccgccgtcgcagtactactacctggagccgtaccaagaagaatgcggcaacgccccacaccaccagctttacatggatgaagacttctcctcctcgtcgtcgtcgaggcacttccaccacggcgcgcgggtgcagcagcagcagccgccggcgtcgtccacgcccacggggacggcgccgacgccgccgctgtcgacctcgtccaccgcggcgggcgccgggcacggcctgttcgaggcggcggacctgtcgttcccgccggacctcaacctcgacttctcgtccccggcgtcgtcgtccggcggcgggacagcgtcgtcgggcgcggttgggggcgacggcggcgggaggtgggctagccagctgctgctggagtgcgcgcggtcggtggccgcccgcgacagccagcgcgtgcagcagctcatgtggatgctcaacgagctcgcgtcgccgtacggcgacgtggagcagaagctggcttcctacttcttgcaggggctgttcgctcggctcacggcgtccgggccgcgcacgctgcgcacgctcgccgcggcgtccgaccggaacacgtcgttcgactcgacgcggcgcacggcgctgcggttccaggagctcagcccctggtcctcgtttgggcacgtcgccgccaatggcgccatcctcgagtccttcctggaggtcgccgccgcggcgtcgtcggagacgcagcggttccacatcctcgacctgagcaacacgttctgcacgcagtggccgacgctgctggaggcgctggccacgcggtccgccgacgagacgccgcacctctcgatcaccaccgtggtgtccgccgcgccgtccgcgcccacggcggcggtgcagcgcgtcatgcgggagatcgggcagcgcatggagaagttcgcgcggctcatgggcgtgcccttccgcttccgcgccgtgcaccactccggggacctcgcggagctcgacctcgacgcgctcgacctccgcgagggcggcgccaccaccgcgctcgccgtcaactgcgtcaactcgctgcgcggcgtggttcccggcagggcccgccggcgcgacgcgttcgcggcgtcgctccgccggctggacccgcgggtcgtcaccgtcgtcgaggaggaggcggacctggtggcgtccgatcccgacgcgtcgtcggcgacggaggaaggcggcgacacggaggcggcgttcctcaaggtgttcggcgagggcttgcgcttcttctcggcgtacatggattcgctcgaggagagcttccccaagacgagcaacgagaggctggcattggagaggggagcagggcgcgccatcgtcgacttggtctcgtgcccggcgtcggagtcgatggagcggcggaagacggcggcgtcgtgggcgcggcgcatgcggtcggccgggttctctccggtggcattcagcgaggacgtcgccgacgacgtgcgatcgctgctgcgccggtacagggaagggtggtcgatgcgcgaggccggcacggacgactcggcggccggagccggcgtcttcctcgcgtggaaggagcagcctctggtgtgggcaagcgcgtggcggccatgatcggatcgtcgtgatcgatggatcaaagctcaccggtgagtggaacagcatggaagaaaagagctccatagctaagcaagcacgcatgcatatccaccatgcatggggtaagctagcaagctctctcgtgtgtgtcacgatcgacattaatggcggctcacacaaaggcatgtagggttttgaaacagcgtaggaagctacagaaatggatcacgtacgtacgtacacattgggttgcagcgatcgaggagggagatgatagttttagttcctagatttgcatccatttttattcatcgatcgccaacaagttcttggcgagaagatgattttgatttgcttgcttccatcttcttgtttatttttccccctttcgtttgtgtttcttcttaatttgtaagggttaacgacatttttcttcactctggagaaattttacgtgcatggtttttatcatgcgtacctgcatcgatctgatcatacctatatatattcatctagctagtagctagcatcttgcaaacattcatgctttcttgcatggttgttgagatgttacttcttgtcatcttgatgggagaaagtttagggcagacatttgcacggcctagtacttctagctagtcatcaaacatgaaagcactaattaaagtttgctactttgctagtgatagaccatagatatgtgcttacattatagtatttctttatgtacatgcattgtggttaaattaattaattaatcatccctttttcatcattctatcccatttgtaatatcactgcgctcaaaccacaccactaggcgtatatatatagtttggtcatagaagattatgcatgcatggcatggcatggatgtttatttaagttgtaaaatgactccccccgttcaaattattatggtttggatccttatttataggatatgtgatacatcaagttgatactaaaatactactactagtagtagaattcaagttctagccgaatatatattaaataacccctgatcctacacaggcgttgatcgatatatacatctgacttatttatatatgccaaattaagtagttggagcaaattgacctgcgggcctgctgtaagcattggttaaacttgacaaatggccggccttatgttgatttggttaagctaaagctagggaccatttattttctccatatatactactctctccgtttcataatataagtcattctagcattttccacattcatatagaggttagtgaatctagacatatatatctatatagattcactaacctccatatgaatatgggaaatgctaaaataacttacattatgaaacggatggagtactaatatctgatatggagtagtgaaaagatctgtcaatagttttgtgttcatgtacgtagttggtccaagaaaccagatcaagttttgttgactattgcaggctaagacctttgctatcttttgaaggaatgaccggcctgtcgttgacagattagtttctctcctcattaactactacttaatcagctaattaaatacttagagctttgatgctgtacagtataggacaacaagagttgttaagagaaactaatcagtggcgcactatgaaaacatatttataacaggttgacgaataacacaagagaaggatgaggaatgccagttctctcagaggattaggtgatggggtgatatcatgagctcagaaaccatttctagaaaaatcataagcttgcacactttctccttgtccttttcatgcagaagctgcagccgtcccactatagcagattacaatcttattttgactgcgtgcttgataatcctgctgcactttactttgtcctcagctttgtgtatatatttattattactctgtatcactaatgtctgacttgcctgttagagcacgcacttgctgtaaaaaaacgaaaggaaatggagtagttcataatcatcgtggaaaataaaacaaaaactttagtaattaaattaaattaaatgctaccagcaggagtatgtcgcaaacggcacgcagacaggatcacaggagctcacatatacctgaagaaaatgctagaaactgtagctctgaccgaatccgattcctgatctaattccttccgctggacacatcacacacatcggtgagatttcatgtgcagcatctctcccattttactggctgtggttggtatgatatgcacgctagccgtcacacgtacgctgaacaactgtgtatatgagattgtcctttttcctttaaccgaacggccggcgatcgaggcatgcatgggtgtacatgccgcctgctgcctacatgcacgtcagcatatagtagtacatgcatacaccgaagagaggaaggatcatatcgaaggtgctcttcgttgttccgatccgctcgaccgtttcccgcggcgatcgcgcaagccgctaggctacaaaaccggccgcgcaccgtgatgggaaacgtacgtcgtcatgggggcgcggggggtcgttatcgcgcgcgtcggcaccgcggccggttggggggatcgcgggttacgtacggggcgcggcgcgcgtatgcgtgaaagatccccgtgtcgtcgctgggccggtgtgggggcgtgcggggcgaacgggggggatgcgaacgggggcgggagggaggcgaatctcgtggcggggcgcggggtggaatctaacaggagaaggtggtggtggacttggagtggacgggacgggacggacggccggctggttggcgggttggctggatggctagtggagtgcgtgcgtacgtgcgcctgcctcctgcgcgtcgcgtacgtagtacgtgccgggacccccacgatctttttcgcctttccgtccgttttctcccgcggaattattacgccgatcgacccatatgcaccccgcgcccgcgcgcgcgcgcgtcatcgccgcgctccatctcgcgacacggatcgctgtccgccgcgacggcacgtactacgtacgtaccggccggggacagcatcttggccccctctgctgcccggccgctgcgcccagcttagcttgcatgctacttcttctcgtgtacgtacatgcatatgtgtgatctagtactggccggccgatcgatcgagatcgatccaggcttgtctcgtcctatagtatatggatctgttgatcaccagccacaactaagggcatgttctaaacagctaattgaaaattgctactcctcgttttctgttatcatattttttaaactgttaaacggtgttttatgcccaaactttttatataggatatgctttaaaaatcaaataaaatcatttttcaaaatttaaataattgatactcattaatcatatgctaataattgtgtttcttgtttttacatacagccaaaacctgcagccgaaaagaacacgcctaacaacggaggcaatcgagttagtattatctattatatactaaaagtcctttaaacttcctagaaacactcttaagccgtcacttgtcacttctacaaacgtttctaagtcgtcacatggcactatctaatctcaccgttgatttttacactgatggacctgttattttacaccattagattagatttattatttaaaaaataataacttcctcatgtttatatcataccagcgctactactgttgtgccgtacgtacgtactaagttaataccatacaaacgttaatgttgttcttccggtacgtacatccatacacgattgaacgtacctacgtacgtacacaattgaaaacaaaataataaagcttgctaatgtctgccggaagaaaaaaaacatacgcatgtacataaaaaacgacagaaaaaaacatacatccataaaaatcgacagtctcttaaaatttgataatctacaatgtaaagttaaaatatattacttcacaaatataaatatatttagttaaataaatatttataataaatatccaatcaatgttccttaaaccatcttctaaatctatctattatataccaaaagtacattaaactttgtacaaacgctcttacgccgctgcctacgtgtctctctaataaattagataaattctaaaaatctattatatattaaaagtccaataaatatcgtacatatgttcttacgttgtcacatggcgctctaatttattagagaaatcctagaaatcgagagaacaaaaagaaaagcatccgatcttcaaatttcactgaaactggtggacctattattttaaatattagattagatctattaaaaatctcatgatactaatctctataaaaaaaacataatgtgcgtatgtgcgtacttcgtatgatcgccctcctcccgaaaaaaaaaaaacaaaacttaaatacctacaccatttacgataaaaaaagataaagcaaaaaaataaaaataaaataaaacacgcacacgtacatagtagaattggaaagaaacactaaccatcagtgccaacactgatgtgttgtcaacggtctttaatctacgattttattaaaatctttattactatacgagacacacttactgattctaagaatgtatttattttattttcacaaactaatttacactaactaattcgcctgattgcacttagtgttgggttcaatagtgtataacatttgtccatcaactatattcggcatataaatttctatcaaccataaaaaataggaaaaagcacgaattacctcctcaccctctgaaccatcgtgttcgaccgaattacccctgaatccgaaaaccagacattacccaccctgaattttcaatactggacgtataactctccttgacccaatccgaagcggttttgttctgcgtggcatacgtgtggtaatccagaggtcgagtcgccgagtgagctcgagacggcggcgaataaatttattaaatcgactaagcttaataaattataataaattagtcggggataccgtaagaacgcgtatcagctatgggacaccgaaaaaactggtatttagttgctggacacccgtgacattattttataatatccaaaggaaatggagagagaaacaaaaacaaaagtatgattgtgccccttgcctaccaagtccggctcgcatacacctccgacactgcaactgcacccgttgccggtgaggtgactgtctagaggggggagggggtttcgagatatggtattttgtagatttttatggtggtacgtctctttagctatatttttttaaggacgtgactacacagctagtggtagctggtttagacaaaccacctaccactccacatatgatagacactatccacctatacttcaaatacaattttctcttaaactactaatccaatttacgatatgattacaccgttgtgttcgtaacaattaaatctttataacaagatctcacatgattatattttgatgaaaaaatataaattacttttataatatatctaaattacttttagatttcactaagttacttcttaggcatataaaagtaattcaataaagcctaaaagtaatttacatatactatagaagtaacttataacaaaaagaaagtaacttctataatatatgttaattactttaaaactttattgaatttacttttatatgtttaagaagtaacttagtaaaatctaaaagtaatttagatatattataaaagtaatttgtgatttttttatcaaaatataatcatttgagatcttgttgtaaagatttaattgttacgaacacaacggtataatcggattgtaaatcggatgtgtaatttaagaaaaaaaaattatttgaagcatagatggttggaatattttttctacttgcttgatcaattagtactatagtaaagtaagattattcaagacacatatctggacaatggctgatcgtatctggacaatggctaatagcgtcgctcgttatgactaaatcgagagagctctcgatttagattgtgcgtatatgttactattgtcccttgaccgaccagaccggccagtacaccccctcatctatgttattgctatcattatgtggttataacatgtaaacacaagcagtttatgttttcgacccggtccgaaaagtatggaattcgctttaaatcggatcggttttgatatgttgtgtaaatcttggttcggaccattctgttttgcctctccctaaatttgctgtagtagcacgctagcacctcctcgatgtaatttgtactgaactcaattgcccacttattttctaattagtaaggttgtacgttttcaattaaaactaaaggagggtgtgatggattatggtaaattaattaagtcgctatcaccttgatgtatagaactgcgtggagtaccatcacctcgacacaccagaaagttttcgctttctgagatgtgggtcaaaatgggccaccagcagttccaattttcaacccaattctgagcaaatcatgatactagcggtccttttgcagcctttgtaatagttgggtatgcatgcttttggttttatccaatgagaaaaaaaataaagggctactaagctttttgtgcagtccagtggaggcttctcttctttccggtcatatatattttgtaatacaagaaaacatacacatatactgctgagaactgatcccttcagaagttgctcataaactacgaagcaagttgctgtggaccttgtggtttcacagccttacgactgtttgatcaacatccaaaaaaaaaaaggagaagaaacggagaaaggtatatagtgatcaaccactcaactcatagctagaagacccaaattaaagctggacagactgctaataataagaattgtttgaaccacacaatgtttgtgctattatattagtttacacccaaaaaatcaagaatcatgcatcagctggtacttactccatcaattccaattccaagtccatgtttcctggtctgttctgaacgtgtaaagtggtttttatttttaggctagcaaaattttcagtgtctttcaaccatgacatgtttttactatgtttacaaatagatactcccgacgttttgactttggacaaaatcaaactgctttaaatttaaccaaatttgtagaagtaataataatattttcaactcaacacgaatttattatgaaactatattcaattattgatttaatgaaattaatttggtattataaatattattatatttgtgcataaacttagtcaaattcaaagtagtttgactttgacccaagtcaaaatatcttataacctgaaacggaggaagtaatacaaattttgaatgttctacagcaacatattaagatcaattttactactaaattaacactcaaagtttgtgtagcttgctggtgggccgtgtatatggaggatatcaaaaattagtaatttgttcaaggacattttcagcctaaattgaagagagaaatttttgaaaagatgacaatgtccttagagtcaaaagcttctacgaccctagcaatgcacttggttgattgcagatttagagtggcataattctaaattttcacttcaacgtccatgttacgtacaatcctgtggtcttaggggcattctcgtctattgaagaatttctctctttaattggactgaaagtgtcttgtagcaaattactaaatttttaggtgtcgtttagtcatgtaattaacaatctttgatgtcctgtaacaatatgatttttaacattatgtaagtcaccactaaaagcaattaatcacaaggtgaagtttatctggttttgaaggtttagagtgaaaaataattagtttgtgttcagaatgaaaatggacttggatgaaagtttggggtccaaaattggactacccttatttaaaaaacaagtacacgacctcagcaaattaagtactacgttctatatatctaatgaagagttagcaaccaacttattcagcaagtaacaagggatcagttgtctcttggtatccatggtggcatggatgcttattagttttctcttggcaagaacttccatattatcccatgtgcttcactatatgatacactcaaattaatatgttgactaacaagtgatcagcaaatgacacactttcatgttgcattgtacctagtactatagcatatgcaagcaataagtgagggaatattgttttctttaatttgtgaggtttaacttgcagtggcaggagtagtctttcaccttattgttgctgaaccgaagtgtactggacaagcctaagagctagctatgcattggaccaagggaaaattgtaaccatgccattataaggagggtgagtgaggatcaaatagtgggagctcctttttaggggggtggaggtgaaggtgcgggcatggagagacatggcccttctttttctgcccccggcaataacccctttgcacaggtcctcttttagggcatggggttaatactagtttctccttgcctgtacagtcgcatgtctcttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcttcgtcggttcgcttgcgcgagccgg

SEQ ID NO: 6694 - DNA, 747 bp, Oryza sativa
  unsure (1)..(747): unsure at all n locations
gtgtggaattganannctgaatattccagctcggtacccatcggaattcggaagtggcgacgagcaccatagacaatgaaatagttaatattagggatgaaaatggtcgaaaacagaccacctttatcgtttttgttttcatattttttcagaattggaaaccccggataaaaaacagaatcaaatattgtcgaaaacgaaaacagagcgaaaacagaccggcgctgatatagtaacaaaaatttatcggaataaaaaacccctcaaactaagctttaaactatatcaaatctaattctcaagtctcatattttaacattatatcacaaaacacaatcatgtcaagtccaattcttaagtttgaattgggtgtattgggttgggctgaattgagtgacttggaattagtatgctgaattgggataggctggggaggaattatagactacggtatgggccttcttaattccggaaattccaagaaattttccgaccgattccgagttccgacgaaaactgccattatcatattcgattccgtttccgataaaatatttccgaattcgtttccgtttccgtttccgaaaaattatgaccgacagatactgttttcgaaaataggttcggaatccagaaagtttccatactgtttttatccatagttaatgtgtatgatattataggtaccggatctaatacctttgataccaaatatgatatttcgtaggtactatgcttatgttgtac

SEQ ID NO: 6695 - DNA, 714 bp, Oryza sativa
  unsure (1)..(714): unsure at all n locations
gtggcacatgatgatcgtatnnnnnnnnnnnnnnnnnnnnnnnnnnnnnnnnnnnnatatgcatgctttgtcaaatctcatctaacggcacagttttttttcgtctgaaaatcactctaatatgcatatatatatatatatatatatatatatatatatgaacttctgcaggtggacaaacctttagatgccaaggcaccgagtgatatttatggcgaaatgccgaagaccgacgatgtgacatggcaggtgcctgagttccagcatcaccatctcaagcatctgtagttcagtggcttcaatgaaaaaaaaatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6696 - DNA, 5346 bp, Oryza sativa
  unsure (1)..(5346): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccattgaaaattcggagttgtgctaattcatctttctcttttctgttaggtctgatcagtaacaaaaatcgaagtgaaactgatgcttatgtgttcctgaaactgtgttttttcaggttggccagcagttctggtggaaataatataatggggccccatgattccccagctcgctgtgtcgaatactcctacagtcctacatgcaggtaggtactcgttattgcgttttcgtgtggctagaaagtgttgtttgactttgtaaaattcattttttttagaagtcgctagttggaattcatgatatagtttctagatggggtaggtcttctaaaccctgccaataaaaaatgtctatcttctgaaatttgtcaattcgacctcataatgtgctagctgagttcaggttttactggtaaggaggataatcctatctagtatcttagaaggaacttccttcttggtttaagacaaacttttatcacagtgctacaacagattaaattgtttagttgtggtttttatccattttaggccgaacatttatccttctgtagttactgtttatatttctgtatagtcgatctgatcatggaatatatttcacgttgtgttatgcgatcatttgaaagtaaagtattcgctctgggtccttcggaacgacgagttgctatgattaatttgaatatgttctctgactaagtatgcacttaagctgcaaaaggaaaactttcatgaatagctatttactgaagatgagacattactagcattgccacgtgatcatatttttaatctacatagtctgcatgctcataggtggttgccattgattatctgagaatgcaaggaacatcgtttatgttgtcaaatacaatttcatcccactcaatgcaaagaaattcccttgatctctctccaactgtttcgattactttgttttctttaatggcctcaaatatcccacatttgcagatacggcacatttgcaactggtggatgtgacagttttatggcctttgggatggcgctagcaaaaggtaaattgtcttccgtgatatatttgttgaagaactatgtatgataacttcagcgtacattattattttttcttcttttaattgaagtgccccagccctcaaatacccatgtaacatcacttcttgtctttcagcaaggatggccatctgcttcgctgtcgcatccaggtgcacgttcgataagccgtaagggagacataccttaagaccagaatttggctgggacaagtattccttttcagtagggatggcaattttacccacgggttcgggtatccatacccgatccgatggtatgggtatggggttaattttttgcccgtaggtacgcccggccgtaacccgaaaatctaatgggtagtagccgggttttatatggtaacccatacccgacccgaaattaatgtagaggttgattttggtctatctctcatacctattttcctttgatctattaaaatcttgaactttgatgaaattatgctagcttgtttataatttgtattgctctttttaaccattggtgataattttacgatttactgattttattgctctttatttagttacctttctattgagatatcaatcatatgaaacccactgggtatccaccgggtataccatacccaacgggtatgggcatgggtatgaatttctacccgccaattctatcgggtatcaatcgggcgggcaaaagcgggtcaggtacggacttgctctacccgcacccaacccgacccgacccattgccatccctacttttcagggtactaatctgtattctcatttctcacatcatttgcaccctgcaggcataagcctgacgcaatctttatctgtaatgtcaactaaatggaagtaaaccagaggacgaagacattagcggatccctatcagcctgagatgtcagtgaggtgcgtttcttcccctcaatttgcctgtttattgttcgttggttctgacactttacgaaagttcttagcgttatgctcaaactatggattctattaattgacagaaacacattcagtagtatatctgcattagagaagttacaagatggtaggttgatcaatcatctgaggtagtataaactagctagtgacaatatttctccactgcacgaatgtataaaccgagttcatcaatcagcacgcagtaattcacctcaccctgtcatccatgttgagtccaaatccccattatcatctttaacaagtcagaaagaaatcatctcatttatgaccgatccaactggatcgagcaacgagacctacatccaactattatactaccgatgataatgttatcaaattccagcaacataagtagacattacctcgtggggattattctccacggagacgattagggagacaccgcgcgtatctgcgccccaaatcaaacgcacttaaagcgttttgtgaaggagcatgtgggggaagctagcaataatcaaggcacagctaatgctgcttcccattgaaaaattaatgcgacttggtaaagtattaagcatatgattctgcacatttctgcgtaatacatccacgtcgagagtgagtggcacagctgctgctagctacacagcaagcagagtagtatatatgccttgatcgatctgcctgtgtgtgtggtttagattctcgtacgcgtgtactcactcgcgcgcggagagcgagatcatcactgaatcagctcgctatctcagctatactggggtgcaactaagtgagctaatgattgggcctttgccgccacattgtgcaaacaagtagtgtaaacgatcacgctattgcacacgtcggttcacgtttcgtcccgagtttaatgcccacggtgtttagtactacccctttccaaaatgtatgatgccgtttatttttcgtacaacataagcatagtacctacgaaatatcatatttggtatcaaaggtattagatccggtacctataatatcatacacattaactatggataaaaacagtatggaaactttctggattccgaacctattttcgaaaacagtatctgtcggtcataatttttcggaaacggaaacggaaacgaattcggaaatattttatcggaaacggaatcgaatatgataatggcagttttcgtcggaactcggaatcggtcggaaaatttcttggaatttccggaattaagaaggcccataccgtagtctataattcctccccagcctatcccaattcagcatactaattccaagtcactcaattcagcccaacccaatacacccaattcaaacttaagaattggacttgacatgattgtgttttgtgatataatgttaaaatatgagacttgagaattagatttgatatagtttaaagcttagtttgaggggttttttattccgataaatttttgttactatatcagcgccggtctgttttcgctctgttttcgttttcgacaatatttgattctgttttttatccggggtttccaattctgaaaaaatatgaaaacaaaaacgataaaggtggtctgttttcgtaccattttcatccctaatattaactatttcattgtctatgtattttcggaattgaggtccacacaaacaagagtcgtgtctgatgtgcccagcgcatgaccggcagtccattatcgactcctctaagttaatctaacctttttcttttgaaacagttaatctaagctttcagtacaagtagctaggtgcctcaacccttctattttttgtcatttctatctttatgaggagctgtcaccccaaccactttgatgctctcaaaagaacagataatagagtggcctgttccaacgagcaaaacagcagcggctagcatcagtctcacctcggctagctagcaaggcacattccctaaagacactttatgaggagctggagatgattccaacgctatctatctgaagttttgatctgtgatatttcagcaattttgtgtaatcatatttgctcacgctaaagggtaaattaattgtggttgaatattcagtttagtttaaggattggaatattctaaactagctattgtagagggcagtactaatcgacatcagggacaatcttggtcatctctggtaaacgatgaatgtcctaagtcaagtgctacaggaaaatcactacaacaccaaaagactcgacaataccaaaagagtatagaatttcaaacaaaggtttccaagcttttagatccattgatcggttctagagcctagccaccttagggcatgttcagattaatatcattttaaatcattacattatttgataaagttgataaatatatggttgcatttagtttgttatcaaacattgataatgcatagaaaattttggcaacaatacatttaaactattctataaaatcttgacaatgctaccaatttaccgaaattttggaattagcaacttttgaaaatgttaattttgatagtaatctgaacagatcattagtttaaaaaatgtcctttatacgaaagcactttcttcatgatggctcaatcctcttcatgtgtagacataggtcaattgcatcagtggtagctccatagaagccgttcttccttgcccctctagatgtgaggaattcgcaatcaaggaacactgagtgaataacctctatgcccaacatcgctagcactggataatgttacatacatcctcgttcacctcgtcctaccaccttgttgtctgacaaagtcatctagggatgaacaaaaatgcagtagagttttgttcgaattttgaaattcataaaaaacaatcattcataacattcgatagaactcttaaatgaactcttaaattaatttgtttttgaaattttgtccctacccccttaaaaaattctcatgtcaaattattgaaccgtactatagttcaaaacacattaatgttcacacaacaaccttttgcatttattgcagaagatctatatcttgcaataaatgttaaataaaatatttcaaactaattcaatcgtaataactcacttttctcgaaaagataaaatgaataaatttggcagtccaataatatatatacttccataaaagcagatagatttatatccccatacaaatatttaggaatataaatgcattttattctcccacccaattaa

SEQ ID NO: 6697 - DNA, 721 bp, Oryza sativa
  unsure (1)..(721): unsure at all n locations
ccgcgcccattgagaatccactnnnnnnnnnnnnnnnnnnnnnnnnnnnnnnnnnnnnacccgtgcggttcacatagagataggataaaacgagtcgatttgtgtggaaaaagaagaaaatggcgcgtgctttgacgctttgtagcattgaccctccttcctagggtcttttcctgcaaattccaaattggagcacatgattttggtgcatgagtatctaaaaacatcagtagtattctatattcttaagtcttaaccccgtagaaatcaacgtatcaacactcaagatcttaccactgtacaacctggctccataacgtgtgatttgttgggctcagaagcaatagcagctgttattggatggtttcgcagtacaaacgcccatgcttttatccatccgcgctcgtccgagcacgtctcattaactaactcactcactcaagtgaggtcaaattacagaagctcaagtcaaatgcttatctaatctgccgatactgtcgccggatgatgccattacaccccttcactatcacgcagaggctgtccaaaactatcaaatcgtcgtgacgacgcgagacctctcgctagcctgacagactggtccaacccaaccatatttttctacgactcgagccggaaatccaagaaccgagttcaccgcgcttctccccttgcacggtcgctgacaagtggtgcccacgtggaccggacagtacgcgtt

SEQ ID NO: 6698 - DNA, 724 bp, Oryza sativa
  unsure (1)..(724): unsure at all n locations
ntctcaactacgatgtgcctccacaatgctggcctcagcatgnccatagctctagcgtcacagctttccctgatcaagctcatagctatgnaagctttgagttnccggtcatggatccgttcccgatcgcggatctcgacgcgcattgcgccatcccctcccttactgaagatctgatcagccctccacatggcacccatccatcagcaagagtgaaagaagctacaaaggttgttacaccagtggctaccaagaggaagtctagtgctgccatgacggtatgcccctgcaaataacttaatagaacagtgatctacttcagttaccatgctgttttattttccatgcctaattggattgatgaactgatacaggcatcaaagaagagcaagaaggctggcaaaaaagatcctattggcagcgacgaaggcggcaacacttacattgatacgcaaagttctagcagttgcacctcagaggaaggaaacctggagggcaacgcgaagccgagctcgaagaagatgggtactagggccaaccgtggggcggcaaccgatccccagagtctctatgcaagggtaagtacaaataaaataaaatgtgtaaaaaaaatgacaaagtgattcaaggaattctgatgaggttaaatttgtccgttctacagannnnnnnnnnnnnnnnnnnnnnnnnnnnnnnnnnnnnnnnnnnnntataaancccacgg

SEQ ID NO: 6699 - DNA, 935 bp, Oryza sativa
  unsure (1)..(935): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttaataaaggttcttcaaaccgtccattttaatgttgccagaaaacaacagttcagagttcagatatgtatcaactggttaaatcattgttgttcatggggcggcctgtgatcaccgtatacgtgtggagctctctcccctgcgaaggctctcgtggcaggtaaggtgtctcgcccgtgcggcacacctggggcgaccacgcccaataacgtgcctgctcccccggcgtgcccagtagctagcggcacgccgttgtcgctgtcctggcagttgatcgatcgccggttggtcgagccctgggccgtcggtgcacccagcgtccgccgcgtggcaagtgcctgtgagtactggccagtgtcttgctgctcgagtactgaagcgtgttcagttcccattggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaact

SEQ ID NO: 6700 - DNA, 961 bp, Oryza sativa
  unsure (1)..(961): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatctgcccgttattacataccaaatggtactcagatcacactgatctgaccaacacactagctgtcagtctgtcacccgttacaagtgaattattgagctccaggctagtcagaccaacggattctggctagcacaaagaacaaatcttcagcgattccggcggcagcagcagcgagaacctgacgaaacggtcgccatctcccaaccgcaaccatcgcgcgggccgggcatgcgcactcggcgtctgcgtcggcgacgcagctgagctagctgtggacgacaggcatgtggaaatatggaataaaccaaacgacgtatttacaaatgaaaagtaatttgtaaataaaactttcatatacgtgctaataacaaactaaaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6701 - DNA, 712 bp, Oryza sativa
  unsure (1)..(712): unsure at all n locations
cgcggaccttgatgaacaacnnnnnnnnnnnnnnnnnnnnnnnnnnnnnnnnnnnnnnnnncggcacgccggcgtgggagacgttcgccgtaaggcgtaacccaggcggtgtcctccgatccggaccttcgattcgacgagcatttgccggatttctcccgtgatatttgcggtgtatacatgcatgtggcgtgtgctcggttcgatcgggagctagttggcgacttgcctaaccccgatcgcattcaaataaattgccgtcgctatcaccaaatgatgcgtgcccatccccaataatcccgagctaatcaagccgcggtcacctttccggaatcgaggtccaggcagtagcagttaagcgttgcctttttgaaaaactcgatgaagttacggccatgtacgcaacgataagcatcagttttcgtactccattcgttagttcggcgtacgaccactgataattttggagtcacatcagatcatcattttgcccgtgcaaaagcgagtaaatccaatccaaaatactcaagtatccaagggatggagtactatttatttttcctactcttcacatctcggtacagtaataaaatgagagtgggtcaagttgatagtagtactcctattttcctactatgaagtactatggtttaaaattcttgggtaccgagctcgaaatcgcctataggagtcgtatacaatcacttgccgt

SEQ ID NO: 6702 - DNA, 824 bp, Oryza sativa
  unsure (1)..(824): unsure at all n locations
gcgcccttgtgaacatcnnnnnnnnnnnnnnnnnnnnnnnnnnnnnnnnnnnnnnnnnctttgaagaaatcagtctcattattgattaatttgtacaggagacaggtatcatttcttatttagcatgtccatgtccaatttggtatcatgaacagagcttgtgtcaacaagaaagttgaatgtactatataacaataatatgacttgtctttgttctgtgtttttttttaatctgtttgcaagtttttcttgagtgaactgtctggttaatgttcccttcaaatcccttatatccctgtgttttggcattgtacaggtgagccagtcatccaagctctgtcaagatgtctgacagccatgaaactgataggaacattgagatctggaagattaagaagctaatcaaggctctggagtcagctagaggaaatggcacaagcatgatctctcttattatgcctccacgtgaccagattgcgcgagtggctaagatgttgggtgatgaatatggtaccgcctcaaacatcaagagtagagtcaatcgtcagtctgttttggctgccattacctcagctcagcagaggctgaagctctataacaaagttcctccaaatggattggttctctacactggaaccattggtactgaagatgggaaggaaaagaaggttaccattgattttgaacccttcaagcctatcaatgtatcactgtatctttgtgataacaagttcaaactgaactttgaatgaactcttggaatttgatgacaaggcttggtttatatgtatcgatgttatggggattcttttggcacacttagt

SEQ ID NO: 6703 - DNA, 1228 bp, Oryza sativa
  unsure (1)..(1228): unsure at all n locations
cgtgtcccttgtaatacaacnnnnnnnnnnnnnnnnnnnnnnnnnnnnnnnnnnnnnnnnntgatgtgaggtggctagttgaactgaacaccgcgattgcattgaaagaggtgtctcagaaatgtatgggagtggaatgctatgggaaacttctccatcggtcccgttgagccaaaggattggatttatccaacgtctttaccaatccagtggaaatgcgtcatcgcctatgtgcttgagcgaggaacttaccgacgacgacaactgctggcgaaaaatccgtcaccacctatctggtgtcatgacgactactcagcgtttatgatacacgcgtcagatcataagcgactcattgctatgtcttttgctgcgtcgctgcaggtcgctctgactccacgcttgactattgctgcgataaccataactctaggctaatgatcacggtgacgcagccatgaagcaaacggtggacccctgtgtgtctctgggttagtatgtgtacaacaaattttgaattattttttagaaattagcctacctagtacctctcttttgataggattaagcttgtattattcctgtcaatgtatatttctctctcaaaaaaataaacaaggtataggattagtgttacaaatgccaacactgtgacatgaaaaatactcatctcaaatggaagtcaatcatatcacttgatctttgatcattaacatgatcatgattacttcttcttatggctttatggtaaatgccaagtagtaggaagaaaaatgaataaagttacattacatgtatgatatttgggactatatgggccagaatcaattaatctctatgcaattcaatgttagctctgtatatccgaggcgatattatttttgcagagaagagatgttcagatcaatattgctgatgttgactccattgtaagcgattggtgcatacatccacgtgtcatcagagcttagcaactgcacatgatagtttgcagcaaagttaggaaggtatttcacttactgtttatagaaaaataatttggttattaacaatccttggctagatgacaatgatatgtaatgtacccaccttaatctgaagttgcaaaaatttgacatactgcactgcttcctccagcattgtactgatgtcaacctgtnnnnnnnnnnnnnnnnnnnnnnnnnnnnnnnnnnnnnnnnngttctacaactgggatnctcaaaagggccat

SEQ ID NO: 6704 - DNA, 727 bp, Oryza sativa
  unsure (1)..(727): unsure at all n locations
acgccccattaaatacaacnnnnnnnnnnnnnnnnnnnnnnnnnnnnnnnnnnnnnnnnncgaggtaactaaacatatgcatgctttgtcaaatctcatctaacggcacagttttttttcgtctgaaaatcactctaatatgcatatatatatatatatatatatatatatatatatgaacttctgcaggtggacaaacctttagatgccaaggcaccgagtgatatttatggcgaaatgccgaagaccgacgatgtgacatggcaggtgcctgagttccagcatcaccatctcaagcatctgtagttcagtggcttcaatgaagaagaaatgcactggaggatagtggagcttgtcaaggagagagctgtgaacctgcagagcattgctctggatgacggatgccaagcctgcgatgttgtggcgaatgaatatgttctctccggtgggatcaaaaacaagaaaccggtgttgttatcagtgtcccagatcacaggatctcctcctattctcacccttgtatagagggtgtatccggtgccttgtgctcgcaggcgagtatagggttgacgccgactcttttaaatatgttcctaaatatttgacatcgttgactttttaaagcatgtttgatcgttcgtcttattaaaaaaattaaggaataataaattcttttcctattattagattcaatgcaaatatacttttatggaaataaaaaaataaa

SEQ ID NO: 6705 - DNA, 1039 bp, Oryza sativa
  unsure (1)..(1039): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatccaaaagctcaatagaaggaattgttggccttatgaagaaaaatccggaattataaacccatatgcgcattgtgtgtgcgtatcttgcccagcccattaagggctcatcaaatacatcattgaaaccataagctgtcctattgtcatgaccatcactcattgactctacatcagcatctctgtaaagatgatcaaacggattctggaagaaaataatatcgatatctgataggagcacactatatccaagctgcaagaattccctcaatatgcgaaactttagtccagacacagcatggtttccacctacctttccaatattgtcaactccttcgtcaggatcccgcctataaaatggaacacctttagacttgcaaaaggtttcagtgctgtcatccaatgcaacaattaaataatttgaaatcccaactcgtttgatgttagtaaaccacatctcaagcatctctctcacattggagtttgccaacgcaacaattagttctttctttatagcaacctgttgcaatatcttggccaatctgggatttatggattcatcagggataactgttggattttttctaatagccttgacagtaccaaaaggaccagccttatatagaacctcgtcttttccttgcccagctaattgaagcttcattgttagttcattaatctgcttcctaaattcagcatttttcctctccaacaatactacatgtgactttagggggtaccgaagctagaatgtcaaacaatggcaca

SEQ ID NO: 6706 - DNA, 835 bp, Oryza sativa
  unsure (1)..(835): unsure at all n locations
ggggtgtataagagtatagttgtagagccgccgacgattgacgggacttctagaaaataaaaaataaattccaacgatagttatgtttgatttttagaatcncnatgacaataaagagtaggcgatggacgggctgtagaggggcatagtggcatcgtttgatggaacttctaaaaattataaaaaaaactacaagtccaatttttaaaggtttggaacttccaaaaaagtaaaaaaaaacccaatgataatcatgttcaattttaaaatctcaatgacaataaagaggggaggcagcgggcaagccgtagaggagtacaatggcaaagccgctgatgatttggcgggacttctagaaagtaaaaatgaacccaaacgataattatgttcgatttttaaaatctcaataacaacaaagagaagaaacagtggacgggccgtagaggaatataatggcaacatttgatgggacatatagaaattataaaaacgaaacccaacatgacaataaactctaaaaactataaaatccaatttttaaaggttccaagaagaatgaatagaaatagtggtagatcgagcaagcaaataaagaatgagatgacataaggggtagcaaatggtgtgacttttaaaaactatataattagaaacgcgaggatgataaggtttggtcttttaaagtcttaagacaatgagatagctatttaataaattttaaagtaaatcatacttaaaaatatatgatttttgtttggtaggggcccggcaacagctagtttctctaaaatgacgctaccgagctgataattgattgtcactttcgacaccaaat

SEQ ID NO: 6707 - DNA, 799 bp, Oryza sativa
  unsure (1)..(799): unsure at all n locations
tgcagcnccgntttgaannccnttgaaattgnnnnnnnnnnnnnnnnnnnnnnnnnnnnnnnnnnnnnnnnnnnnnnncacgagacagtgcgaagttctattgatagagcagaaaaaaattacaagattacggtcctggagggtcgtagccaggaaaaggaaaaaaaataccaccacccacgcaccgacatcaccaacacacaagcccaggagaaggctagcaccggaccggccgccgctaagcgtgaccgaccgccactagaccgacaaagggacacagacgagattgcccccaaggggatgccagaacgacgtcttcaagaagagaagcgacggaagaccgccgccgccgtccgttgggactcaaaggagccaagactgagctttcaccaggcaaacgccctcaggaggtgagacagcacgacaatgccctcaggagggtgatcatcgttgtcggtccggccgaggccggactaggttttcacccgccgctcaccacctacgaatccacggctgacgcaccaaagctccaccaccacactagcgtcatagcctaaacttctggttagcatacaagatattctacaaagcagaaccaaaattttcatttcttgatcctatcgtcatttgtataagcaagttccaatgatcaaatcctggttctgttggaaccacagcagttcagttcacaaacgtcagaggctgcttacaagctttctggaacaacaataatgtaaactatgcaaaatcagcagaaaacccttttctttcctgaaaatggttgtaaaacgaaattcat

SEQ ID NO: 6708 - DNA, 891 bp, Oryza sativa
  unsure (1)..(891): unsure at all n locations
nnnnnnnnnnnnnnnnnnnnnnnnnnnnnnnnnnnnaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatttaaaagagtcggcgtcaaccctatactcgcctgcgagcacaaggcaccggatacaccctctatacaagggtgagaattgctagtactttttaggatgaaattaacaaattccaagagatagacctgcctcatctagaaacttaatcatgaattcaactagcgacttctctaaaaactgccaggtcggcggaagggactcctctaaaaagtaaaaactcaagttgggtgaatcaacgacacttttcagctagatgaaaatgcgataacaggtaccagtagagtaggagtactcgacacaactaactgcggcatcatggcgtaccaagaaataattcccaccagaactgaaggccaacctgcaaaaaaaaaaaaagttccaggaacacacaagccatcagttttgcttcaacttacatgagtgatctgaactaacagaaaagcaaaatatgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 6709 - DNA, 717 bp, Oryza sativa
  unsure (1)..(717): unsure at all n locations
caaggggttgnnanctggttgaccanttngcttggnaccctgttccggacgatccacctgctccgtcgtccggccccagaagctcccgaaccagaagagcccctcttgctcgatcagcgccttccacacgccgccgtcgtcgtcgtcgacggcgaagcacctctctttccaccacccctcctcgtcgtcgccgccgcctccgttgatcccgccgccgaatgcgccttggaatagatcgtcgtcgtcaaatagctcctccagctgtttcttcacgcctgcagccgggtcgaccgtgctgcagcctctcttggccgccgccgccgccgccgatgatgatgatcttctcccgtgccatctccggaggatgatcctcttggacttgacaaccaccttcttgggcagcctgacgaagaggaacacggtgatctgcagcaccaggcacgggcagcagcagcacaccaccaggcagtccatggccaccagcccgggtggcctggggcccgccgcgcacgacgacnacgacatnggcggcggcagtcggagacagatcgatcaccgtcttttggacagtggataggaggaggagggagaagaagagatcgatcgagcttagctattagctatagctagcccatgcctaactgcatcgtggctagcgtgcctggaggagtgagaccgagggtgctaagttagggtgcttgagaagctcgagtggct

SEQ ID NO: 6710 - DNA, 810 bp, Oryza sativa
  unsure (1)..(810): unsure at all n locations
ctgtgcntttatanattctatgctcgcnnnnnnnnnnnnnnnnnnnnnnnnnnnnnnctgatcattgacacgcaatgcacagtcgctgcgaattcgtgatgggcacatatatacgtaccactgcccctaggtccccctgccggcacatgccccgtgcaggccgggacgaggcgccgtacgcgccaacaataatgcttgctcgatcgccaatcgatcgcaaacggcaaaccgtccgggcgattctaccgtggcgcacggcgccggccggcaacgaaccgagcaacgacacccccccccccccctcccctgctcccccggcgctggtcgatcggacgagaattcggccgtggcgctgtgcgctgtgcgcgcgcgacaactgggaggtacgcgtgcgtcgcagcgtgggatcgaaagtgcgtaatgtcgcttgattaatattgtgggctgtcctaccaagtcctgatttgatttgacggggattagctagctcagctgctgcgttagttgctggtgagaaagatagaggattgctgtggtgtgtaacccggatttcctgcgagaatacggtggaacgacagggattgttcgtgcacagcacagggtgcagttgtgtcgggacgatgcaccaacgccacggattggtgcttttccgtgggtttttctcgcgtgatctgcacgccgttttcgcccaaaacttcaaggccggtgcgcgccggccaacaacgcgatttaaactgtggaccctgctttgactgagcgagcccactattctttaggggttttggccaaaaaagaccaagacggctcctt

SEQ ID NO: 6711 - DNA, 696 bp, Oryza sativa
  unsure (1)..(696): unsure at all n locations
tgggcttttaaatctcattcttgctgccngcaggtcgactctagaggatccccatatatatctgcgtggaacacatcctataaaaatatttcagttctgtggactaaaattgagattgcccccaaggggatgccagaacgacgtcttcaagaagagaagcgacggaagaccgccgccgccgtccgttgggactcaaaggagccaagactgagctttcaccaggcaaacgccctcaggaggtgagacagcacgacaatgccctcaggagggtgatcatcgttgtcggtccggccgaggccggactaggttttcacccgccgctcaccacctacgaatccacggctgacgcaccaaagctccaccaccacactagcgtcatagcctaaacttctggttagcatacaagatattctacaaagcagaaccaaaattttcatttcttgatcctatcgtcatttgtataagcaagttccaatgatcaaatcctggttctgttgaaaccacagcagttcagttcacaaacgtcagaggctgcttacaagcttcctggaacaacaataatgtaaactatgcaaaatcagcagaaaacctttttcttccttgaaaatggttggtaaaacgaaattcactgnnnnnnnnnnnnnnnnnnnnnnnnnnnnnnnnnnnnnnnnnnnnnnnnnnnnnnnnnnnnnnnnn

SEQ ID NO: 6712 - DNA, 15448 bp, Oryza sativa
  unsure (1)..(15448): unsure at all n locations
ctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccttcaatataacatgtgctaggtagtacgcagtttggctattaaatttgacgcagttctacaggtaatattgctggaattcgaatatgaattatggtggattgggaccatggcatttcgtcgacgtacacatacataagcattgcattcatgctaaccaaacaaaaggaaggtgtgaataaatgtgggttagatggacagatctcttcaaaatttactatcagtgtcctttaggaagctctgaacgttagtgtcatgtctgcatcagttcttaactgtgctcaacttggccgacatggttttctaggatactcctaagcaacctttagttgcaagttattgcagaattaactgctgctcattaggagttctagtactattgtgcaggtagcagactgaaatgtttcttgtgctgtactgtgcattccagtttagtgaagagttaatggggtttgtacagtgtacagcaaccgtgtgtttaaaggctgaaaagttagaacttctgaggctggtgccacctgcgagatgcataaacacaagaaagttataacttctgaaaagttggaatttaatggcgtcttttttgttcttttcctctcacggatagcgtagcagagctgcaggatgcagttctactagggtcatttgttactggtagagtgccggaattgccaaccctgctgtcatttgtagtatttgcaaataatcaagatccaatccgctcaaatactttggccttgctatctttgtgggctcatggaaccatggaaccattcgccagatcgacatttccagctccatcctgtttggcaatggtttttctctcataataagttccaagatttcgtagtacgacacgtacacctgttggattgttcttctgtctctgccaaatcgttgatgtcacaagctaagagacgatgaagtatagataaataacattatgtttcatgatgcgtgaaatttaaaaatagatcatttaacttactattcaggttgttcaaattgatgctattttcaactatactattttttttagaaaagttaaaaaaatgttgccaaatttgataaatacataagaaatcttgctaaaattttgacaatattgttaacttgctctagtttattttggttataataacatgccctaactgactgacacgtgaacccgtaactcgtggatcccatgtcagctacccacgttttttcacaagagcatttttccatttttttagcaaggttttaatttggtttattggtaggatccgatcacgtcgcagagcagctacctgaagcggcggctgtcggagtgcagcgacgtcgccgtggacctgccggcggggctcaccgtcgacgcgttcgtggacgcggtggcgtcgtgctacggcgccgaggcggcgctgtcgccggggagcctcgcggcggcgtgggcggcggcggactggctggagctgcgcggcgaggacgggctggcccggcgcgccgaggactacttcttccaggaggtggccacggaccacggccgcgccgccgcggtgctgcgcgcgtgcacggcgttcctcggcggcgaggcggccggcgccggcgccgcgctgctcgtccggtgcctcgagacgctcgcgtcgtccggcggcgccgacggcaggtggctcgacgacgtggccgcgctccccgtggaggagttcgaggtcgccgtcgaggccatgcgcgcgcgcttcgcccacgaccacgacctcatgtacaccatcgttgatcactacctgcaggtaagtaaaaaaaaaagtttacaacatcaaattcccaaaatttgttaaaatttatgccaagttgatatagtagcatggtcgagtcaaattaaatactcgggggaacgaaaattcgctagaccttgaactgttcatcacgtgatccaatgattcatcaagctgtaagcattttgctactgaagtagtgtgtcggttggtttcggaagcagtgcactgtggcgaatttgttgctgaatgcaaagcaatcctcgtagagctcaactgtaggatcaagattccttgctcccaatgcaagtcatacttggatactggataggtgcagcactatttggagtagtaactaattgcaagtcaacctggataggctaattagctgcagaacctttgtgctgaagcaaactatacacggagtcatggagatgcatcagattctatgctctgaaaactaatcatctagtcactaatcattaatcatctgattattagtatacttttgctttggtgctaagttgagttcaaaggaagttgtcattggaggtacaggttagcacaatccttatcctactgggctacaggtcaaaggaagttgagcttttgaggattgtgttgcaccctgcattctacaagtcacaactcaagttataatattttctagccatgagtctcagatgaattttgtaggatcttgaaacaaacaatttaaatctggtaagagttcacaaatttaatggtcatgtaccttaaagacagaatccgaagatataaacaatttccattatcttaaaataagttctataagaagttcagaggaattcatcagcattttgacagaccataattcaatgcatctcttgtgtaaaaatgtatttagaatgtgtttagttcacacttaatttagaagtttggttgaaattggaacgatgtgacggaaaagttagaagtttgtgtgtgtaagaaagttttgatgtgatggaaaagttggaagtttgaagaaatagtttggaactaaacacggcattaatgatttttgtgttggatctgcactgaatttgggatggatgcagaatcacagggggaagctgacggaggaggagaagagcagggtgtgctacaacgtgaactgcaccaagctgtcgcaccacctgttcatgcacctcgtccagaacccgcgcctcccgctccgcttcgtcgtgcaggccatgctcgtcgagcagctccactcccaccactccatgctgctcagcggcggtcaccatcaccacgccggcgccgccggcgcaccgagctccgccgcgccgcctgcttcgctcctcaagagctccctctccggcgcattcggtgcttgtggcggtttagccgccaccgccgccgccgcgggcgacgccgccagcagcatgacgctcggcgacatcctccagcgcgacgccgtgctgcgccagtcggcgcacatcagggcgtccatgcaggccaccacccagcggatcgacagcctcgagcgcgagctcgccgggctccgcacgcgcctgcgccgctccgagcaggcggcggccgccgcggccacggcctcggccgccatagaccgcgcgtccgccaagtccgccagcttccggatcccgcgaagccggctctgggacggcgaggacctcgccgcgccggccgccgccgtcatcaccaaggacaccccgaacaccaggggcctcaagtctcggctggtgctcgggttcaagaacctgttcggccggagaccagtcaccgccgccgccgccgcgccgcccacgtccggcgaacgcgccgctgcgcgcgtgagcgtgaacgacaaagccatgtccaccgatgcgccggagctcgacgccgacgccgacgccgacgagctgacgcggcctcaccggaggaatctgtccatcgtgtgatccgagcaattgcgtgcgtgtgcatggcgactgcaatgcacgcatgcatgatccgtgtggtatatacatctatcaggagaagtgatctgatcatgttgccactatctttgcacggccatatgatatattttcgatgctaatttgttcgttttcttgctttttttaatggcaaaaatttgttttggtccgtttgtacaactcaagagccagccttgatcaacgaatgcttattagagaggttactgcatgcagagttgcaggctcaacagttttttgtttggtttaatgctaacatgaatgaaccggacacttctgagttctgaatcagattcagacacaccctgttcctcaaaaaaaagaaaaactttgttgtacttattctgaaagtgctgatcatgagtaatctttacaatatcattagaatagtgaaattcgagccccgttgggagaggtcgatttttcgctaatttcaaataaatttaacaaatttcaaacaaaccattcgaaatgcacctcaagcagttgagatcttgttttgacgtttgaaacgcccagggtcttccaactagctccacaaggtggtgagctagacgacctgggttcgaagcatcaccccttttaattatttgatattaggttctttcctaatattcacgtttttagatattgttttgacctgcttgagacgctcgaaatttgttaagttcaactgttcaagcgagattccgcgaaattgtgaacgcctcacagccatccatctcaaaattattctatggtgtacttcgctacagcagatcgccacacgattccttggaaattcttccatatcgtccttgaagaacatgatcattcatccaggaattctccctttgcacgtggtgtacttcgctttgccgatactgtggccatccattcagttgacaaatgggatagttcgttgacaaatgtcaaatgtaatgcattcacttggtttaaggcttcgttggatcaagctcattggccttaaaagatggatttgtttgatagtttaaagaaacttcaatataaagagttttgacatgaaatacactgttaagcagtacaaagtcacaataaacgaggaagcggcctagcctattaacacattacgacacatcctaaatcaacaataaaatttgctactctttatatcctaaaatataaggagtattaagtcttttacttggttttcaacataaaactttgccccttagtttatttcataatatattatcaacaaccacaaaattagcacaacaaaattggcataatatgacgaatataacgatgccacatacataatactccttagtactaagcacgtagtatattgtcagtttaattattagtcaaaattgcaaactatggattttcctaaaattataggcctcttatattttgggatggatggagtactagacatgagaaaatcattgcctatactccctattatttaatttcatgccttctatagaacacaaaatttttcattccatgtggattttgtagcattttcatataaactaaatgtgatttctacatgaacctggaaaaaaaaagaatgttctgatgctggccacaatattagttcatgtccttgagaattgtaaaattaattaagttctaaaaatccaaaattggtatgctttcaaacaagcaccactaaaatttcactgtcaaaatccaatcatcgacacaagcacaaactaaaactctccctctggtcataagtattatatgtttagaacaaaatttggttaaagttctgaaatcatgacgatcgattacatattagaataagtgggatatcgtgctagtaattttcacagtaaatctatgtatattatttttttttgaataagtatttgaaaaattgcaaagttttaaaagattaaccataaatttcaacaaattatgaccggatggagtatctttcaagtcacacttgtgtccctactacaccaaccatatgctactagtaaatgtttgcaatcactctttactcctatatatgtcccacttgaaacacagagaaattcacataaattatgcaagtagtatttcacagtgagccagcaggaatactcctggagtcctcccattctttttataaacaaagtgaggatactatttaaaacagggaccttgcgggttgtgccaaaagtcaactcctggaaacgggttccttacagaaatataatactacctccgtaccatattataaatcaccgtgattttttgctattcaaaatttgttaagtttaattaaatttttagtataatttagcaacatgtaaaacacgaaattagcttcattaaatctaacattagatatattttgataatatatttattttatgttaaaaatgctaaacttaaaaaatataattacgaaaaaaatttcaaaacaactactccttccgtcctaaaataaatctaagaccagataagacatttcttagtcctcgatagtattagaaaatgtcttatctgattataggttattgtattttgttatatttcgagacggtgggagagggagtaataacaaggatggaacagagggagggagcagtacactcccaattgcaaaaatctggtcaaatctgagccgtacgcccagttgatatgataagtggtgcactacatatccaccgtccccttcctccactaacgaatcttactcgatacagttcgtcccacttctccacacaaacaaagcaaaccgagcgtcacgtctcgggcgggcaagccaccactagtcagtagccgggccccacccttctcccagatctcccgttccctccgatctcctcggcggcggcggcggcgagcggcggatggccagccggcgggagggccccctgatgcgcggcggcgcgggcggcggggcagggcagccgctctcgcgcgggtcgcgcatcgcggcggcggtcgccgtcggcgtcgcgctcggctgcgtgtgcgccttcctctaccccgacggcctcctctcccgctcctccgacgccgccctccattggcctcgccaggtaaaccgccgcctccgcgcctatctcccccgtccccttgccttttcgccgcccgccgcgtcgtctcgtgggaagggaggggagagtcgtgggcggggatcgttggggtttgaactggggcggttagcgattgttggttttggggcatctgttttagcttggggttttctaatgttaggggaattcatttttttagtcgaacacgattcatttttggactactgtaacagtagcaatcggtgattggatcacggaatcctgattgttatatggattagtaagacggtgtgcgtgagatcactcggaaaaaagtaagatcattttacccaaaagaaaaaaaaagctcaactctctaaggtatgcttaaatgatacgataaggaaggtttgtgttatacgaaggcaattgtattgggacaagccgacaaatcagtcaatcaattgctaggatcgtatgaccttaaaatagagattttccttgattgctgcaacgctatgtgattattacccatgattccatgaatgtattagggggttggttgttacctctgttgaagtggtcccttatatgcttgttcatggtgttgatggcacacactgcaatattttgtcacaaataatgagcaattcgtttggaaatattgatctttggccaatcactagttcactttggttggcagcgcttgcagccagtagcttgtcacggtatttcttgtagcaacacatctatttgtttttagttttttacccatctatgaacaacagtatttcaagtggttgtcatctatagctaatagatgtgattctcaaggcactagcaatgagccattgtcaagaaattgggctgaaagagaagatacagtaagttagccagggggatgctcaaattactaatgagtacggagatgaatttttatcttcaatgttgagttggtactaagttttgtcccccgctttcacacgtgcatactcttcacgatacactcatgtagttccaattgccaccttcattgattgagacactaccaattttaagattgcaatttcctgtattaattctgcagttattatgataccaaggttctacttcgttaagttctttgcctggattgtaccaaaccaggccaaaattttcttgtgtcctggacatcgaatttatgtttcaatgaaaaatcagtcagttgtctttttttttgttgaaattttttttttgaatcttaatttcctgtgtgtagttagtactgttatttataatttttgtaatgccaccaggggtctaatagaaaaagtatatggctcacagtctgtttaactactgcttgtaatatgtataaattgttgttcaaatagtaacactttgaggggtggaagtaaatttatcaatatgtaagccacaccatgtaataccatgaaaaaaaagattatgaaactttttccacagagttatttttacaagtgttatgtttccataaacttgtaagctacatttggaacataactttagttaaattcaactcaatacaactccatactacatgaatcctcgataatcctgtcttccaaacaatcttgtgaagtgcaatcctttctttgtttgcttttggcttgtatgcagtgttacaggatatgttagtcattgtgttcaataccctgcacacgtataccataaattaaatgtgtataatatgtcttcatacatcaaaactgaatgcaccttgttgatcgtttaaactttttgttataaccttagatgcactgatatttgttttattatcagatatggttttacaattatgtttctatctttataggctgactcagttgcctgtgagacttctgagggagttaccagcctaaagtcacatgtagtattgttggagaggaaaaatgctgaatttaggaagcagattaatgaactaacaatgaagcttcaattagctgggcaaggaaaagacgaggttctatataaggctggtccttttggtactgtcaaggctattagaaaaaatccaacagttatccctgatgaatccataaatcccagattggccaagatattgcaacaggttgatataaagaaagaactaattgttgcgttggcaaactccaatgtgagagagatgcttaagatgtggttacacaacctcaaacgagtggggattcaaaattatttaattggtgcattggatgacagcactgaaaccttttgcaagtctaaaggtgttccattttataggcgggatcctgacgaaggagttgacaatattggaaaggtaggtggaaaccatgctgtgtctggactaaagtttcgcatattgagggaattcttgcagcttggatatagtgtgctcctatcagatatcgatattattttcttccagaatccgtttgatcatctttacagagatgctgatgtagagtcaatgagtgatggtcatgacaataggacagcttatggtttcaatgatgtatttgatgagcccttaatgggctgggcaagatacgcacacacaatgcgcatatgggtttataattccggatttttcttcataaggccaacaattccttctattgagcttttggatagagtagctggccgcctttctcgtgaacccaaatcatgggatcaagctgttttcaatgaggaactgttcttcccctcacatccaggttatgaaggtctccatatatccaaaagaaccatggatatataccaatttatgaacagcaaagttctattcaagactgtgaggaaagatgctaatctgcggaagttgaagccagtgattgtgcacttgaattaccatcctgataagtcggaacgcatgaaagcagtgattgagttttacgtcaatggaaaacagaatgcacttgaacattttcctgatggatcagaataataactgattaactgtagttgtcgtaacacggcaaatggactttttttttgtgtatctgttgctattggaacactgaatgaagacacagattagtgatttctataaaagagctcatcacattttggatccattgtgtttggctgcagactttcactaagcatctaactcaaacagttcacataacacaaataccagcttccttaccttctctactttgcactcaaacataaataggaaacaatgatcacaataagtctttactatagaaactctttaattataaaaacttttactaccttttctgtttcttttcttccatcacatctactttccagtataaattttcttatcctttctggttggttaagaccaatcgttttattttcctgtttcgccctaattttggtttgtgtcttttgttatattaagtaggatagaaattatttaatgttaaaaaaagtagggtataaataatttacaacatcaccaagtgtgaagagacctgaaaacgaaaaagaaacagaaagcaaacagaatagtcccgcctatgtcgatctattgggaaattctaatgatatccttggcgctgcatatgatcctggattcctggtcattagttgtggcatttcagtctgtttgttatgaaccactcttttgttctgttcacaccatatctctcatgccactcttttatcatctttgtcttgtgtttttcaccttggggtgtcccttttatctaccaattcagctaggtttcatcgctgttgtacatgcttggagcatcacatctcagtgttttacatgattttctcctatatttggcatacgaaaatgcagtccttgatttgatgctgagctgtttcaaggtttttttagtagagctggtaaaaataattgtttggccactgtcggatttgcagcgtctaccgtccaaatcttattttgtagtaggagccatataatttttttgtattctgaaggtgcccatgccttgcatattagctttacggccgctgagtccatcctcccattgatttgtatttgcagttagtaactctatattactccatccgtccctaaatatttgacactgttgattttttttaaacatgtttgaccgttcattttatttaaaaacttttgtgaaatatgtaaaactatatatatatatatatatatacataaaagtatatttgacaatgaatcaaataataggaaaagaattaattattacttaatttttttaataagacgaacgatcaaacatgctttaaaaagtcaacgatgtcaaatatttaggaacatatttaaaagagtcggcgtcaaccctatactcgcctgcgagcacaaggcaccggatacaccctctatacaagggtgagaataggaggagatcctgtgatctgggacactgataacaacaccggtttcttgtttttgatcccaccggagagaacatattcattcgccacaacatcgcaggcttggcatccgtcatccagagcaatgctctgcaggttcacagctctctccttgacaagctccactatcctccagtgcatttcttcttcattgaagccactgaactacagatgcttgagatggtgatgctggaactcaggcacctgccatgtcacatcgtcggtcttcggcatttcgccataaatatcactcggtgccttggcatctaaaggtttgtccacctgcagaagttcatatatatatatatatatatatatatatatatatgcatattagagtgattttcagacgaaaaaaaactgtgccgttagatgagatttgacaaagcatgcatatgtttagttacctcgagtataaattcctccaaaaccggcgctgcttggaggaagaacaatgtccacgagaggtcgcacccacggaaaattcctgtcagaacgagggacttcagcttgctgaacatcggttcaagttgtttgggagcctctggttcgatccaaatctgcatacaactcgtcgtgggcatgggcaatgagaaaaatatattgtttggaacaagctaattgaataattgtaaggcttttggaacaatttaatcctgtagatatctttgcatgataaacttaaattctagagataaaataagatattaacaatatgtagaagggatgttttataaaattaaagtacataaagagtaaagaggcagttggtaaaaaaaataaaaatgagtaaatttcacaaaactacaagtattttgcacaatttatcacaaaactacagatttaaaaggttgtttcacaaaactacatattcagtgtctccgtttatcacaaaactacaggtagtttgtacaatctatgacaaaactatagatttaagaacttgttttacaaaattatagatttagtgtattcgtttattacaaaactacacattttgtgtcttcatttatcacaaaactacagattcagtgtctccattatcccaaaactacaagttttaagaatactaaaatatgtagttttgtgataatgaagacactaaacttatagttttgtaataaatgaatatattaaatctgtagttttatgaaacaaattcttaaatctgtagttttgtgatatattgtgcaaagcatttgtagttttgtgataaacgaagccactgaatctgtagttttataaaacaagttcttaaatctgtatttttgtgatatattatacaaagtatctatagttttatgacaaacgaagccactaaatctgtagttttgtgaaacaagtttttaaatctgtagttgcaaagtatctgcagttttacgaaacttacactataaaaaaagttgattgccttcttttaatgaaggagtagggtgactgatgttgcattagatacttaccctccaagatgagaaccccaatgtcagagactcgaggtgcggtgtgctggccaacattttgcttagtcttactggttcctggtagtaaacggctttgttcttcaagtgcagctccctgaggcacgggacgtggccgaacgagacgggggcgtagcggcagaaccagttggcgacgacgacgcgctccagcctcggcgccgacgacacccgcagtttcttgtacatggcctcgtccacggcgtgcacggcgaggcgcctcagccgcgcgtgccccacgtccaacaccgcgccgaaccccgcgtcggactggtacattccgagctcctccaggccggtgcagcggccgaggagggacgcgagcgccggcgacgtgaaccgcaggttgacgagggaaagctcggcgacggagggcagcaggctcggcgacgcggccgcggccaggaggcgcgccagccgccgcgcctgccgcttgctcggctgatcctgatcgggcgcgccgcctccgccggtggccctgaacacgagctccagcccgccggccgcgaccttgccgctgtcgacggcgtcgttgaggcgctcgacgacgcggcggacggtgtaggactcgtccctgagcaggtacgcnnnnnnnnnnnnnnnnnnnnnnnnncggtctccgggaagaaggctctccaccgcgccggcgacgcgctccatggcccgcttcgtcctcgcgtgccagccggcgcggagagcggcgggctcgaactcccgggcgtcgatgaccagccgcgggagaaggccgggcagccgccgccaccgcctcgacagcacggccatcctcccagcctcgcggacgccgaggttgcccatgatttccagcaggatgtcgtccggcaacgcgctcagacggtcttcgccaccgccgccgccgccagcgatggatcgttggccacaacactgaggatggattctaatctctctcgggtggacgtccacccgtttcttgcatgccacctaaataattataaaaaaatttcaaaaaaattcacaagataggttaatatgtaatatatcacttcacgaacatgtaagttcaaattcgacttctacaagttgtaacgaaaataacaaatcaaactttaactagtatacgtatattcacagttaaatttattattttttttgttacgacttatagaagttgaatttggatttgcatgtttgtgaagtgatatattacatattaacctatcatgtcaatttttttgaaattttttcataatcatttagatgacatgcaagaaacgggtggacgtccacccgagtatttaaaacagtttcccccacaacactccatcgacaaaactctcaagtaaacctgcagactaccgcagctgcgtgcatggtgcacctgtagttttatatacatactgaccgtgcgtgctgaaagcctgaaaccgaaacggactcggtgtcggaaagggagcgctgctggtctttttgggccgaaccccgtgaaggatagtgggctcgctcagtcgaagcagcgtccacagttgaaatcgcgttcgtgggccgcgcgcgccggccttgcgagtttgcgccgaaacccgcgtgcagatcacgcgagaaaacaccacggaaaagcaccaatccgtggcgttggtgcatcgtcccgacacaactgcaccctgtgctgtgcacgaacaatccctgtcgttccaccgtattctcgcaggaaatccgggttacacaccacagcaatcctctatctttctcaccagcaactaacgcagcagctgagctagctaatccccgtcaaatcaaatcaggacttggtaggacagcccacaatattaatcaagcgacattacgcactttcgatcccacgctgcgacgcacgcgtacctcccagttgtcgcgcgcgcacagcgcacagcgccacggccgaattctcgtccgatcgaccagcgccgggggagcaggggaggggggggggggggtgtcgttgctcggttcgttgccggccggcgccgtgcgccacggtagaatcgcccggacggtttgccgtttgcgatcgattggcgatcgagcaagcattattgttggcgcgtacggcgcctcgtcccggcctgcacggggcatgtgccggcagggggacctaggggcagtggtacgtatatatgtgcccatcacgaattcgcagcgactgtgcattgcgtgtcaatgatcagctctctcggggcgccttgtataattaccacgtagctagcacaaaagcagcctgacagtttacccaggagttttgaacccgggggggggggggggggttntttaaatttaccacccttgaccccctcgggacttatggggggatctgctacttttgcagtttttgcaatgaaagtactcgtatgctagtttgctcctcttattggtgggctcccccaagggtttattttgaccccaggtgggtggatcttgcctgctattgctatactacagttctcccctgccccgcgggttcatagctggttgggaaaccccgtatccaaaattttaagaattttctgacaggactgcttccttttttccccaaatcccgggaactttcctctgtgcccaaattaaactgggcgggaaaatacctttgattggnggcattactgaagtaggggggcccccccctttatcacttgctgtagagaataaaacaaggcgggtaaaaaagaaaaaatggttggtgacccttgcccttaaaattgcaaaaaaacccaccgtnnngggnatttccaagtccacgccgtggccaattcg

SEQ ID NO: 6713 - DNA, 4773 bp, Oryza sativa
  unsure (1)..(4773): unsure at all n locations
atataggcatagtacctgccataatatcaatttgggtagcagaaggattaggaccggggacttataagtccaatggacttaaattatgtgtcaacacagattggccaccttctggatttctgagcgtatatttataacctctgtttggggcggcttataattattggaaagtggaaaagaaaaagaatgcgtaaatgttttaccggaagtgttttanannatgannatggggggggggggggaggtagattaacgtacattcagcatctgctggggtagatatggacaactactaatcatccactgaatcgctgaatcaattacgcagcagcaatcagttatcagtgcgtacgtagttagctacagtacaccatctctagatatacctgaggggtgaaaacggtcggaaatggtaatgtctctttgacaatgacgctcgatcggccggtaattgaccatatttatcatttaaactacttggtgtcaatattaatataatatagaaagaaattagaaaaaacaaaaattataaatagctaaaaacggtatggtcggaaacggtaccccttatatgaaaataacgcttgatcgatcaggaatttactcgatcgttttcacccctagtcatacccctctataaatcctaaaaaactaattttaaagaatgaatctagatatatatccactgtttaaaaaacaactttctaagatgaattatgataattagttgttttatttttaggacggaggaagtagctggttgttgttgatccaccaaatgaggataagctctcaattaaaacaacagctagcgctagcttaatttgtacacaggccctgcagcttttgcacatgtgcgtatcgatcgctagacagttgatcaatctgtgacgacgatgagttctgctgttctcacgtcgtttcaattagccatcaaacatgtacacatgttccgtactcttggcaaacggtcggcactcggcaactggactagcaacgggactatactaggatatacaccaagctagatgcatcgatctcgctggcccggccggtcgggccggggcgtgacacacgctgcagccggagcccagccggccagttaattatttgggcccgatcgagacgctgatcagtaggagtacgcgtactacacgtatatactagtagctgatcgatttgaaagcactgcgtctgcatgcatgcatgcgtttatttccgtttggtcgagctcgtgaatacgcctaatcatatcgatcgttagcaggagctagctgggtcatggggtcatggggtgacgttcgtacgcacggccagacggcctccggctcatccgttgattagcagctagcagatgactgaccactgatcatctgatgatcgactgatcgctgcagatgatgcatattgatctgatcatctgatgactgatctctgcagatgatgcatggagtatgtcattatttggatgagttgacggtgaatgcgtgtggtaaactcttttttttttttcgggtgaatgtgtgtggtgaacttgtaccaaaagtttatagttcctccccggtgaatatacacatactatatcagtatatcttaggacaaaatacttgtatctgaagatgaatattaaaaaggggtagctttctgcgaatgtgtcgagctgtgcaacgcagcactggcacgtgcgtggcgagcaagcgtcgttgtctgccatcttggacatgtttttgttctggccattcgccgctacgttcaagcaggcacgacaaactgccacacagtttacgctcacagtacgtgccattatctttctcccatcaaaaaccagagagaatctgcagaaaaaagggggaaaccactctctccgtttcgatgccacttcccccatcgccatttcgccatccaacgctctccatcgatgatcatgcatcagtatatagatcacagttcttttttttttctctttctttcatcgactgaaattctcaatagaactatatatagccgtactacgtacacactgcaataagcaaatatagagcttataatcaattagtagtagtaccatgcaatcactgtaagttacataaattcatttcagataaatccgccaccatcgatctggcagatacatttcagagaacttcagccattaattccgccggtatcaacgtccaattcagacaagacgtactctgcatgactgcatgcgtattactgctactctcaacagttgaaattctgaatttcatctgaaaggccgatgcacacggcggacggaggacatgtgcatatgtcaatggcgcgagcagtttagccgcttttgcatggaatcattctgcaaaaccaggccccagcgcgggcaatgtgcacgtactacttttgcacagcaatcgccctcttctcttctccatggagtatgtatatatatgcaactgcaacaatgcgtggttgctttcctcctctgcatgattccattcgcaaagtactcctcctttggggatagagtccatagagatgtggatgtgatcccatcacgatgttgcactctcaacagtgtgtgggtgaaccagtgaccgatcgatcgatccatgcaagcaatggatcggaggacgggaggagtagtagtaggagtaggacaagtcacaagtactagcatatatagtatctcactggcaatatgggtgtctccatcactgcaccttcacggcttcctcagtacaaaatttaatcatttttatggttggcacgagtattaagaaaataggtgagaatgattaaagaaaatgtgtgattggttgagaagaaaaaatatatgaaagagaatagttttcattggttgagagaaggaggtatgtgaataaatcaagaattagctttattttgagacaaattattgtgctaaaaacaactacattttacaaaggaggtagcagataccaagctaccactccatccattccattaaaaataaatctatcacgagacatatgggagggagtacttgcatacttcatccgtcccacaaaaaatcaatttaggatcggatgttgatatattatagtaccaccaatctggatgggtttatgtggtttgattccttaatccttatcaaactattggtagtgccaaatcttagacatgttttggcactaccaatgttttagtagagttggactatatgagttggcaaatattcgcatcaatccaaacatctacaaaacactatttaaattgccaaatatttggtagggcaagtcttggcattaaaccaaaacagaccataatatttgtttatattcgtagtagtaggatataccaatatcagctactagatttatttttttatgtgacggaatgtgcggttgcattgcattttcttggcgaagtggctagctagtactaggactagaggtaagcatgtagtggtagctagaataatggtgatggatatggggcaaatgcataaaatgtgtgtagtagtggcaggggagagaggctaccggcgagctagctgccaatggatgcaatgttggagcattgcatgaattttcgtgcctggatggttgtcggtctttctggggtcaggcttgtgcaagtcgcctgacaaaaagggctcgcatacacgcatgctgcacaccgcgaagaactccaggcttttttcaaggcgatcaccacttaaaactgagggccattgccaatttgtcatggccaccatgcatgatcgagcaagcgagagcgaacggaccaaaagtttttgctttctctcatacacgacctaattgcatcgtttctcgagcaaaaaaaaatcagtctttttgctagctatagcttggttcattgcatgggtacaattatatcatggaactgtactgctgcattatctgaaactatttgccatatgacagtggcaattaagctcaagattcaagaagcattccatttcctcgaatctgtcgctaagaggttggtagggaaggattacaagtacatgtacatgcgcgagatgcttcctgtcatcactggatagaggattaacgttgttcccaaggagaatgaactaaaaatgcagcaaaacatcatcgttctctaggtaacctcgcgaacatatatatgcagaagtttggaatgattgtctttctaccacgcgctccttggaacagtaacaccttcagggaaaaaatagtactcctatacaagaacaagacaggagaaaaatagtataaaacaagtgctatgggaaaaaaaaacatgtacatatactctatatgtagagagagggagtttgcatatggaggggaacctgcaaagaacaaacaccaattgctgcatatcataacaataagagacatgcgactgtacaggcaaggagaaactagtattaaccccatgccctaaaagaggacctgtgcaaaggggttattgccgggggcagaaaaagaagggccatgtctctccatgcccgcaccttcacctccacccccctaaaaaggagctcccactatttgatcctcactcaccctccttataatggcatggttacaattttcccttggtccaatgcatagctagctcttaggcttgtccagtacacttcggttcagcaacaatagggtgaaagactactccttgcactgcaagttaaacctcacaaattaaagaaaacaatattccctcacttatggcttgcatatgctaatagactagggtacaatgcaacatggaagggtggcatttgttggacacttggtaggcaacataataatttgaatg

SEQ ID NO: 6714 - DNA, 752 bp, Oryza sativa
  unsure (1)..(752): unsure at all n locations
cacgggcnattganattcgagattcgagctcggtaccctatggtataggagtattagctaaagtaagtactttatatttttgcaaaaaaaatttattaattttaataaaaatgtaacaagaagatgtttgaaacgtgtgaataataacatggatatttgaaaaagaaagggtagaagaaattcgttggggacaacaaaactagaaactaggcccacttgttaatcattggtgcagaaaaattcggcccaatccggtccgttcgcctctgggcggtgacgatccaaccgtccatccagatcctgggaaagccgccggatgggacccattccgatcccgtcgtctccaaagccccacccccccccaccaagccgcaccccggcttacaggtgggccccacggaaccgagggttatatcgcgtggttcaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 6715 - DNA, 741 bp, Oryza sativa
  unsure (1)..(741): unsure at all n locations
gcggccttgaagttgatatgcttgtttgccggcagcccgactctagaggatccccatgtcgtcttctccggcggccacgtcgcggtcgtgctcgccgcctccggcggcggaggagttcgccatgccggcggcgctcagataatcgaactgtccagtgtgaaattctctcgttgcagccgaggcttgaaaaatagtcttgcaggcgctcgtcaaaaggtttggaagtattttggttagatccaagttgctgtttgatacagccacacaataatctgctggcgataatggctggatgtgacccctggtccttctcgatggcggctgggcaacaggctgaacgatagaatccaatacaccagtgctctacagcacaagttgcttgcttatccaagaatcgagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6716 - DNA, 758 bp, Oryza sativa
  unsure (1)..(758): unsure at all n locations
cgcggcccattgnanaattgnnnnnnnnnnnnnnnnnnnnnnnnnnnnnnnnnnnnnnnnnnnnnnnagttgaagccagtgattgtgcacttgaattaccatcctgataagtcggaacgcatgaaagcagtgattgagttttacgtcaatggaaaacagaatgcacttgaacattttcctgatggatcagaataataactgattaactgtagttgtcgtaacacggcaaatggactttttttttgtgtatctgttgctattggaacactgaatgaagacacagattagtgatttctataaaagagctcatcacattttggatccattgtgtttggctgcagactttcactaagcatctaactcaaacagttcacataacacaaataccagcttccttaccttctctactttgcactcaaacataaataggaaacaatgatcacaataagtctttactatagaaactctttaattataaaaacttttactaccttttctggttcttttcttccatcacatctacttttcagtataaattttcttatcctttctggttggttaagaccaatcgttttattttcctgtttcgccctaattttggttggggtcttttgttatattaagtaggatagaaattatttaatgttaaaaaaagtagggtataaatattttacaacatcaccaagtgtgaagagaccttgaaacgaaaaagaaacagaagcaaacagaatagtcccgcctatgtcgatctattggaa

SEQ ID NO: 6717 - DNA, 741 bp, Oryza sativa
  unsure (1)..(741): unsure at all n locations
cggcgccattgtgtttgacatnctcggtacccatcctgtttataaatatggatctgacaaataagtagcaccatcatgttggatgttgaaattatcaagcttgctcttttttattgtacttaatattttaccatttgggttggggcagggggtctaccagggaagccgcactctctcaactggttgatgcttttgaaagcttcattcttcatggtcttgtggagaacaagtaagctaatactttcaccagtcaatcttacagttgcatctagagataatagttacttagttgtcagcaatatggatattatatagtactagtgattattggaaacatgaaagacttatatgacaatcaagtccaacctagtcagatgtcagactaacacacttctcagtgaagatggactatatattaattcattctgttccattgtgaggacgtgttactgactttattttttccctctttcgaagatatgccaccctgctgagtctgttcaacagttcgataaagaagggatctacaaaagaggcttgtttagcatcccgtgccattggtatgtgccctgtaacactaaatactcatttccgttcattgcagctattgtttactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6718 - DNA, 764 bp, Oryza sativa
  unsure (1)..(764): unsure at all n locations
cggccgtgagtaccgattactatgcgcgaattcgagctcggtacccgttcttacgacaatacattgatttgtttgaataaaatgtggaatcaggttcattcatctgtctttcatactgatgtaaattctattcgatgcatttttttttccagttcaatatgtttctgatgcacttctgtgaattatagctgattgatgatttagtgctgcttggggttcgagctggtggggatttaaacggtttgcaagcgcttgatcatgaagagatgtcagaaggttggctacttggctacttgttttactttgctctctgaggtttgtttttctttcagtactgtcattgactattctttctctattccgcagaatctcttgagtcatgtccttctgaggagatatttctcttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcgg

SEQ ID NO: 6719 - DNA, 733 bp, Oryza sativa
  unsure (1)..(733): unsure at all n locations
tgggctaggattgaaangccatnngnaannnattgannatgcanaaactnttnnnnnnnnnnnnnnnnnnnnnnnnnnnnnnnnnnnnctgttgtgcactagggcaatttcagagattgaagaatcagaaaaccgagctcgcaagcaagctgaatatttgagaaaatgtttagaagagcataatcttgaacttcgagtaaaagcagcaaatgaagcggaaactgcatgccaacaaaggctttcaattgctgaagcagaactggaagacttaagggccaaagtggatgcatcggaaaggttagtattggtgaaaattttgttttctcaacccctccgtgcaaaattgttctccagtttattgggacttgccttttcaaaataattctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 6720 - DNA, 945 bp, Oryza sativa
  unsure (1)..(945): unsure at all n locations
agcgccctattgatnnnnnnnnnnnnnnnnnnnnnnnnnnnnnnnnnnnnnnnnnnnnnnnnttttacgcgactcaaggtggaagacgagtgcgccacagataggtgggccgctttgtagggagcgagagatgggccttttggccacttttccatgggcctgaaaaatagtgctcctactacagcccacctgatctggcccgtaggcgaacgatgaaggtgacatcactcgtggacggcggcatagcaacctggaggctgggggtcgaagtttaattctccgaccccatgttttctcgattttttgtttttgttacgctgtctggatcgacagaaaaaaaaatgttgttataaagattcttatttagacatttttgtttctgttacaatgcctggatcgacaggaaaaaaacatgttgttataaagattcttatttagacaattttattttgctgtgacccattgattgcagatcgtgaggtgcaaaaaatgagttttgggcctcaaaacctgtcgacagcccaatagctagttcctatttgaaagggaaaaaaattactttgactccctcaactatagcccgagtataattcatatcctccaaccacaaaactgggtatatcgacttctccgactattaaaataggtgcaaacaatatccctcggtgtttttggaggtggttttggctgacgtggcgcctacgtaggctaaacatagactaatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6721 - DNA, 14959 bp, Oryza sativa
  unsure (1)..(14959): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatctatgaattcagattggaccgtgtttcgccatctcgaaacgataacattcttataaccaacaaattacaaggggaatcagaatatttcagttacgacttgaattgccagtaaagcaatggtgaatagcagtgcctagcgtcactaataaagattttgtccttgcatctgatttgcttcaagtccactccctttcatgaaaaaaacagccgctgccttgccctcaaaattgtgcttgtgcaagctagctagctacctacctttgttgattctggtgtttgtgcactactttgcatgagtgtatcaccacaaagatcaagactcctgaaaacatactagtggtaactgataactccacaataaaaaaagaatgagaattattctgatgaaaggttgagctcaactttggtgagcactcctggtggctttagatctcggatttctcattcattcacccatgatgcatatatatgtcaaagtctcactttgattccccaacacccatggtttcctcccctttaatgctttataaacctcaattttgtttgtgggccggcctctagctagatcttgatccctcctccctcccttgtgactttgtgaggctcacattcagagatatgaacatgtagtcactcagtgctggtattaaggccctccaaacacctgtcaccataatcatcattcatcaaggccatcatctactaagagtactaccaatgcttttatttagtgatgatgcatttcacctcttgatggccatcctccatcgacaaggagtacagtttgctaacctttgatctttgacatgcattgagcattgtgtccagtgtgatgatcaataattgttgagcaggcaggctagctagtttgaaagataattgcaaatgaatcatgcaaacaactgttggaacaacagtagtgtgtgtgcgcgcttgatgagcatgacagccaatattatttgatcagatgcacgtacgagtgcgatctacacaggagagagaacgttccacaactgctaatgtttgactatgcttggatggaacagtacacttgctgttcttcattgacagcaacaaaatttgaatttgatgatttcacatttgagttgattttgatttcttttatatagttttatcttgcagtgttggttttcaagtcgctaaaaacacacacacaaaagttctactcacaaatatgttttgtcgttaataagcattacggcttataattagctatagtacagtaaaaatcagaatcctctgtgtgtgcttttcgtgtaagtaatatatctgccaagacttgtagtaacagatgacctaaaaagggggctaatttcttacagttcaccatccatttattgtatactccaatttgattgtgatgttgccaagatgcttgggaattagtggtgccagttgttgtcatccttgtggttgtgaggtctggattctgggacagataatctttcacgcaactgctgaatctaattagtggcctgcctgcctgtgatggtagcttgtggaaggaacagtgctagtactagcagcattttcttgaaagcacatgcatgcatgtccattttataatcctaaggcgaaagccttatttgtcgctcaagaacagtttatggttgcttcttaaatttctggagatcggtgacatctcaacccttttctgatgcttcacgagagcctgttctgcgtctgtcagctggctgctttgcttgcggttggattggctatcacctggtcacatttttgctgtactcccgctcaaccttgaattcagattaattgtattaggaaacgtcccattcaatactaaattgatttttcatgggacggaggtagtagctgctatctttgatttctcattttgttccccttctcctgtaaagtatgagtagtagtaaaaccaaataagcattctattgacaaacatatggggtggttataaatctaaaccccccccccctttttttgccgaatggatgaatggctgaaaaatttgtgataattgttcaaagttacaaatggagttaaaacaatattctaaggaattcatatacacaacttttttttaataaaaaacaccgttcagaagttcagtgacggtgagcttgcgcattaatccatcgttccattccttagaaattgaaatgctggaataagctgtggcacctgctggatccgaaccgagtgctcttgcttgaagtggacctgtcctaacatatgggagtatatttcttgtaaaagcaggatcataaattagatccttgtactgaaagttgtattgtcatgaaagaaactactcttaaaaacgaattttggtgtcacttcagaaaaagaaggaaggaagatttcaagcggaaggagaggaagggaagatgcaaccagatttgtggtgagaaactgggaattaatcaatgaatcattttgccttaaagcgaagctttgtggcgcgccgtgctagctccgaggtctgaaaaggaaacgcgactgcgacatcgggctcatgaattttatctttcttttttgccctcgtttcgttcagttcttgttgctgcgaatgagagataatgggcgatgatgactcggtgtaggacggtgagcagtgatcaccaatttccagagattcagagagatatcaattcagagcttcagatctcgtcggcagctctgcgtcaccagcagtacactctttctttcatttcaatgtactagtgttgctttggtgcatgcggagagcgtttgggtcaatgctttaacttatcacaatacacattggagtatcactaattcttaaccttgtgttagattgattgttatagttgtgattacgatactttcttagtaccttgtcccacatgtcatatacacgatcatttgcctagctttttagctacaagtatagcttacaatatgtaaactacaatgtctgaagtgaattgtggcaatgatagttaagaaccaaatctctgcgtagtactgtactagcatcgcatagatgcggtgtggttgttcaatctttggacgggaagatgcatggaatcgatatcagcgtcgatggtggcgagcactgtggctgttcaatcttcgcatagatgcatcgatcggtagagtggatgggtgagtcatagtcatactcgtaggttgtatatagagagcaggtagtaggaggagtagcgtaaattctggcgcagcagcgagctgagctgagccgccccacctcaaatggtcgttatagttgcaatcgaccagcagcagctagcagcatcggatcagatattcagatcacgagcactataaacctcacgcactcacccacgcagtgctcttctttttacccatatagtatatatttttcttgttattattgcactactagtaacaaaacacgcatttcttctttcatgttactgcatccatcgtcgtttgatccgccaaacctctaaagatcaggtggtatcgtaacgtttggaccaggtggcataggagttttttacccaggagcatgggtggcgatctagtctacggattgatagccactagtttctgtgttttgtgatgaggaagtgttcttaggtccagttttttggctgtgtgcattctatgtagaggccgggggtggactcagttggaatgtattatcttgatgtatttaactaagtcttaataaagctttcattattttaaaaaaacctctaaagaccaaccattggtagctagtggaaccaatccatgttgtcagcacagatcgatggagcaacctacagtatatagctgctgtcaagtacaggtagtagtgacaacggcattgtgtaatactcatgaaaagcaagcaacggcagcaggagaagtctctttcagctgtcaatagttttgccgtggatcacgagtagagagtcatcaaatcagatgtttattagacggagcgtatcagcgtatcgtgtactcctgctagtgttgctagtgtgtttgtgctgcctgcaagcgcaatgcagcagcaagcaactgcagtgagatgatcgaatcgaatcctgcaaggggaaaaaggaatcatcagtgaatgaaatccaatccctttcggttttggttttggttttcctgcctgcctggttgcttgctttgcagtttgccttgtggtcgtggaccgagctgctatgctattgctagctttcctcctttcttttcgcgtatctcgatgactcgacagcttccactcctgcactcttacagcaacagtagtaacatcacgttgcccccacacagacgcacagatcactggagatgcaacgcaacagaaaagaaaacaacgcaactgtctagttccacgccaaaattaaaagtttaaagaaattaaaactatgtaaccaaaacaatatgaaaacgatgtaacgaaaaagttggaagtttatgtatataagggcatccacaatgtgaaataaaagtagtccataagcaatattatatttcattcagctacctattaccattgtgcaactagtccatattgagaaaataataaaaaggtatccataagcttatggactacccatatggaataaataatactatctatctctatctctctctcatctcctaatgctactttgtatctatatacattgtagagattgctatagttaaagtctatttatgtgggtcccatctatataaattacttgccctatatacattgatgatgccctaaaaaagttcaataggacgaaaaagttaaaagttaaaaaaaagttgaaatgtaaagagggccagaaaacaaaacgaggctggccccgtgcattatggaggagaatgtggtcacggaaaatccctgacccaacgtttcgtttctaacttttaccgacccagtgtgaaaatagtaaccgacaaaaataaagaaaaatagtgaaaataatgtgagcatgaaaatgattttattgctatatccaccatttccgaattttatcataatcttgagcgaattgctaggttttataatatgataattgttgaatttctaactactataatattcatggtacatgtctctatttgatccatagcgtggagacccatcaacttttcaattaaacccctaagttgagtgcatagctaaaagagaaacatgtttcttaaaacataaagcaaatatttttttttaagataatgaaagcttttattgaactcagtcaattacatcaaggtgatacaattatcctgagcacacttccggcctctacataactaagatgcacacagctgaacaaacaaaaccacactcgaaaggaaaaaagaatgacatggagtattgaggaccatcaatctaacgactaaattgccactcatgaacaactccttggtcatctcctccaaaagcacagagttttaaggaccaccaattctaagactagatcaccacccatatctctgggtaaaaaactccttgaccaccttctccgaatgttgacatgccacaactaccatatcccgcgaaccaagcttctgtaggatagcccatgtacgaagccaatggataagagaatataaaacctgcaaattgaagatatgacttttttttatcaaaaatcacattattcttgcatagccaaagcgaccaacaagtagcagctgctcctaacagaacatgtgatttcaaattattatgaattccatcaagccagctcccaaacatatgcgctacacaatatggtggaggaagtccagatgttgtttagatgatggaccaaacagaaagggcaaaatggcattcgaagaaaagatgtctaattgtctcgtcattgcaacaaaaacaacagttcttattgccttgccatttcctttttatcaaattgtccttcgttaacaccactccacggcgcaagtaccaaagaaaaatcttaacttttaggggtatctttaatttccaaagacggttattaatgttgggaacattgctgtgaattagagctagataatgagacttcaccgagaactccccatttgaggttaagttccaatgaaactcatcttgctcctgagttaaatgaaaaccagtgatgcgcggtaataaattattccacgctgctagttttgatcctataaggtctcttcgccatgaaaaagatggaggattgttttcgaagacttgtgcaactgtagcgtgcttatgcctaactatgttgtaaaggcaaggataatgttctttcaaggttgaattgcccaaccatttgtcttcccaaaacctaatttgggagccatctttaattataaaggatccaaaacggagaaagtcccatttcaccttcatgaggctagaccaaaagtgtgagtcccctgccttccattgagcttgaggaagaggtttatcaccgagatacttattacgcatcaactgttgctaaaccccttccgtggagagcaacttgaataaccacttactaagtagagccatattcttaatttccaaatcatgaattcctaatcccccttgttccttggggcggcacagtatgttccatttagcaagacgatacttttttttgaccatcactttgccattaaaacctggagcgaaagtagtcaagctttgtaagtatccctcttggtatggcaaagaaggacatcatatacaacgggaggctacttagcaccgaattaatcaatgttagccgtcctccggtagataggagttttcctttccaactgattagacgcttttcaaagcgttctacaacctccttccaatcggcatttcttaatctcctgtaatgaatagggatacccagataccgaaatggaaattgaccagtggaacaaccaaagagttccatgtattcgttttcaaaatctttcgcttcaccaaagcaatataattcaattttatggaaatttatcttaagacccgataattgctcaaagacaaaaagcaacaacttcatattactagctttttctaggtcatgatccgcaaataatatgtttcaataatctagtaaaatagcttaaaaagaacatgttctaaatatatacaattcagactatatgcatgcacgtgaacatttggagagggatcgagttaggaagtactagactgtaaaaaaaaaaagataaaccctaactacaagtctagatatgtactccctccatcccaaaaagaatcaattcctcatccagatttatagtcaggaattggttttttttaagaacatagggagtatatgtttaggttcgtaactaggattagattttttttgaacggagggagggggtaattcattttttcttttgcagtgaagaagtttgattagctacctgaacctgcatttcatgtagcgcaggcaactcgtacggacgtacgccggctgttgaagacttgggatcacgatcacgatgtggatcgataacacacacgtcggccaccgtcggcgtgagggtccatccatccattgcatcccattacgcatggcaattggcaagcacctttcatgcatatgccacagctgctgttgcctgccgacctccctagcgattacgcatcgtgtgttagtaagtaattaaattactcctaactagggttagggtctatttaagtagagtttcaactcctaaatttagcagcctaaactctgctccacatctgtaatttattttgtaagagcttcacctagttccgctactatattttaggtgaaggtaaggtggtgtttagatccagagacttaactttagtatctgtatttagacactaatttagagtattaaatatatactacataccaaactaattacataaacgaaatctaatttgcgagacaaattttttaagcctaattaatctataattagagaatgtttactgtagcatcacataggttaatcatggattaattagacttaatatatttgtctcgcgaattagtctaagattatggatgggttttattaatagtctacgtttaatatttctaattagtgtccaaacatccgatgtgatagggacttcaaagttttagtctcatctaaacagagtctaaaactgtttgtctgagcttcagctttaaaaaagatgcagctgaagcgagctgtgtcaaaaaaaaaaaaaaaaggtctattctcatgtagctcctttcggcagtgctacgaccgatagatcgatcctccatagtggttgaagtattaattcctgctgatttagcaagcaacatgcatggatgcatgcgaattccaagatgagctaggaagtgcatcagtgcaggcatgttgcatgttggtgccttttcttcactgtcatagtacctctccgggccattgattcgctgcttgcttgttacacttgcaaagggaaatcatatcatgcatcgtgtgcatgcatggtacgcatcaatgcacttcatactcaattcttccgtttctattgcatttacccctttccccgatatgatgcttaattatggtgcttgcgaattgcaatgcatgccatagggtagggtagtggtaagtggtaacaggtcaattagtggtagatgcactaacaaccggggttaattagctactcgtaatagagcttagctaagccgttcatttttgttgttggagtggagtggagcatcgctgctgctgctgttgttgctaatttattaatctcaggtttctgcttgcagcactgctcgatgcactgagcttatacttctagatcgatataaacaaatgaaaaacaaaagaaaaaaaaggagcactcgtactcctatcagcatgagaaagatgacgacgtttggtttgactgccattggcgtaactcctcctcctcctactatgcatcagcgtggctttgctttcgggaaagcatatgcttgtcctttttttactaccggtaaatccgcaacgcagagtagtgctagactgctagtaactccaatacccgatgaacagaagaagaaagcagtaataaatggggttggattgcactgtctctcgcaacctttttcgcgtgaaaacatgagagatgtgtccacaaattttaacatcagcggagcggaggcctgctgccatttcgatcgaggaggagagagacctgccaagaacatcgtacggacagcacagcacagtgctccgtgcagatgcagagctcgagaccataggtaaaaaaaagaagagcgccccgccgtccacgaaacgcggccgtgtcgtcgccgccgtcgccgtcgacgccgcgcatcggcatccggcgccgtgtctgtctgtcggtcgtgcccttcgcgttcagcctacgccgctggacggtggacgccacgcgagtgcagaaccatgtttaccaaaccatttggaatagaggccgtgtttagttgattttgataaaaaaaaattagtacaaacacatatttgaaatattaaacgtagactaataacaaaacaaattatagattccgcctgtaaactacgagatgaatctattaaacttaattaatcaccacattgtcaaatcataacgtaattatgatcaaaagattcgtctcgcaatttacatgcaaactatgtaatttttttccgtccatgtttaatgctccatgcatgtgtctaaagttagggccacattcaaccttgtagtttgacgactatcatgatatatatggtggtttcagaaacattatcttacatgataaccgccataactgcacggtttggtacgcgtgccccggtggcactggcactggcaacgcaacgcacacgacgcgtcgcgctgcaggctgcagctgctgctgcggtgcctttcctatcgccgttgccgtgttggtggcgttgcaatcgcatcgtatcggcatcatcgcttccgccaaacggacgcatccgcggtttctgctttgatttctttcaggtttttttgtaattttgttcggcgagtcaaccaggccagaccacagtgcggggcggcagtcagtcgtgcgtgtgcatgcgactgcgagtatgcaatgcaacgtctctttcccatcgcctcgtcttgaatggtaacgcagccactaccacctcatttttccttggtgctgtgcagcccctagttaacctacagcttgaccaaacaaaacaaaaacaaacaaaagctaacttagtactccctccgttcatcttatttaaaaaatttaagtaattattaattcttttcctatcatttgattcattgttgaatatatttttatataggcatataattttatatatttcacaaaaaatttaaataaaacgaacggtcaaacaaatgctaaaaagtgtaaaaggttaacagtgtcaaacatttcaaaacggatagaatattttatttccatctacttccccaaggttacaataaaaacgtctagcatagtcctatataagtacttatatctatagtatactattagctcggattaatttgtcggctctgaacttgtataggagtaaaattctcaggcgcaagcttttctgtagtctgtatttattcagaagacgcccgtctagctataccttgaaattagaaagaaaaacaagacatttgctacgaaaatgagcaagctgtcagcagttcaaatcatagtggtactactggacatgctagtgggtaacaatcgatcttgacgatggaaaccatcaaaccatggctttgtgcttgaccaaagcaacgaaagctacgtcgcatgtgtttcagactttcaggcctcgtttatctagtcaggactctgaatataaacgtgaggacgaccctgtttaaagccggctaatctgtccgtctaaaactcaaaatctaccaatctgctcgtctgaaactgaacacggacactgacctattcgctctgccaagaacacaagatgctaagtgacaacacattcaccattcaaaaattcagacatcacgaatgtgtttggagcgtacaaaacggcaccacgctgacatggcaatgtgaaaagtgtgaattttgattgcacggctggaattaaacattttcatgcatacgagaaggtgacaggattatgattgttttctggaaccgtaggattaggagaaaataataaaagaatcatagaatggtccaatatttatgaaattttcagatcgtgattatcggtgaaagaaagccatagctattgccgctcaaattcggagagccagggcatatgcagctgggtgcacaaacagttcgtaacgaactttatggctagaatattttggactctgaaacaagaaaaacatgtcatgcttttaaaaaatatcagaatattaattcgcaatatatagctggcaatggcactttctttaaccttgttttattggttgccatgcgcgaaattgataaatgcacgccagacattttagagcccttggaggttgcaatgaacttttggatatcttgcagatttattccgcaatcaagagagcttggggtatttcaacagctttcatcatcgttcacagaaagagatttgattacaaaagggaaagaaatctcaagatagttccgtgacatgatctgatagtatgtcacaagtcacaacaccaacccaaagcccaccgtttgcaaaaaaaaaaaaacaaagcgtttttcgtgcccgttttccccatgataaaattagtagtatatcgtcaccaattattgtagttagctccacggaaaggaaaaaatctatcaaaaaggaaaaggctaattatactcaccaacaatacaaatcatcagcacattaaggccccgtttcatttaaattatcaatttaattatagagataaattaaaaaataaacttaataaatactacctccattttttaatacattatatgatgttgttgactttttgacaaatgtttaatcatttgtcttatttaattttttatgcaaatataaaaaaaataagtcacgcttagagaacatttgagaataaatcaagtcataataaaataaatggtaattacattttttaaataagagaatggtgaaacatatcttagaaaatcaacggcgcaatatattaaaaatcggagggagtaatatgaaaggtctaagcaatttaataggattgttttttaaaacctagatctcatttcaataattcggtgaatatacgctaaaaagaacatgggttaattacttccttgtctagccatacggggaaaaaaagtgtgaacacggtgcaatttaaatgcgtagattcaaaaactccagttttgttttcacgtaacgcaaatgcgaatcaatcgtaatggatctccaattcggggaggagggaggaataaatacgtcctagtcgatcagcagcaacagcgggtcaccgcctcctcgtgttctctctgctgctgcgtctgcatgcgcgatgccaggcgatgcgtgtgaggtgagaccgtgagagagaaaagaaacagcgagagagagatgaagccgtgattaaaagaagagaggagaggagaggagaggaggagaggaccagttcgctcgcgctgcccgcaactctctcctaccaccaccgcccccggggtgcctcctcacacacttggcgcgcgcctcgattcattcctcctcttccttccccccttctttttcttcccccaccttgcttgcaattgccgcggaccaatggcagttcaggcgcattaccaccaccaccatcaccaccagcagcagcatcagcctcctcctcttttcctcgccaggtactcaccgtcgctgctcttgatcggggaagagttacgatggatggggtgattgattctggtgttcttggtttggatttcttgagcagaggcgtcgtcgtctcgccggagaccaccaggccggcgggcatggagtatcactaccagcagcatcagcagcctcccctcttcttggacttctcgcatggagatggaggtaactgatcgcctttgattcttgatctgcgtgttttttccccggttcttggattagattgagatggatggtgttttttgcagatgggggcaactcgagnaagcggccgcgagaggcggatgcgncggcggccatggttgctgcgccgccgccgcagatgttgtcgctgcagccgcaggcgcaggcgcaggggcacaaggtggtgagcctggcgcagctgcacaacaagcggccgccggcgtcgacggggctccgcctcgacttcgacgacggcgggtcggagcacgtgtcgacgacgaccacctcctccgcgtcgtctctcctctccgacgagctcgccacgcagttcgaccggtgcaagaacgagatggcgcgtatgttccaggatcatgtgaggatcgtcgatgtcgatcgttttgattcgttgcttgccgctggtggtgttcggcgatgtgttttctgatgatggtggtggcgtcgcttttgcttgttgcagacggagaggctgcgccgcgcgctgggcgaggtgaggcggcggcactaccggtcgctgctcggcgcggcggaggcggcggcggcgcgccggatgagggagaaggaggcggaggcctcgaatgcggcgcggcgcggcgccgagctggaggagcgcgtcgcgcggctgcgggcggaggcggcggcgtggcaggcgaaggcgctcgccgaccagtccaccgccgcggcgctccacgcgcagctccagcaggcggcggcggccgcggcgcaggcgaggggcagcaagtcgccggaggacgacgacaacatcaaccccaacgccgccgccgcggacgacgccgagtcggggttcgtcgacccggacagagtggaggaggtgaccccgccgccgccgccgtcgcggtcgtgccggacgtgccgggcgaggccgtccttcgtcgtcctcctcccctgcggccacctttgcgtgtgcgaggcgtgcgagcccaccgtttccaccgccatcgccgccgcttgccccacgtgccggggcgcggtcaccggcaccgtgcaggtcttcatctcgtgaaaaaaaagaaaacgattggtacagaaatgcctcgccttttttttttttttttttgctcccctcctcctcgggacatgcatggccattgaaagccaacctctgacaatgaatgaaaaattgtaaagttttattagtattagtttctttttttttttttgcatggcttaatcaattcgatctctctgttatcagatcatattagtcaagaccaaatgataattggcatctttctgctcggttgtatcattattagtcaagatcatatactatttcagagggttaatcacagtcactgacactggatcgctatcgatctagagtgcaatttttttcttctttttactgcgttgtgttgtgtgatttggtccgttgtacagttgctgcagtaaaaagtgctgcgagatgtgtaccaccagacaccagcgcggttggcgatttgcagttaaaggcgaggggggcgtagtggcgggagatgcgcggggatcacgtgagggcgcgcgcggccgtccgatcgcgatcgagcggccgggagtgggtcgcggcggcgctgtcggttgttcgccgggcggccggatgggcgcgcgtcgcgatgcaaaacgcagcagcgaatcaatagcggaggagtggaggaggctttgttgggccgtggtgtcaggcctccatctccaccaagagcaagagaagatacagaagagatgatacaagaaggagcagaagaggaagaggtgctggagcctgacgacaaggaagcagatgcccaggaacaaggaggaaaaccagacttcaagaccaagaagaagcaagttccaggggatcctctagagtcgggctgccggcntaganggttagtgattctcatntacgccg

SEQ ID NO: 6722 - DNA, 26988 bp, Oryza sativa
tctgaattgaagcgtcagcttgaaacggaaccgcctgaattctgaatttccagggatgtactggaattggtacggatattggttgcatgccctgcccttgtcaagtttcttttttttcctcgtgtacttgttggttgcgtactaaccaaggatacatcaagcaacgctaaacagactgatactacgtatagatagcagccacatgtttgatgctgctgctaaataccaatatctctgatttttagtatactgcataacactgctgtagcagttgttttttgttcggtgcatcgcggtgcgatgacaccgtcacaccagtgtgatgcgtagagacaaaaccttactctaccagttgtatttcagtaatgaaatgccagttcatttcagcaatagagtggggagcgaacaatgctctctatttttcctccttttttaagaaaacacagttaatttacttattaacatatctttaaacattcgtcttacttaaaaatatttattctgcagttatttgatttactactattaaagatgctttatacgtgatttatatttttatatttatattgattcttgaagtaaatcgaatgtaaaaaaaattaaggcccttttctataaaaaatcggaggggtacggtagacggtagtgttcaattcgtggcccatgttggttgtatcgagtgcaggttaattgctggcgggtggagaacaggtcgaccgaccagcacggcgtgtagagagacaaaaaaaaaaaactccgattttcttgtatggtttgtcaacacggtacgtacttgtgtcatgagctacatcttctgaaaaagtcacaggaggagttaattgctactccagacgtgtccgttgatatccatctccatcagctgctgcaggaggacacggtatatgcaccgtgaaaggagcagtccacaatgaaatgcacacatgcatgcatgcagtggtattttggtttattgttcagtttgcaaagaagttagtgtatacagctccgttttatatcgtaggataatttaacctttctaaagttaaaattatttaaagttcaatcatgcttataaaaaaatatagtaatattttcaacaccaaacatacatactattaaattatattcaaatatgcttataaaaaaacatagtagcatgtttataatgtttcaagtgtgtacaagcgagaccaatttattctagacttaatacacgtgtagtaatagtggctaagcagagtatcattgatcaagatcggtgcacacactcaacaacgagcaaacttgcgtccggcacagtgtaggagtacgtgtacttgtactcgatcataatgcaatatactatacagcacgcaaaagaagttaagaagcccaaacacacatggaagaaatcaatttaaacgactcgatatccatcacgactgggtacatataaactactcctacgtgtatatatgccaaagttcgatctgccacgatcgagcgctcgatttgctgcaactttgttccttgctgctgggtggcatctgacaggtgggtcaaggagactagctagctcgtgggcccaaatcgccagcccatctagtagctacaatgatcagtcgagccgtaacttctaaatttatctccaggagttagacatggagtggagctgcctaaacccaactctacctcttgttcattttgtgagagagctcaacccaccttcgctctcattttaggtggagctgaaactgtttagctgaggtacagctggagttgtgctaagcagtccctacgtagtgccatgtcccgtcatgtgcatcctgcaataaacttagagcatccataatatacttaattttttttttctatgttactctcaactttcatctcaattttggttcccatcgtttggcttatttcccaataagccaaaacggcttattacgaaataaaaataaatttgtagataaaatttttataaatgtattcttggtgatttaaaagacaatgttgataaagaaactacgttgaaaatatttcaaaatcaatctcaaaatttggctttttctttggcttattaagccatccgatgggagccttttatctacacactatttaataagagttatcgtagtttttctttttaaatatatactaaacaatctatatttataattattttagaatggatgtactacttttttcgctagggctcatcttgcttcgtatagtttgttagacacattggtgatgcgtgtgcatgcagactcgaggctagtggctgccaggtcagcttggtcctaacctgacaggacatgttcgacggctacgtggacgatcttgcatcgatctcgatcgccttttcctctcaactacatcaatcgagtgatctatccatccaatgcaaccagatgcaccgatctcgcccatctcgagttcagtcgtagacgtctttttagcgttaaggatgattcagtcgatcaagatgatactctctcgttccttaaatatttaacgccgttgacttttaaatatatttaatagtttgttttattaaaaaaattctgtaaaatatgtaaaactatatgtatacataaaaatatatttaacaataaatcaaatgatagaaaaaaaattaataattacttaaattttttcaaaaaatatgaacggccaaacattttttaaaaaattaacggcgttaaatattttagaatggagagagtatataccacgatcgatcaggtcgacgctatctagctagctagctctcgatcgataagggccttgtttggtttccagtgacttattccaagtccatgtcacatcgggtgtttggatactaatttggagtattaaacatacactaattacaaaacacattccatatccttggactaattcacgagacgaatcttttgagtctaattatgtcatgattttgacaatgtgatgctacagtaaactttttataattatagattaattaggcttaaaaaattcgtctcgcggattagctcttatttatgaaattagtttttttattagtctatgtttaatactctaaattagcgtccaaacatccgatgtgacatgggctaaaaagttttagccccatctaaacaccccctaagtttcgtgtcgaattttagctgctggcctgtagcgcagtgcacgagcagatagatagatagatagatcatcgaggctgatctcaaccatcatctgctgagtctggtttgccatccttgtcactcactcgatcatcggcgcttgcgtacgcagcttcgatcgattttgatttggtccttctcttctactctgtccggaatgtttgttagttcatcaattcgatccggcagcgacgaaaggtgccaaactgtactctgtatgtcatgtgtgtctgtccacatgcatgcatgtacattagcgtgaaatccaaagtagatcgatggatcgatcatgcatatcgctttgcgagatgataaggcaatcgatcgatgcaaccctgcttgctgttaactgcagttctgaatttataatcaccaatcgatcgatcggcaattaatccaacaaaacctttactagcacacattaactggtgtacgttatcgcttcaggccattcataatcactctaggacaagtcagcttttataatgggcatcaagataatcgacaaggttgagttttcacctgtgtgcatcacttgatcagggtgaagattggcttggctttctgcacacagcttgacagatacgactacttgactacactacttgagtccagctcagagcatgctaacctagatagatactctctctgtccaaaaaaaaaaaagacaactctgattttcgtgtccaacattttaccgtccgtcttatttaaaaaaaatatgaaaaaaatatagaaagataagtcacgcataaaatattaattatgttttatcatctaacaataatgaaaatacgaattataaaaaaatttatacaagacggacagtcaaatttggacacgaaaatctagggtttgtctttttatttggacggatggagtactttgatttgtaggccaaggtaggcaaagcactgatcattgcagttgattaacactagtaactgatcgtttactttttgctggctaagctttctcaaaaggctattttatctggaggcttctttcaggggaggtcacctgatcagttttgcttggaataaggctattttatctggaggcttctttcaggggatatccacttctctgaatcttttctgccgcctctttcatgctttcggttcttgggcaggcaaggatcatgtgcccaacaatctttctttactctctaccagttaattatacttatctgtactccattctcatacagtgctcctcttaattactaccaccagtactccaatttctttctgaacatacaccaaggacgtactgtaatccgtattctcccaaccagtaggacagatatgtacccaacccaatcaacccattgattaccgccactgcgatctcgatccatgcatgttgcatgtcaatcttgaattgattgatctcccgtactacacaaaattaaacacgcctgtttgattacattggactggtaatccgcatcatcaagatgcatgtaaacaggtgatcacgtgcatcacgtctgagaattagaggtattattatctttttctaagagcatgaagatccatgagtgttgaatgatgttaccatttttgtctgtttataaatgcctgaaaattcatcagaggcaggagaaattatttgagcttagctctgacatacagataaatagagggatggatgcttttgcttctctctcgatcttggctaccataaacaaggtgcacacactcctattcgagcatgtttgcacacagaaaatgggcgtcacatttcagatggatcagtgccaatttgccacctgtgtgatattctaaccgtaacgctgttgtctcatcttgttctgttgctacttgccgtatctgaattatagtttgcaactttgtatgggtctatatgtcttgttgtctgatggggaatgaggtagttgtcaggtgcaaactagtcaaatgagataggcgttctggggaggaaagaagaaaaaaaggttggcatatacgataaagataataggcagaaccgcagaaggaataaagtttttgcaatcgcatggcaatacgagtggcttggaagagaaagcaagcttgacaaatactccctctgttttaaaatgtttgacaccgttgactttttagcacatgtttgaccgttcgtcttataaaaaaaattatgaaatatgtaaaaatatatgtgtacatgaaaatttatttaataatgaatcaaatgatatgaaaagaataaataattatttaaattttttgaataagacgaatggtcaaacacgtacttaaaaaaaaagacatgttctagaaatggtgtcatcatccgtttttggtttctataggatcaaaggcaagataaacactgacatttgcctaatgacctcattggctggacgttggtagtgccaatccaatgaccaaagcatttttttccgtttcatttgaaaaactccaaatctccaaatccaatgaccgaaagcatttgatcccagagaataaaccatttttatgtataagggtgatttttgggccgaactccgaacagttctagtgggcttaatttttaggcctagtcggtcatgacagtagaatgatacgtgggccaaatgctagtgtagcttactcttaacgggctgggctgactccaaaatggaagagcagaaatgctcttgacgggcttctttccagatgggctggtaaagcgggaatttcccatcagaacagatcaccattcttgtaagtaactagcagagtgtggtagaagaaaggaataagctcgaaaagaagacagccttggccaatgccatcgagcttccaagctagcgtaccggcatccaaaggagttgttcttcgaggtgacttttgttcctcctcttttcctttgattgatccttttgcattagcatcagtatagcatctgaccgactgacagtagttggcactcagtcattcagtctaaccaatgttacttgcatactcctgtgatgtaccgatgtgctgtgtgtgtagcattgcggcttttttttttttgaaacacattataaacgcaaacgtatgtaacacgtacacgctcaccttataaatatacacacgtacattatactcctccaaagtacaaacacgcccgaaagagtggatgacgaggaaaataccctttgaggcctagtttagattctaacttttttcttcaaactttcaatttttttcatcatatcgaactttcatacagacaaactttcaacttttccgtcacatcgttttaatttcttcaaactttcaattttagcgtgtaacctaaacccagcctcagttgttatcctgtttcggttgcccctatccacgggcggctcacgtattggcaggtgcggtggcagagagaggggcaggtgtcgcgctcgtgccgggggcgatgcgacgaacgcgtcgtcgttggctgcgccttgggctgcgtggccacgccggcagcacaacgccgcagaggtagctttgcgtgctcgctcgagtcgtcacgcgcgccccgcacacgaggcatccggcgtcagcgtcgtccacatcccccgtcgacatttgcctgctttggttaagcactttgcgtgccacgccgcgttcttcttttctcttccctttcctttttcctaatctttcatcaacgacaataagctggtttggtagtcacttgctaccgtgattatgactttgctcgaccatccatccagcttgcgcgattaaaaaaggttctaattacttctcgcccttcggtttgatcgcaattaagcaattaattatttaatttactaattaacaaatccaggtgtattttctctggacactaccacacgactcagaccgagccggtaactaaccagcacgcaccacgtacatcgcccgacgccacgccacccgtctcatcccagccgcgaccgcgagggcatctccgtaattttcgcgccttcttcttctcctcctccttctagcgatctcctttcctacctcgacacagaaactacccgtggtggactgcctgcttccactgagttctagtccagtgccctcgattgattctctcatctctcgcgcgcggagggaaggtcgggaggaggaggcgcgaggcatctcgccccaatctctgctcgcctcttcgctctcgcggcgtcggcgggcggcgccgatcgccggcggcggcggcggcggcggagatgttggaggaccaggtcgccttcctgctgcagaagtacctcggcaactatgtccgggggctcagcaaggaggccctcaagatcagcgtgtggagaggtgacgacctcattcgcactcccccccccctttccctatcctcctctcgctctgcttccgtcgatgatgattagttcgtgcggctttagtcggctactctctacttttgctgcggctctgctttgttttctgagtagtggcggttgcagcagaaacagtggtaggtagcgaatcgctatggagcagcgatttcgtatggtttgggagttttaggaagttcaatctgagtgtgtagtttgtgattgttggattcgtttgtgccatcggaaatggctggcgtctgcataagatgctgcttcatgtggaagctgatttcgttggtagcaatgtaggattggaccatcggtgtgtgtacgcattggttttctgaactaaactgactggcattgatgcgtggaccacaattggaacataaacttcgtgaatgcaagtgttggtacaagcagtgacaatgtcgataatgcggagcagtgactgggaagtgctttgcagatcgaaagtatcttgtcaagctgtgctggtatcagcacctcagcagttcatacaagtgctttttggcgactgtgagagtgtgagttgtggttgctgtcaaatcgtggagtgttaataggtgctcagagtattgaattaggaagctgtttgtcagagaagggtggagatgtcacggttatctgggatgtttaacatggacgaataccattcaagagctgcagccatgtaagaagattgagggcaaatgttagacatgccaccagtatgtcctctaggtgaaatccagaaaccgcttgaattctctggctaacagacacatcttgatgctgttactcgacactacaagagcatagcgctcagagttgcaactgtaattcagaatttagggaatttatcggtttggacaatttacttctgcttatcactgacagttatggcctggaagcctggaatgtggtgtatggctaaaaatatgcaaggtgatcattggaatagtagtagtactatcactatgtatgattttcttggtctgactgtctagacgaccattcctttcggataaactagataaagatgcaagaaaacaagagtagggtggtgttcacttgtagatcctgtagcttgagcgcataaagtatatgaagttggtccttctctgttaccagttctgtgaagaattgtaaagttggatggtctattcatacatatactaggtatatgctttccatggtgccaatcaaccaaaacatgtgttgatggttggcagtaagagcatcaagatgttttgagggaaattgttgtttgagtgattgcatagacaaatcaaacgaatgtatccgtggtttgcatgttacgacgattgtaggtaaattcacattgtatatggaatggatttcaatagttcatgaaagtatgcacaggattttgttcaacttgcacgatgctatttatcacgagaagcatatgacagtaggcatcagatggcaattccatcatgtggcatcatggacggatgggctgggaactcctcaggccacctatagaatattctatgatattaagctgtttcatctaaatagtggcatgtattcgttgcagaacagacaatggcatgcatttattatatttagagtagaacacaatgtgttgttcctagaacttggtcaaataccagaaggaacttgtaaacccacttgtttttccttttgctagctattgaccctgtttatcaatgaaatatatccatttttgctgcttaatgctattacatttttttgaaatactatttcaggtgatgtagaactcacgaacatgcagttgaagcctgaggctctcaattcattaaagttacctgtgagggtgaaagctggttttcttggttcagtgaagctcaaggtttgctgtaattgcttcagctcagtgcatttacttttgccttaagatatgaagtgctgagctaaagaatgaatgtgtgaatgattattaggtcccgtggagcaggcttggtcaagagccagttttggtttatcttgatcgaatatttatattagctgaaccagcaacacaagttgaaggttgcagtgaggatgccgttcaagaggcaaaaagaagtagagtcagggtaattactttgtgaccttttaaagtgagttatggaaacaatgccagtgccatatgcattgatgatctgtggttattcactcaggaaatggaaatgaagttattggagagccaacaacagctgaaatctgaactggtatttagcccttttagtttttcgctgatgtgtttatgtactgatgataatggatcacctagttggccagatagtcaatctggctacctttgtttcgattgatgttgtgtgtttaacattcattatttttggaacacttcatttatttcttactggcacttttgttcttgaagaattcgtcatggcttgggtctttcattagcactgtaattggaaatattaagttgtcaattagcaatattcatatcagatatgaggacacagagaggtacttaaatcccgtttactgaatttctccttaaaaatgcatatagaatgataataacttgttctctatagcaatccaggccacccttttgcagcaggtttggcactctcaaagctttcagcatttactgtggatgatcgtggaaaggagacttttgccacaggcggggatttggaccgagttaagaaggtatattgttttggtgctcactaatttgataatccttaatagctctggttactttttggataccggtatctctatgcaactcactactaaaccttctggaaagtaaagttagggcatggacaccaatttcaatgccatttggtcgataagacacattccgttctcaaaaaaggggcgtgcaattcaaatatccttcgtttaaggaatacaaatcttaatttggacaacaataggtgccaaaacacactattatcatgacacaaagccatccgcagcctagtagtgaactttgttgatgcaaattctagagtgatggaggagagcactatggatgtatagttgtatcgaacagcttaaagcgcatatgatgtattttatgatattcaagaaacagaaggttgaactctagaacagtagggaacacaagaaacatctctagttgatgcgaatgtattttgattaagaatctttggcgtaatgtacttgtccattttcttttccttgtgacaatctttcataattttcataccaatggatcttgattttttatagtttatttgcaaatggtttgcagtcagtcgaacttgagagcctggcattgtattttgattctgatagcagtccttggagtgtggataagtcctgggaagatctattaccttcagaatggagtcaggtaatttccatctgtagtcaattgctaataaaaaaattgatgtttgagcatatatattatgcacgaggccatgactgcctgtcctgttgcatgggaccatttaagtgattcaagaaggcaggcatacagcaggatgtcacctagcttgttcaggaagttggcaagttagctgcaacaatcataattagctttagctgtacatctaatctattagttacccaactgagattgttagggaggtcttatataaaggaaatgttatcttttgagaggactaagcaaattttcatccctatctcttaatctcacctcttgttccccatccataattttggcactttggcggtgttaataacaaaacataccatcgatcattactgtatacttctgcacatatacagtcgtccatttttcattaactaactgaacagccataaactgtgcctagatttcctgacactgggttgcagtgaggtttcgtaagctgggtcatgccaatatcactgtttacatccaataattttattccacttgacaaattcttgctgcttcataaattgtatttcagatttttgagttcagaaagcaggacagttctaatcctccttcaaaaacacacacttacattttacgacctatctctggcaaagccaaatatacgaagatacaacttgatgaagcaaagaaaaccggacaggctttgcaaaatgcagctgttgatttggatgacgttactttgtctttgtctaaggtctgtactctccctctctctctctccctctgtgccaatggcactgttgaatgtgtacgccttgttctttatatcaggatggctacagggacgtcttgaagatggctgataatttttcttcttttaatcaacgtctcaaatatgctcactaccggccatctttgccagtcaaatctgacccaaggtcttggtggaagtatgcatacaaggtggtggttcatgaaacaaagaaagcaaggtgtgtattttctgcatatctttctctggcttccacatggtgtacagatagaaattccttgtggataaatatatgtttattggaatatgatggtaccgctagattatatttgaaggtactctcattcgatgttaattctgtagttggtattaccaatcaaggtttaatgatagtgatcatgcgaagttgtttataagcatgaaacaggattatgtttaacagtttgctgtaaggatgtttaacaagaaatcttgcatgcattccgacatctattttactcattctcagactcatgtcttccttttttgacatttcatgatttctagcattagtcttttgctgtaaatgcctggttaattggttttatgaaactgtacatgctgtgctgctgcaaacatttttgtagattagaaaggagttgggcagtaacaaggcaatcaagcagcaccaatttggagagcctagacaatagatttgatgcatttatttgttgtactgtaaatcactctctcaatcttttcctatttctgattatacccaaagcatgttattaattaatcacatatggctgtgggcattgttttaacttttgtactttttcatggtgttctccccctgtacgtatgactttatcaattattttatgttgatattcctaatggatgcagtggaaatctatcatgggagcaactactgaaaaatgcaagacttagaaagacatatgtatctgtatatgcatccttattgaaatctgacatgagccgattggttgttgatgataacgaggatataaagaaacttgatcgtgaactagatatagaagtcattttacaatggaggtaattctttcttctttttctagttattgttgctacttctgctttctgtgttatgcaccaagagaattaccatctccctgatgttgccctgagatagtaaataagtgaaaaactggtagtgatgccccataagatctgttccagctatccacacaaatgtgaaagcaagaagttggtgagattgacatattttcaatttcattatgtaacacatactgaatgttgatcattggtcagtgcaagaagttcatcatattgcagtggctgatttatttcctgatgtgcttgtagttcgatgacttccctgttcccagggaacatcaaggagctgattacatattcctattcacctgctttgtcgtacaccattttgtttttagtacactgaaatgcttgattaatgtaaaagtgtgtactccattggctcttctcagcattcctttttgtttgacacaacgactactcatgttacatgcctgtcttttgtgcaattgttgcagaatattcctgttgattatgtatgttattcttgctgtttaaaatttccttatattgaattcaatgcacacatcatggccctttttagtcctatgaataatacttagtatatgattcatagctttgttatgcttttacatgtacaagtacaatgaatagatgagtgtcctgttcaacttcatgatcatttgagccatagagaatagaacgaaggttgtccgtaattatccatgcactaacacatggagttaaactaaacttctgctccaggccttgtttcatgtgcatgttcttataccatttcttcattgctcaatgcatttagtttagtatatagttttttgatgttttttttactatcatttgtgcaggatgttggcccccaagtttgtagagcagtcagcagaaacacatcaatatgctcaacaaaataagcagcagtcctggtggtcatttggatggttagttcggatacaaacctcgcgctttatgcttgtggaaggtgtagaaattaattcatcttttgtgtgcaggactggctcttcaaaggatgagggagactcaaagagttttagtgatgaagattgggaaagattgaataggattattggctacaaagaaaatgatgactatattcctgttcaacaggatatgaaattgatgcagttctattttgaaatacgcatgaagcataatgcatcgaagcttatcatcgataactcagagtatcttgctgatctgtcatgtgaagatttctgttgtaacttgaaaatgtatccagaggcaaaaatttttgacctgaagcttggttcctacaagcttttatctccgtatggtctgcttgctgaggtttgcccatctggttctctaatttttgttttaggtgcttttacctgaaaattgaaattcatttgacagcaaagttactcaaacatgccgctatctatatgaattgacagagtgcaagtgttaccgattctcttattggcattttctcctacaaacctttcgatgagcaactggactggagtttcacggctaaagcttctccttgttacataactgtgagctatccattttgaacctttaatgtgtatttgtttattctaccattatatgtttaaagttcctgttctgtggcagtatttgaaggattctattgatcaaatcgttgcattcttcaagagtagccctaccattagccagactctggcgatagagactgctgctgctgtgcaggtatattcaacattcatttgtaaaatacttattcctatgatcagatatttaattcttccgtatttttttaatttatgaagatgacattagatgaagtgaagcgcactgctcaacagcaaatgtcacgggttctaaaagatcagtccaggttagtgttcttacactgacaaatttcttttgatgtggacattagaaactatagtttaaatggatactagcctgattaatacattttcaaactgggatttagctgtttgttgtttctatgtttgttagcaagggaaattgatttgcattttcctatgctgttgtctcttccatttcttacgtgtctcttctatgctaattagtatagttaatatttagttatattttacctgtcaaacccttcttgaatggtgactgatgcacaatacccttggtagattttcactgaatctggatattgctgcccccaaaattactgttccgacaaagttccgcccagatgacatacatgaaaccaagcttttgcttgacctagggaatttaattcttcggacggaggtcacgtgcactctctgaaagttggattttatatgcccatggttgggggtaatgtgccactgattttatttgttgcttcaggagatatgggattcccgtgcttcagaagagcaggatatgtatctgaatttcaatctagtgctaagtgatgtatctgcatttttagtggatggtgattaccattggaatgaaagatccaatgaagtaaatttattgtcagttatcgacaagtgtggaattgctttaaagcttcagcaggtaaacgactagtgttcatttactcaaaacagttaatatgataacagtacatataatcaacaggacattaataaatttttattcctttgttcagatccagttagaaagtgcactatacccttctacaagaatggcagtacgggttccatccctgggttttcatttctctccagcacgttatcataggttaatggaaattttcaagatttttcaagataatgatagcgacaaaaacagttcagatcttgcacatttgtgggatcaggctgactttgagggatggtcatctcttctcacatggaaggttgcacttttctgttctcttgaactggatttgtaatctgggttgcatgtatcatgaactgggggcataagggattaggggtagacacagtaaactttgcatgaccttattttgcaaaaatgaacaatggccaattggccatatgatctgtacatctttgagaaaagatgattttaagaggtcaacatacgaactcactgagtggagttcaattaaaccggtacatccaacttaatttgattgtcgttttttcatttatttgataggagactaacaccatactgaaattgacacatgctttactctgcttttaatcataattcacctgtaatgcatatgtgcattcacctggtgcttgtgatgaactttttttgcttaggtttctgagatgcaattttatgatgacatggttgtcattccttaaagaaatataatacagtacttgttatatagacttcaaagcaactggattttcctgatgttgcccgtggtattctgatcttaatgattgcattcttaaattttgttggtgccaactcaaaattgacgtttagatgagtgctggtcctaacatttcgtttagccgaatgccactctgaatcaggttctttagccacaggccatcacctccgaacatctttgcttctctgtgttgcctcattttctagttccctggacaaccctttgttagttattacctcattcttcattttcccgggcagccctacacatgttctgacagttgaaagctgtgctttgaattgaccatggcaaagaaacactgttgttgggtgataccatcaaatgaaatgtggcatacatggagtatattattttaaagtggatgttggagagaacaaaattgctagttgctctctcaccttaatcaatctatacttacattgctaatacttttatttgccctgttaccttaatcagggtgttggaaacagagaagctacttggcaacgtaggtacctgcgcctggtgggaccatttctttatgtatttgataatccgacatcgacaacatacaagcaatggtccaggttgtacactttcgctgtgctttattttctcttggacttttgtatcttaatatacagttgagtgcacctatatgcatttttaattccaaatagatttgtctggaagtgctataaatactacaccttaagttaatcacttatggtttcgtttcagtaaaactgttaatatctatgaatgtttttgttatgagccactagtagttttcagcgtatatttgcggagaggatctttatcgcaacttttagtaagttgcctttcaagattcttggtaggttagtcttagatgtttctcaggtatcatggtgttgtgctggtgatttcctaccatatattacttatttactatttagggagtgaacactgttaatatttccttgaaagaacaacaatattttgacatggcttgatgtcttcaatgtttccatgaagatacaataatttattgcattttcatctatggtgatgagaatagctttgatctaaccttgtaaatggcttataatctttatgctagttttatgcaggtggatatattattttgactttaatcttttgtgttgaatcacagcttacgtaataaacaagtccatcaggttcctatggagcttacaagtggtgtgcagaatatcctggcacttcatgattctggccaagttaatcccaaggaacggtcaagtagctgagttcattatattctgtaaattacttcttttattagactacaatcagtcatgttgtatcataatttactccgtcagtaatggcaagccagaattgacacagtaagcaagtgtgggctaatgtagatatggaacatgaatccctgtgacatagttgatagttctaaacttccaattaactttattttggggagattcttgaagacactggcgctttgattatgttgtttgacaatgaggaagcacgaaggatatggcagaaccgcttgcagggtgctatataccgtgcatcggtactttttggtcctttttcatatgttcaattttgttatatcctattgctatccaggtaatttagtctgtttgcagggttctgccgcactttccagctttcctgaagttgcattcccatcagagacccattccttcaagggcagctttcaagatgttagcattgaaaaattgttcgttgctggcattcttgatgagctaaagatctgcttctcatgtggctatgaggtgtgcctcttacccaattttccttgtaaacttgcatctgaatcaatggtgtgactatcttttctgtagagcaaccacaaactcaaaaaagttctgctagctaaggagagcagcttgtttgaatttcgggcagttggtggccaggtaactctttattcccttctccctccatcccaaaataagttcattttcacccatcccacacataccaatacaaaaccaaaaagactaaaataccccaactttatcaaatcccaacgcaattattcagcactttctactcccaatgcattcatcccctatttctataaactccgataccacgataccacgattgcttaaaaatgaacttatttttgggacaaatgagaggggcaaaaaatgaacttattccgggatggagggagtaagaaattaccttttgtccttgttatatgactgattcattaagctacgttttttttttgtggaaacaaacaggttgaactctcaatgaagggtggcaatctactaatcggtactatcttgcgatctctggaaattgaagatcagtataactaccctggtagtcctgtaccaaggtatttggcgagatcctttatcaatagcgtgcaaaccaacgaagtcccaactcctagtcgaaagaatagtgcaggacctagaggtactgcactgaagaaaagtgacagtgaagaaaggttttttgaagcatcagatgattttgatgaatttgaaacacctatgctgcatgagaggagtatatcagattatttcagcacacagaactttttgcctactagcctcccttctttgcagccacctgcattcagtcgaattcctggtttgctgccagatattgagcttcaatctgccggattcacttcaggggacattacttttgaaagttttgtgaaagctcagattgtgatttatgatcagcagtcccctcaatacaacaacttggataacagggtaaatatctcagtatgacagtatctagcaattctttattgcataaaggggtacatacttcgaaatttatatggatagtactatttctcccaattgtgtgacagacggattttttgttgtttttaccaggttgtgataagtgttgctactctgacctttttctgtcatcgaccaactgttattgcaatcatggaatttatgaatgccatcaaccttgcaaatgtccctgatgctgataaaaataaagatacaacatcggatcctgtagaacataatatggttgaggaacctaagtctgatctggaagcaggaccagtcataaaaagattactggctaaaggtaaaagcagaacagtttttcatctaacatcaagcatggcagaggcacaaatattattaatgaatgaaaatggtgaccggcttgctactttatcacaaaataacctctcaactgatataaaggtatgattatcatctatctctaatggatatgattgatcttgatttgattttcctaatacatgactatcttggcattttaaggtgttcacatcgtcgttcagtatagaggctgcacttggaaaccttaaaataagcgatgacagtctttcttgcaatcatccctacttttgggtttgtgatatgcgtaatccaggaggaagttcttttgtggaggtactaccatttgattaactcaatggactccctagttgtatgctgtaactgcttatgcatttttgttgaggaataactgcttatgcttacattttctatctacttctggcttgaaagaaaacaaacaacattttaattctttgtgcagattgactttagttcatacaatgttgatgacgaagactatagtgggtatgactatagtctatcagcgcagctttcagaagttagaattgtttatctcaaccgttttgttcaagaggtatgctgtttagtgctcatctaattttccctcttctgccattgatttaagtgttctcttttctcatacatactctgtgtgcagattatcaattatttcatgggccttgttcctaagagctctgatagtgttgtaaagctaaaagacaatgtaactaactcagagaagtgggttagcaaaactgatatggaaggatcacctgctctcaaattggatgtctctttcagtaggcctataattgttatgcctcgtgaaactaatagttctgagtaaggatgggtctgtggacatgtactgatagtatgcacatatctttatgatattttaaagagccttgctttggtttgcagtttcttggagcttgatgttctatacataaagatccaaaataaattccaatggatcggtggtgacaagaatgagatgagcgctattcatctagaaattttaacggttacggtaagttcattgtgtcaacatgtttatttatttccctgtttggatggggaggttgaggggagagccctactgaaaactttaattgacacctaaaaaaccgtacatggtaaaaaaaagaaaaagaaaaaagaggaacatgggcaacagatggagatagcctagccattgagaaatgacttacaccatataattagtctgatgccattggaatggagatttcagaagctttacatgttgtagcatattccttttcaggtttatgttagtttttgagcttgagaactacatcaaaatgtgtcgatgtgttcattacttgctgttccttgttgggtgataagaacagagcagaaaaataagtgggattctgggaattgtacttccttatgatgattacgctgtattccttatatctgttgagaacatatattttttggacaagaaagtatattgttattttcctgcataattttcagccagtggacatgagagctttgttaattttggaggcattggaatttggaaattaacccaacttgaaacataggagcacttgtggggagaaaataacttatatttcttagtattgttttccttggagaaatggaactttctgccatggaccttcaaattgtttttataactgtggttacatacttacctttgcaggtaaaggacataaatctaactattggtatgaatatggtgtgtggtgaaactataattcaagatgtggaaggtctctccttcgagatccatagatcattacgtgacctgatgcatcagttaccagcggtggaggcttcaattaaggtagatcattttctctaagtgcatttttaatgaaagctccctggttagattcagtacagtaagcaacaatttatcatttgtctttttgtgtcattgggaaatccattttcatgtccaatgtctcttaggtggatgttctgaaagcagcgttatccaatcgagaatatgaaattatatctgaatgtgcattgtcaaacttctccgagacaccacatgttgtgcctgctcttgatgatcctcgatatggaactactacagctgaatctcatgtatcttcatcttcttcatctgaaagtattcaagatttgtctcaagatgcggagacatggataactaataaaatatctgtttcgataaatctggttgagctttctcttcattcaggatcgacaagggactcacctatggctagcatgcaggtaaagtttcaagagtaatatgctttggaatcgcattgatactatatatactaggattctttcatgttaagttgattcaagtagagtatactcttacattgtcatgcaatcttctgtactcaggcaagtggcgcatggcttctgtataaatcaaatacgagggaggagagctttctttttgctactctcaaaggcttttctgtttttgatgaccgtgaaggaacaaaagatgagttaaggcttgccattgggaaatcagcaacagttagagacacatcatctgctgatggctatgataatcctaatgaacttgattcaggtgaacgaagaatacaaaaagatctaggccttgagccaatcccctcaatgctcatttttgatgctatcctgcgaaaatcttcgtcaactgtgtctgtgtgtgttcagcgtcccaagtttcttgtggcacttgatttcttgctagcaattgtcgagttctttgtgccatctgctcgtagtctgttatctaatgatgaagataaggaccttctgcacatgacttctccactggtattcagtgatcaagtttactatcaggagcgttccactatgagtatttcacctcagaaacctctgattgttgataatgagaagttcgactactatatatatgacggaaaaggtggcaaaatatatttgcgggatagggagggaaaaattctgtcaggccctagtgctgaaagattcattcatgtgctctgtggtaaggggttgcaatttcggaatgtcacgatagtggtatgctctacactttcaatatttattgtttgctctccattttcttttacttgacatttctttctaccaacatcaaaattttttttttaaaaaaacagagggagtagtaatttacaatatatttctttggcttgacaacacaatatcttgctgcagaatggtgagtatttggactcgtgtatatctctcggcagtaattgctggtattcagcatcagaaaatgatcatgtctacttagtaagcgaaaatgaaggccttctatctactcacagtgaggaaattactgaagatgttgtaaaaaatattagtgccaatagatcaacagaattcataattgaaatacaggtattgctctgaacatctagctatacctgaggtacttaatcttggccattgtgctgtaggctagaatcagataaacttgattctaagtcagttgtaaaagttgaaacgagagatggagatggctttatgtgtgttctgttttcttgccctgatcagacccttgattttggaactagaataatccctctcgacagttctagttcattactggtttctcctaaaaagaaagttaaatattggttccagatggttactgttgtgaataaggaaatacgcactggattttcatagtgctgaattcagtccggattcctcttttttctttgtgaatgcagtttgtatttggaaacaatatcatggccagttggccaccaccttgctctgttattttaggctacagtttacatgttagacacgagtgcacccatgagtgcagcccctaccacacacctgaatttttgtagattctggggataaatctgttacaactcaattgttggacagtctctctgaggcgcacctcgagtgtgggcacctagctcatttttgcttacgtttaaatgcttaaagttactatttatatttcattgtgcatgcaggttttactttgtgaggaagtcattatttaagccatttgtgcagataaaaaacaagtgacatgttctgaatatcaatctactagtaacatttccacaaaccagctatgtgtatcagcaatagttcaaagactaacttagaactctaatataatcacatctaaatctgcaatgtttttaaaacagttccagctgacaatgaatacttgcctggtggaatctttctgaacacaaccaggataccactaatgttattgttttatcctgcgtgttgtgatttttgaatctgcattgcattattcccatttgttgattgtacgcttgaatattgttatcccaggctattggaccagagcttactttctacagcacatcaagaaattctggtgaaaatttagcactatcaactaaggttattcatgcccgtacagatgcattttgcaggttggctctctattaccctttggataaagtagttctcacagtttctatcttaaaaccactctaaaatattcaacataagaatttttgaagagcagtgatatatgtactaacaattcttacaaacaaatatctcaaccgttgaatctaatccattggtggttatgaaaaagcaagacgcacacataacatgccacatcagtttctgtaagaagtttgtgaggattttttttttgttaccattttccattgtgctattccagaagtatgccaaaaataaatggttttgtactgtaatatcgtgcctgcaaaatttcagtggcataaaatatcggtaatgcatgatttagatgcaatactctttttgtcactgtgcagtacagatgaaatttgatgttgagatcatgttcaaacgcttttcacaaagtaccgatggttggtcctttttaataacataaaatatatctttgtcttgaagtcttgaaatggcaaaaagatatttcataggagaaaaactatgaatattttcgtgcatatattttgttccccatcaattttcttctaacttctaaatgacatatctgaccatacaatgatgtattccagttcatcttatatttgtgtcatgccagaaaaaacacgattttttgtagagggaggtatattcatcttttgtcaatgcattaactaatgtacttgtcttaccgtactatgtatgttaatagcagttcaggtcattgattgttagttgttattcttattcatgtgacaggcttataatgaagggtgacagtatggagatgagtggaaacatactcggtttaaagatggagagtaatggcatcagagttatagaaccgtttgacatgtctgtgaaatattcaaacgcatctgggaagacaaatttgcatctgctggtttctgagatttatatgaatttctccttcagtattctgaggctgtttttagctgttgaggaagaaatttcagcatttctcaggatgtcatctaagaaaatgtcactggtgtgctctcaatttgataaagttgtgactatgcagggtatggtagaagttattttgttgttggatgctcctaatttgtggttactaatttcagatgcctcaagttttaaggagattgattcttttttctaggtggtgcgagcgatcaagtatactctttttggcgaccgcgtgctccatctggatatgccatttttggcgatttcctcacaccaatgtatttggttacttaactatattatctctctccttgttttttatgaaatgtttttaaccttggttatcatattccatgttaggaatgactctcctactaaaggagttcttgctttgaacacaaacattgtaagggtcaaaaggcctttgtcatacaaactagtttggcgatctggacctccacaaacaaatggaggatcaacacagtgagaaagatttgaagaacaagccttctaatgttgaccggttctgctcagtttggttacctgtagcacctgtgggctatgttgcattgggttgtgtttcttcaactggaactgctgaaccacctttatcgtcagttttttgtttgtctgcttccttggtttcttcatgtggcctaagggattgcattccactgaggtattatgaacattacctttgagcttaagtttcttgtgcgactacaaaactctacatccattatatttttcaatttatatttttcagcggtaatgccaatatgtcattctggcgggttgataatgcttttggttcctttttacccggagatccagcacatatgcgtgtagatggaaatgcatatgatcttcgccatatgctgttcaatgatgcggactcttccaagactagctctatagggcaagatagtcacaatgatgcttcgcagatagagagatcagcattgacctcaggtcggctatttgaagcagtagcaagctttaaactaatttggtctaataatggcatgtcttcaccaaagaaactatctatatggcgtccaatgttgtctgaaggaatgttttactttggtgacattgctgttaacgggtaaatattttacagtcaactttctgatcttctggctaaactttctatggtattcaaattaaaatactttttggttgtaggtatgagccaccaaattcagctgttgtacttcgaaattctggcgatgatacctttctcagagctcctgaaggttatcagcttgttggtagaattaagaagcacaggggtactgagggtgtatcgttttggtttcctcaagctccaccaggttttgttgctttaggatgtgttgcatctaaaagttcaccagcgaaagaggacttgcatttcttaagatgtattagaagtgacatggtgaagggaggccaattttcggaggaaagcgtgtgggactcatctggtgctagaacatctgaaagttttagcttatggaccgttgataatgatgttggtacatttcttgttagaagtggatttagaaaacctccaagaagacttgccctgaagcttgctggtccacctacatccagcagttcagatagcataattattgatgctgaaatcaaatcattttctgcagtttcatttgatgattatggaggaatggtaagtcttgtgctactgtactttagcaagttcctcaatttatttgaggtttcagggctatgccatttatgttcggtgttataactattcatcccatgcggattaatttacttatgtttgtgttagccatattaagtttccaaccttttcgttttgcagatggtaccattatttggaatatcatttaatagtgtggggtttagttatcatggtggtcctcaacatctaaatgctactgtgggtttgtcatttgcggcaagatcttataatgacaagtataattcatgggagcccttcattgaaccaactgatggctttcttaggtaacagttccaagaattgaactctacatgatcattatgattcttattggtggcctgcctactttacgatgtctggcggtagtttgtttcagtgccttaagcacaatgttattgaagatacctttttggtgactccctgcatccaaagaaaaaaaatataggtcaaactttcaaaactttgagcatgtgtgttcgaattagacaaatgaaattcatatgtgtagatttgttacaaaagtactttcttcataatattgtaatattgttgggttccataagtatattgtagtagtagaaatcactccctccggttccatgattcttgacgttggattatcaataacttttaaaatatttagtttgaagactatagaacatgatgtatagattagtcttagaaagtactttaataaaattaaatatttacttactttttgcatgtattataatagaaaatcatagtcaaagatatgttttggacaatagttgtaaaagttgtattttgtagagactatcaatgtccaaacattttttttttgtg

SEQ ID NO: 6723 - DNA, 1732 bp, Oryza sativa
  unsure (1)..(1732): unsure at all n locations
cggcggccattgaaagtgangtacacctnnnnnnnnnnnnnnnnnnnnnnnnnnnnnnnnnttaattgtttgagccatttcatctaacaataatgatgatgatgatactggtgatagtgttactgaacctgggtaatttacagattagttttgccttattttgttggtccattagccatatgaaatgcaacattatacattagacataactaaatgaaagactcgttacttttgttgaattgttgttaatttgtaatttgatgttcccttttctggcaatgatcttaggtaccaatatgacatgaacacaccaggttctccagggcaacttcgtattgcctcaacacgagatctgaatatgaacatatcagtttccaatacaaacatgttatcacaagcttatgctagctggaacaatattagccttggcaatgagttatacaggatggtatgccatttatttacgattctgactatatagtcagtgttcaattctgataacctaaaagacttaaacaatattaatctatatttaagcacctcctcattcctgtcatcatttgtctactgaggtactgttctttcattctatgatgaccaggaaacgtcttctactagtgaaaggtcgattcttgatgtgcacgaaagaagaagttattatgttatcccacaaaacaaacttggccaagacatatacattagaaccactgaatataggagttcagatgttacacttctgtcatctggggatgataggtctataaaagttccagcttcaagggatcttctggattctcatttaaaggggagatctgttaggttatatcgcttgatggttactgctattattgccaatgctgaggtactttcttctgcattcgattttgtgtggtttgtgttgaatgaacaagtgttcctttttgttgcatttgcatttgcttgtttcttgataacatgttagcggttgaaattcttttcatctacttggttctcattgaattacatttcgcgtttggcaccttaatagcactctgataattgttctgttatgtctatcaaatgcacaaatgttcatggcattctaaactagaaccaatcccgttatcacttgttggttattactggtccccagcatggtactgtgacctaatggacaaaacattacaattattctggctcattgtcagcaatttggttggtgcacttggttccaggcttcggcaaactttgctgtaacttgtaggtgattctattttgaatgtcgtctccgttgtccaaaaatgcgaaaacaggatgtccacgtgcaaacatacgagaagcttaaaagacccgagtagatacatttcaatctttggaaacactctgttcaaatatatagattccattccttcccataaccatcgaaaaggccatcgagtccatggactttgtgttacaggcatcgataatcagtattgcaggtctagagatgctgacctcttcataacatcatgcgtcctatgatactgtcataggaagattaaaggaaaagtgcccacattaccatgttatcaatgattactcatttttatactatcataaaaaacttgaaggttatttttttctgttcacaattcaaaacctatttgcagcacacgaattccatttggattcagcttcggtaaatatttcacttgctacgaggttgttgaacatcgtctaaggggngcctgagatgagtattctaccacgc

SEQ ID NO: 6724 - DNA, 2321 bp, Oryza sativa
  unsure (1)..(2321): unsure at all n locations
tganaagctgacttggtagatcgtactactaactatacagcgaattcgagctcggtaccccaatttgatagccttaaacatcttaattcaagcaataacagtttgtttgttcacccaaaatgtcccaagtactactgcctgacatcatctgttggctatgtgtgttatgggaggaggcagaagtctgccacaccttgttatgttgttttcgtttttcttgtggagtttactatgtagtaagttaattgcaagatatcattcatcatcatataacatccaagtagaataacagatggatgccgcagctcttcagtatgagaaccagaagctggtgcagcaattggaggcacagaagtccaaaatgcgtgcattggaaggcaagttcaaggagctgagggatgagcaatgttcttacgacaatacattgatttgtttgaataaaatgtggaatcaggttcattcatctgtctttcatactgatgtaaattctattcgatgcatttttttttccagttcaatatgtttctgatgcacttctgtgaattatagctgattgatgatttagtgctgcttggggttcgagctggtggggatttaaacggtttgcaagcgcttgatcatgaagagatgtcagaaggttggctacttggctacttgttttactttgctctctgaggtttgtttttctttcagtactgtcattgactattctttctctattccgcagaatctcttgagtcatgtccttctgaggagatatttctcttcagactcttgaattccaggaatttcagaaataatgatgacagtagcctgtcaaaattagttgaggaagctcttgccttgcgctattcaacaacagttactctgatgaagtccctgcaagaggcttttgctgtacagcaggctagaagtgaatctttatcattagctttaaatggacagaactccagtgaaggtaaagatgaaagcaatatttgtgcccttcttttttttttttggtctaacattgcaactctattatttaatcaaataaatttatttccttcagacgttattgtggcccttgaaaaccataatgattacttgaaagaagtggttgacaatttacgtcaagctgtgtctatcatcaacaggaagcacgaaaagtatctggatgagattgaggctttcaaaaacaatcaatcaagagaactacatgaagtaaagtgtctttcaggtgttaaagaatgccacttcttcccccatttgtgttggtttgtttaaaattttgctgcattgcatttatgttgatctattcacagtttttggctgttgtctcatgtactaaatgtaaatcagttctactaaatttaaaaacaccattttttaaaatagcttgattgcataaaattgtattttggcacataccctgactttgcattttggattggattactcttgcacaccaaaacaacctgtaatgcacattcatatgttgtattttaggtgagctagaggaaagcatggcagagcttgaggaaagccgtcgaaagttggctgttctccagttgcaaacgggtggaggctcactgatgaacacatctgctcctaacggtgtgaacggtagtgtttcaactgataaatcttcagacaagggtatgggctggcgagatctgaaagatgctgttgaggaggctaaggtactgtgataagacattattattattattattttcttttcaagttttcatggatgctttgaaggctgaagagtgttattttctcacttcttatcttattggtgtttttttttctttcttttcctgctaatttctcctatggagatcagactcttgctgcaaaccgcctatttgaactccatgagactcaagaggataatctgatactatccaagcagttggaagatattcaggttcatacctttttaatttttctgatttgagttcgctttcttatttctttttaatttgcgcttctttgctatgtgtgcaggatcaattaaaagatgagaactatattgttacatcaaaaccatatacgattctcagtgaccagttacaccatctgaatgctgagatagagcgatacagggggttagttgaagtgctacaggtatgctgcttttcctcagttgtgctggtttacaatggtattgttgtttgatcaaacccnctgcccccccccctcccttcctctctttctttctctccctccctcttccttctctcttctcttctnttttctcttctccccacttttcctcccttcctccttcttttttccttcctcttctcactntcttatctncttcctccttc

SEQ ID NO: 6725 - DNA, 45213 bp, Oryza sativa
  unsure (1)..(45213): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccccccccgagttagaatgaaaaggaccagctcatgcaaaagaaagaagaaatgcttgcaaagccagaatcagtggacgctgttcaacaatccattaccacttacaaggccaaaattgaggacctggaacatgaaatccagaaacttatggctgaaaagaatgatcttgagatcaaggctgaggaagccttgcaagattcaggtagagtggacctgatcacatttatagcttgctagctggggatggctcatctcttcgtgaagagcgtaacataagtttttcttaattccactgtatagggaaaaaagacttcaaggacgagattcatgttatggctgcatcactctccaaagagatggaattgttggacaatcaaatgaatagatccaaggatgcggcttctgaagcacttgcactacgtgaggaagctgactatttaagaactttgctagctaagaaggtatttctttgatttgggtaaccatatctttctgttttctgtgatggtctccaatctgcatctattacggtggtttggaattttcttaggcttctgtaaattttgttctaccttctaaaaacatcatttatatctcttccttgcaatttcatgcacttgttcagttgccatcgattcattatgttgcattcccccgtttcagctcatgggacatttttccataaattcaccatttaaattcaaggaacaagtgcatttatattcactctgatggtctccacagaactgtccatggctatattcaaaacagtatttttcacactaaaactggcatacatacttgttccatttttctcttcaaggttgatgatcattttacacaatcagaatgaacttaatgctccagggtaccttcttgtcaccaggtgctagcatggtcatgcataaatgattttaggtccctttgaattcatttacttcatgatattgattctgtaaatattcatggcaaaactttgttttttgttttgtttttttttttttggggggggggggggggtatgtgtgtgtgtggatgctcttatgcatagttgtggacttggtgtttaatgttcaaatacattgttttttcagtagtctttacctgattaggcctccatgtgttgcgttcttcttgtgataatagctatctgaacctctaatacaattaaaacatctgattgaagtgtctggagttttcagattgatgaacaaaaggagatatctgatagatacaacacacaagtcaccgagatcaaatccctcaaagcattggtaaagtatcctgatcttcaccttttcttctagggcactgatttgcaacaatcgaatggtcagccaacatataatgatatttaggtttcatcattcagaaatgaaggcagacctctctattaactggtggatagcctgatacatgagagcttataattcttggaattgggtatcctaggtcctaaaactattgttcaaattttagcctaaaattagattagccactttattttagcctacaaactccatattctgcagaaatccatgagttcgagcattcccaaacaggcccttaactgctattactgttaaataattgaaaatttaattgtcattcacagtgtgcataaatctgagcatcatttgtgggtaaaagatgttttggaacaaaaatgcaattaacagggcttctagttctgtcattcatttttctccatataatttcaacagattgagacactggaccaggaaaagcaggagttacaatttatagtggatatgctcggtaaagaatgttctgagtcgaggtataatttgtttgctagtaccttttctgctgatttatgattgttatgggttgtattgttctcaaaagtggtgaaccctcatcatctattcttaaaaattctttatcagtaatacacaaaagactcgtgtataattgcattaagattgggaaacgaaatttcagtacacttggtctagatgcacaaccacatcagacccaaaaagaatacgaaaagaaaaggataaacagacactcacgcaactgaatcatgcgacctattcatttaatatttaagcatgttcaaaaaaacagatatggttctaagatagtataggtaaaaacatatcttgttaggaaattttcagctttcatctatttgacatgcatattacatatggtagatccttccagtttgtttcttaccatactctgttgtgcactagggcaatttcagagattgaagaatcagaaaaccgagctcgcaagcaagctgaatatttgagaaaatgtttagaagagcataatcttgaacttcgagtaaaagcagcaaatgaagcggaaactgcatgccaacaaaggctttcaattgctgaagcagaactggaagacttaagggccaaagtggatgcatcggaaaggttagtattggtgaaaattttgttttctcaacccctccgtgcaaaattgttctccagtttattgggacttgccttttcaaaataattctccattgagggaatttatagtgtagttgtattctctaaccctgctatccataccaagtaccctatttaacaaggggttaatcagactctagaaaccgggggaacttctatacacgaatctggacatagcctctgtccagattatgaacgttgctttttttctgggatgaagggagtaaaaaataatatgtgctggcttgggggctctaaactgtcctggatgaaaattgtagttgaccagctctcaattctagcccccattttccccaccacacaagcgcacaccaactcccaaaacaaaaaagatccctaaacattactttgatcttttgtctcccttgttctgtgagcatagactatgtggacaactatattgaaatgagtagttataatttgatatagctcaacaatcttcaattagtttcctgcattgaatccttttcatcacacgcattctgttttgccagagatgttatgaaactcaaggagtcaataagaattaaagaagctgaagtagatggccatatttctgaaattgaggtaggcgcggttttctcttcttatcagcagtcctttttgtgtgtgaaataaaagcatatgatattgtcattgcagacaattggtcaagcatatgaagacatgcaaacccaaaatcagcaccttcttcaacaggttgctgatagagatgattttaacataaaggtatttagatatccatcaatcttgttgcttgcctttgtagagttcctggtagtctgtagcaccttacacggctagtaggtgcagggatttatagactgttctagattctagaaccaaagctaatctgctcttttttccccaatcacaagttggttcctgtcctaacatggttctcatctaacagctagtatcagatagtgtaaagatgaagcaagcctatggttcccttcttgctgaaaagaatatgctacagaagcaacttcagcatgtcaacagttcactggagtcatctaaactaaaaatcaccagtggtgaagagcaggtagccttttatttatgcctaaagtcgttctttctgcgtaaggcccttggagatattgttaaaacaagtgttgatttacaagaaataaattgaagatgtatcggattacttgcatcttatactattaactgttacagatgaagacctatgtagcacaagctatgaaatcttcttcagagaataggcatcttgcaattagccttgaaaggactatgctggaggtatcagatgcagagaaggagctcaagtggcttcggtccgctactggatctgctgagaaagaatatgagataaatcagaaaaaaatagctgagctaaaaatggagctagagcgtgagaggttaggctgctctgaactccaggattggtcatgctatgctgccatcaccatcatgtgttcattacattttttttggttaattcagaaatgagaggataaagcttgaggaagaatacgaagaggtgaaaaacgaagtcagtgagctaacctcagaaactgaagagactactatacagaagctccaagatgaaataaaagaatgcaaggctattctcaagtgtggggtgtgcttcgaccggccgaaagaggtgatgggccattgggccactgaatcaacttattctggattatgtcgatttgtctctgaacctagatgtagatatctgggatttaattattatttacacccatcacaaattcacgtttctttgttatactcttacatgcgacagccaattctgttaccgccgctgatggcatttctgttcctttctctcttttttcttcttcttcttcttcttcttttttttttggcaggtcgtgatcaccaaatgcttccacttattctgctcgccatgtatccagaggaaccttgagatccgccaccgcaaatgcccaggttgtggcaccccctttggacagagtgacgttcgggaggtgaagatctgaagcgtcagcaaaacagcttgaatgactgacttggtagcgagcatgtaaatatatagtagtagtgctagtttctgttttcttggaggacagatattagatcgaattgtcttggtgtgcctctgccaagactgccatgtagaaactattattattatcacctaaaaatagtgcaattgcggggatctgatactgactgtgtctgttttgcgtgttgtatcattaatttatctgttaattgaggtaccggctaaagttgttttacaatttacccgggaaataatgcattttgagtttatttattgatccatcccaagatatgaaaaaaaacacaaatattagggaaggaactaatatcaaataattagaatgggtgaggttttaaatccaggtcatctagcccaccaccttgtggaagacctctaggtgtttttcatcccaaggtatgaaagaagcgtgtcaaaatgaatctgttcgatagttttggatgggctactgctattgcctgtgtaatttctccttggaggtttgggagagctgtagaagtgggcgcccttggcagcccatccaattcctaacagtgatcaccaaatgtatcctgaaatttctccctgatctgcctctgccaatatactgaagtacaactcagtgcctgcagccagtgctgctgatatttttcccggatcgatcgtcgatcgatcaatcaatacttctaatgctggcggttctgccagctgctgattggtccagatggcacaatcatcctctgatgcgtgttatgcgaagatgaaacttcaagctagcgctgagcatgcttcatgcgtacatgcggctggttgtctgcctccctgctgtcgtgcggcatcatgggccagcgacatgcatgctccatcactgagatcaaatccctcacggcctgttcggttggagggagtttttaagagggattggaagtttagagggatgaggttattaattgttttgtttggttgggagacatgtgaattttggtgggattttttagataatggaatgaaacaattttggtggaattttggtgagatggggatggggaattgaggaaggaactccctccttttcaatacttgggtagaggcaggtaattgggagggaattcatcctttactttgtctaagcaaatctcagccatccgtttttattaatgacctaatctccaactaaactccctatcaatttccatcacctctaccaaacaagatattgggattaaaaatcaaattctcatcttaatctcatcattaattttctcgtgtaaactaccaatccccttccctcgagttaccaaacaagccaagcgattggtaaagtatcctgaccttttccttttcttctaaggtgctgatttgcaacaatcacatggacaaccaacatggaaaacggaaaataggaggtgggagggagcgcatgcgctggaaacagcgagtaattttgctactcttcacgggatgcggaggtgggaacggagggaggctttgaaaaagggaaaaatgggagagggtctcgccgtctcggttgcgcactgtcaaataaattacgatgagaaagccacaaaatttagcttataaacatatataggcatgagcgaaacaatagggctccaggtctcgtagaaggcgagacctatgtgcaaatgggccaaggacagctacgcaaatatatagaccactttctggaaaagaacaattacacaactaatgactatgcaatacatctaactgatctgaacaaactgtaaaagactttgttaagagaaaccctaaacttatgggggtggctactgcgcgcatacgcgccaactaaattgctggcgcgcacgtcagctgccccaccccaggcctcccttatctttttttttctttttgcactttttttttcgattttggtgcctccgggcgtgtttttctttttctttttcgccgtttctttttcgatcttttttcaatctttcgcacacctctttacaaatatataactgaaagtttttaatttttatttgtaagttttcaaatttgagttgaaagtttttaaattttaagttgaaagttttataatttgacttgaaagttttcaaatctgagttgaaagttttaaatttgagttgaaagttttcaaatctgagttgaaagttttaaattcgagttgaaagttttcaaatctaagttaaaaattttaaattcgagttgaaagtttttgaaattccggtcaaaagatttgaatattcgagttaaaagtttttaaaatttaggtcgaaagttttcaaattcaggttgaatttttttaaatttgagatgaaagtttttgaaagtgcatctaggcccctaatgattttggtgattaattacaagcgattagagaggactaacatttttatttaaacaaatgtgaaggttgttatgtcctcaatgagttagcgtaatgcatatcccgccgaatatgttgatgtgatgtgatgtggcaaatgagcaaatggtattttgtacgttttcgtttccttgagttaataggaaagccgcactattaagagggatgatgcattgacatacgaggagtgatcaaagtgctcaaaatctatttttaaaaagtgtttctcctcagtttggtatgttctggattttttcggagttttccgaaactcattttcggactttccgaaaacacacagaaccagattttcgcttctggaaattttcggatatgtccgaaagtgattttcggacttttcgaaaaagactgcgaaggcaaaagtggttctgtatattttcggacttgtccgaaacttttttccgaaaatcatcagtagagtcaatttcgcttctgtatattttcggacttgtccgaaagttattttcggactttttcgagaacatccagaacgatgttgttggtactggaaattttcggacttgtctgaaaagttttcggaatgtccgaaaaatccttcgttgactttgctgttggtgctgagctggaattttcggacatgtccgaaaatctttcggaatatccgaaaatctcaattattgtgcataacgggcagaatatggactgtggctataaatagcccactcccatcacttgtgagggctgctggttccattccaatcatttgtgcccttggcttgctctctctctagcacttttgagccttgttttcttgtttcccctctcacctgtgttcgatttggatttggatttggtgtgtgtgtgagagttgtggattcgagtttgtgggagtgcttgttgttgatttcgtgaagatttgtgagcactttcatcatctccgggagttctttgcttcatttgttactcttggaggttgaggactcctaggcggttaggtgtcgctcccgagccaccgatctacttgtggttggccgggagaagtttgtgaaggtcggatctcacctccgaaagggaagagatacccttagtggaaggaggagtgcttagtgcaacttcttgaggaaagggttagctaagacccggctcttagtgagctcctcaacggagagtatatccctcaaggattcgaacttcgggaacaacctcgtgagcttcatctttggtgactttacttcctccctcttcactagctttgcttgtttgagccgctacaggtctagttactgtttgtgctagcatattcttgttgtaggcaactagatctaggatttactttgctgtttgtgctgacttcgaaaattttcggatatatccgaaaatttcggaaatatccgaaaattactgcttccgcttttaattgaatttttgaattagcctattcaccccccctctaggcctaattgacactttcagttttcaaaatttacaatgaaagttgtagattttcaattcttttgtgctgagaaaaaaagaaatattagcttaatataccataattatcgataactaattacgtataggattttttcttcaagtactgcgcaggaaaaaaaatccgagtcctgcgcacttcgttgcggaaaaaaagaaaaaggaggttgtagctagtgggccgcgcgcgagtatatgggccgaaaacgctcgcgacttagctagccggcgcgtctgcgcgcgataggaatctcgcaaaccttactgtcttcctggtggtgctgaatgttacgctgtttattactccctcaaaccatgaggtagcccggttcctatttacgatgtttattacttcattcatttcaaataataaggcctatatttatattttcatcattaatttatttcatgctatgttcccgacaaatataaaactaacatcacatgaaagtactttaaaacataaatctagcgatataacatgcataatgcatagatatgattatagtatgattattagtcaaaattttaccaaatttgaatttcattaaaaagagggcaccctataatttgaaacggagggagtataaaagtatgtcaagaaaaaaatcgtatagaaaaaatttacacgaaacacgtcattttaaaacttgggaagcgtgcacaatcagaaatgaacgtgcctaaatctccagttcaggcagcagcccaacacataatcggtccagcccagcccaacggacgagcaaagagcaaatctaaattgcctcctccaaccgacttcgaagtccgaacggcagaaaccccaacccgaacccgaaccccctccccatttgcgaaggcgggagcagaggagagagagagagagagagagagagagagagagaagagagagagagagagagagggagagggcagtgcgccgcggaagagacagctggaacccgatcacgcgcgcctacccgtccgtagaatcggcggcggcggcggcgtccgcgctcgtctccggcgccgacgagctcctcgaccacggagaacgcgcggaccgcggccatgtcgaagaagaaggcgcccacgtccatcccgtgcgagctccccctcgccttagaccctagcgtgtaagttgccccaaaccctaacccctatcgcgattctttggtggtgtgcccgtgtgcgattctttggtcccgtggtggcgatgttgtgtaggtcctgagcattctcgttcttgcagctccgcgcgcccatcggatcgtcctgtggcctcccagtcttccgcacgtcccccttttccggcagcctccgccgctgccgctgcgcctgcggctgcgcccgcggttcgttcgctcgtcgccaactcttctggcatggacacccgattcgacgaggacgaacggacaaccgccgccacgcggcgccgccagtcgccctctccttcttttgcaccatcgacgtcgaaggcgacggcggtgggactcactagatacggtgctgtcaagtcctgggggccgaggagggagctggaaactggggagaccagtaggtgcatggaggtgctactgctagagaacccaatcgatgctacaaaaccatctcctctccatgttgatgaagacaagcaggttatatattatttttgctccgatcccatctgtacgtgttgatccaactctaaatggaattatcacgttttccatctatattagctagctactgtagtggacttaatcggatgtttgcaaaagtttctaacagagatcttcatgcaagtgaaataacactattaaggtgctcctaatttgcttcatttgatatgtaatatgtatgaaatgccatggtgaacctttcatattttttccccttttttgaaaactatttgttcttttctctttctggataactgttccatagttggttccaatggttgctaatgctgtgcagggtgaggttattggtggtacccaacagaatgctccagagagctgtgtaacggagcgagcacgactgaatctgaaatctcgctccagtgcagtgggacaatctgctggcagtcctctcaaggaaaggtaggtggtcttgtagcccttttttgtatttcccttttcttttctataagttcatggattttctagttttatcatctgagtcttgctgttagctaccttatatatatattgaccgctatatgtgcagtacacttagcctgtccaagcacattcattaaatgccattaatgtttcattaaattttgaagtttcaagtatccgtcctgtttattgatatatgattgatgtcaaataggtgtatttagaagggaaaatttatctctgatgtttctgttcagtatgtacattcccaaaatgcatgcacatcctgtgcaattaagaatgactcttcattttgtttgactttaccttgttggaagactaaagctactcgcgatattgtcgattcaaggatcatcttttttctttgttgtaatacatgtttacacttcctacctatcagggtcagtttatattgatagccaatgctgatccctttaggttgtattgagtatttatttgtgggaaaccacttccctctggttccactgcacattatatgtgtgatgtgatttgtttattgacatttagatgcaccattagaaataaattgtgcttcttagtggctgcacgaacaatggataaattcatatgtgtaatgagtggctgaaaatgtataagggcatctggatattactatctttaatttggctccataatccccattccttgttttttttaatctttggaagcttggaattttttttgaggatttatactgatgttgaatttgcccgcaaattaatatgctattacatcttatgccttaaagctagaccttatctaactttggttttatctttctacattccacatggtagaattctggctccatcaacagcaatgaaaagagcaacggagaacaaatatttggcgaacttgaagacagatattgttgagaaggcgttgaaatatgatagaaaagagaaaatgaaggaggttatgaggctgatgatattccagaggagggttttgtattagagcctacaggtcacggaaatgggaagcaatttcgtcttccgcactctttgtatgatgtcctccacacttatcagaaagaaggtatcaagtggctatggacattgcatctcaagaaattaggaggtgcactatgtgatgaaatgggcatgggaaagacccggcaggtaaattacatgcaatggtttgttctttaggtgttagaatttcaatggttactctcattgagaagaggatggcactcgagatggggcaattttctggttttcttcattcactaaatacaaaagccatacctacccgagggaggttggatacatatatatagccatagctggctgctagcctattgctgcaccctcctagtctaaaattcgaaatttgaatgggatgctgtcctagagggcatccaaactgaataaagcataaaggaggcataaaggagatgctaactgctgcagtcctactaaccgcagctgtcctagcaactgaaaaatatgctaaagggtagatgctgtcctgaaaaaggtgaaactacccaaaagcaaaaagaagaatcacgaccaaggaccacaaagacttatccaacattctccccctaagtcttgtgcgtcgtcttgtggggaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttagtgaaaaacggggttctttgccagggccagagcggacttgctatccaccctgagctccaccgttctagtgtctctgccgaggagatcactaagcagtcgagcaagccagagcgcctgggtcgaagcggcggaggccgccatgtactcggcctcgcagctggacagggccaccacctgctgcttgaccgactgccagctaacgaggcacttgccgaggaagaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtaacggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccaaatcactcatctagaaagtggccttcatctcctccttgaacgccgcgacctccgcatccttggtgccggtgatcaccaagtcgtcgacgtagacacccactagcaaggcatttcctccattgccccgccggtagatggccgcctcgtgcgggctttgctcgaagcccatccccttgagcgtggaatccaacttggcattccacgccctcggtgcctgccgcaagccgtaaagggccttgtgcaggcgtagcaccttggcctccttgccggggatcacaaatcccggcggctggtgcacgtagacctcctccttcaagtcgcagtttaaaaacgccgacttgacgtccatgtgatggacgccccagccttcccgagcagccagcgcaaggagtcgcacagactccatccgtgccacgggagcgaaggcatcgtcgtagtcgatcccctcctgctgcacgaaaccgcgtgccaccaagcgagccttgtgcttgatgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctacaaaagaccgaggctcaccgtcgtcgcacgcaaggtgcaactgcgcctctaggtcgcgaggcaccagtcccggcaccggctggtcgccgagaagatcctccatcgtacggtaccgtagctgctcgccgtcgtggtacgcgtcgatgcgctccccgtcgtgggagagcggagtagcgaactccaccgggctgcgctcaacacgagctggcgtcggagtagacgtgcttggaggagtggctgttggtgctggagcatgtggagtcactggctggggttgtgtcgacgaagagctcgtcgtagtcgaagtcgtggcccgagggtgtgttggtgtcggagtcggtggagattcgggggctggggtagacacgctaggtgaagaagagctgcctactcccccagctccctcgaagtggacgtactcgacggtgaagtcgtcgtacgtcggagtcgaaccatcgtccaccgccttgtcccatacccaccctcgcccttcgtcgaacacaacgtcgcgcgcagtgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctgcccccagaagatggccggcatccccctctgcttgaggagggcccgagccatccccacaaccgtcgggttgcgccgctcgacgacgccgttctgctgcgggctgtacggcgtggtgtagtggcgctgaatgccctcatcagcgcagtacgacgcgaattcagccgctgtgaattcgccgccgttgtcagtgcgcagcacgcgcagcttgcggccgcactccgcctttgcagcagcctgcgcatgcctgatggcgtccgcagcctctcccttgctgccgaggaccatcacccacatgtagcgggagaggtcgtcgacgagcagcaggaagtaacgtcgtcctcctggtgtggctggtgtcactgggccacacaagtccccgtgcacgagctcgagccgctccttggctcggaagctcgtctgctggggaaaggggagccgccgctgcttcgtcaccacgcagacgtcgcagagctgctccacgtggtcaagacacggcatgcctcgcaccatctccttggcactgagctgcttcagggcctcgaagtggaggtgcccgaagcgctcgtgccactgccacgcctcgtcgtcccgatgagcggcgaggcaaactggttgtgcgacctgcacgttgaggatgtcgagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcagggatgtagtagactccggtgagcagcctgtgctcaccggacttggcggtgaaggtgacggagccaacacccttgatctccacgccggaggcgtccccgaacttgacggagcctcggacgctggagtcgaactcggtgaagaactcccgtcggccggtcatgtgatgggtggcgccggtgtcgaggtaccacccatcagccttgtcgttgctggagccgttgcagagggagacgagtaccttcggctcatcaaggtggaggaaagccgctgcggccggtgccgctggaggtagctcgatgcttgcgtgagccaggagcagagccggctcttcctccacccgtgcgacgtgggcctggccacgtcgtggctgtcgacagtctttggcccaatggccaagcttgccacagttgcggcaggcgtcgtctcgtgccggcttgtggttgccggtggcaacgccctgggcgcctctgcgggcgccaccctcggcacgtcttcgcgcccaccgtagctggacacctccccgcgccttgcgcggcttacggccggctgtcggggaagatgactcccccttcctcccgtcaccctgagaggcctcccactgctcccgagtgagatggagcttcccgccgatggtgatgggccccgagagaggctgtggctcatcaccatcgacgaccttgaggcgacctaacgcctcctcgatcgacatcgtggagaggtccagcagagattcaatcgagcgagcgatctacctgtacttctcagggacgcagcggaagagcttctcgacagctctctcctcatcgtaggtgtcgtcaccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttttgggaaagcgagaactgcatctcgggcgggactgcagcgatgagggcatctagtgcccgccgatcctcgtcgtagtcgacgtcaccgtaccggactgcttcccacatgtgccgcacctggagcctcaccctcatcatcgcggcccactcgatgtagttggttttggtgagggtaggccaccgacgggaccaaagtctctgaccaccgtctggacgccgtggtgaccatggcgccggtcaggggagagagagccgtgctgcctgcaagggccgcgtgcgggctccgggctgccgccggcacgcctgcgcccgtctgggttcccgtcggcgggcgcgcggtcccttgggccgccgccgccgccgtggacgtgggctgctgctcaccgctctgctcgctcccgtgcccttcctcttgccagctcctcaagctccctgtcggcggtgatgtcgccggcgatggagccgttgatgttgctgcgcaaggtctcaacctctacctccgccgcacgtgccgcatcttccgccgcctccgcctccgcctccgccctggctgctgccaactccgctgccgccagtctggctgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgcgtggagagggggaagggaaaggggaaggaggagcaaccggtgctgttgctgctgctggctaagagctcaaccgagcttgggagggggtggaacaagagatgtttagtctacaggaaagtatggctctgataccagatgttagaatttcaatggttactctcattgagaagaggatggcactcgagatggggcaattttctggttttcttcattcactaaacacaaaagccatacctacccgagggaggttggatacatatatatagccatagctggctgctagcctattgctgcaccctcctagtctaaaattcgaaatttgaatgggatgctgtcctagagggcatccaaactgaataaagcataaaggaggcataaaggagatgctaactgctgctgtcctactaaccgcagctgtcctagcaactgaaaaatatgctaaagggtagatgctgtcctgaaaaaggtgaaactatccaaaagcaaaaagaagaatcacgaccaaggaccacaaagacttatccaacattaggcaccacacgccccaaaattagctatataaatgcattttattttgtttatgttccaggtagctgcttttcttcgtggtttgctccaggcagatgtcatacacaacgcaatgatcatttgcccagtcacggtgatagaaacctggcgcaaagaacttaatattgttggtgtgctggttatcaaagtgtaagtttacatgatataactatttatctagttgtttcagtaatgatatctagttattttgtcagttttaatggatttgttttctcttgcaggttccgttatgatagaagaaccgactgcattgcactaaaaagcatagctactgttagcctgcactctactttaatgtttttgcattattctttttatccattaaacttgcttgttattttttcttttgattggattgaattcaatctgtcatgttaccacttatgccatttatttgatggacaatgtttatctattgaatttaatttattgaaaacaatcacattaaaactgtgattatagtcgatatctgtcagagttaccgattctattttttggtaggttgccttccattaatttttactgtcatcccatacagcctttgcttaactactttctatgagttagaagaaatgctacagctgataatataaaatgagatagatgcaacaccaaagtttccttacttgagattcaagacttgaccacactatcttaccttttgtgtttgtgtttgtggttttgggaatggggtgggggtggggtctggaatggttaaacctcactattgctcaactcataagcccgtgattatttttagaagaccagtacccattttattaatgcatcataaaagatggaatactgcttctaccctcgcttttatgcaagtagtcttgaaagatccctaacacagagaatcacattacttgctgatttgctatcctgaatcttggtatggtggttgctataggtattcagatgaaatattttgactcaatatccatctcctgtgcaggatggaggtgtccttataacaacatttgaagcagtccgggaccatattcaccgcattctggagacggggcacggcttgggattatattgttatcgatgaagcgcacaggatgaagaacgacaggacaaagctctttgattctttatgtagaattgattgtacacacagaattttgatgactgggacgctcatccaaaacaacttgacggtacaccctctccaaccacaatagtcataaagaaatttggttgtttatttttgtttacttatttgtaacggaacctacctgcaggaattttatgcgctgatgaacttctgttgtcctaatctacttggagagtccggacaatttcatgaaaacttcagcatgccaattgaaagggctagatatagaggcgcatctgcgcaattgataaaagagtcaatagaagcatctgaggtaaataccttctgttctacatacaggcaaaataatttctatttttctggttggtacaaatatcctgaacaagcttgatttgtattctgcagaggctgaagaaacttgttagcccttttgtattgagaaggacgaaagagatgttaaagaatagcgcctctaaacttggtactaaacatgaattgactgtgtggttgaagatctctgctgctcaagtaaacttactaaagcttatcaatatgttatcaaaatttattcgtcatctttaacttctttttttttcttactctccacaggaatatctttacaccaatcttatcatgagcaatgttttgggagatgagcctggcacacctttggcagcttctcaagtaatctcccctacaatctgaagtctattttttgtcaactctaccttttgatgtacggatctttcacctttgtttttgtctaatcacaggttgcgaggagtatctgcaatcacccagtaatggtgattggttctgactttgaacagaggggtgaatcagaagagaagaaggatgctttaactgacattatccgaaaaggtttattggcggtcagtaacatcgaggatattgaagtcgacgactacagtttgtccagcaaagtagcttttactttatatttggtggataggctcatcaaggaagatataagatcttgttattttctcaatctccacgaacattgacgatgatagaggtagtttctaacaatagttgcataactctctttttgccgggtcagccaaaggttggccaaccaatttcttaagattggggagaaaaacaaaggaatgttacagcgacattacaatgtcgcgctagtccgggagagatcccagacacagcgtgaacaagcgaaagagaaatagacaatacaacaacgattactcgccgaattgggagaagatcccagctaccctccataccgtgatttcttcttttatattctcggctacttgctccgtggtcatcgacacatgctgaaaaattctagcatttcgttccttccaaataagccagcaaattaacatgaaggcactgtcgaagtccactttgtagctcgtccgaaaacggcgtcgcgttgcaagccaccagtcagcaagtctgctgtcaccgtctgcctggattgcaaagtttgcatcgcaccatcttctgatctttcgccatacctccgccgtaaaaggacaggttacaaacaagtggtggcaatcctcgtcttctctctcacacagtgagcagagggggtcgtgcggccaatttcgcttcgcaagattgtcggcggtgagacatcgatccttcaacgcaagccacatgaagaaacgcacacgcgagggggccctggatcgccacagtagctcgccataggagcagtcctcagcagctatgaagaaaacatcataagccgacgccgccgagaatttcccgtcgcccgtcagcttccatctgatctcgtcaggcgatgggagcagggagaaatcgtggacctcatcccataactgaaaaaattcgcccattgcttcattggacagtgcaccctgcagaccacggacccatctgttgttgcacaaggctttagcaactgaaagtctagcacgccccacataagaaaatagcgttggccatcgccaagcaaagcagccgtgcccagtccagtttgctgtccaaaaatcagtgttttcgccatttccgacaatgtacttcaccactgatctgaacatgagattcacatcgttccctagcttaaaggcagccaaggtccagggcctctccctctgctccagcgacctcgcaggccattgcaaccggagagcctgaccaaagaaattcagatccttcacacctaggccgcctttttcaaccggggagcacacctttcgccacgagaccagacaatgtcctccacttacctcctcctgacccttccaaaggaagccccgacattttctttcaatatccttgattgcccactttggcaattgtaaaaccgacaagtagtgaaccgggagggccatgagcaccgacttgatcaagcaaagtctgccatcaatggataacatctttggtttccatcctgctacaatagttgcataactctcatttgtccatgtctctattatgttcttttatttatcatacttaatcatttttaattgtgaaaattgtagagagcattgtccaccatagtagatccaagcaaaatgattcgcatggatgggaaaacacctcagaaacagcgaccaatgttaatccaggtttttattgtcttctgtattacccattctgtttactccatctcttatttattgtagggagtatgtgttcttccttctttatctcagttataatttttgtatacaggagtttcaacaaactaacagatggtcactttttctgatcacaacaaatgttggaggtgtcggaattactttaactaaagcaactcgggtcattgtttttgatccagccaagaatccaaggttttttttactctttgtctctttggtaaaattgtttctacttatatgtaaagttggatcattttatttcagcaatgacactcaagtgttgatcgagcccatcgccttgggcaagataaagatgtcattgtgtatagattagtcacatgtggaacgattgaagaacacacctaccgacaacaggtattaattgcttcctgcaggcagcaataattacaggtattgcatttttaatcgatcaaatttgccatctgcaggtgattaaaggtgagaaggcaacagctgtaacgaaggaaaatcagagcaggcgggaaataacaaagccggtatgcatagacttagttcttattgctgctgtagttatctgcaggactttattgatgccagttttttcttactaacagacaaggagggtcctgagtatgcctcctgaaggttttggagtctccaaaactttgattgagcttctagctatacatggaggtgcttttgatccgtaaggattcttcttttacaaactcattactagttttaagataagataaatcatctactttttctgggtatattagtgagcttgtattccttccttttgttcattgtgtaggtcacttgatgaatctgaaatcaggcaagtcagaggacatgaatctgttgttggtgtatcaaaccatttgcatctgttttcccagagggaatctgaccctgtcacaaatgaaaaacacaagttagtttttctatttgttaatttgcatgaatttttcctgtgcattggttccctaggttattatggttcctctagttatctgcagtctgctgattgatgtttttgcaactctcaatagtcttttcctttttttttggcagatatacagctggcccaagtcgcaagcgcagcgaactatctatggttgttttttgaactatattatgcagatactttactgtttctctctacctgatcttaatattaactatataatatttcagccagtagatgcagaaattctgaagtcaataaggagcacatttatcgaaattcctatacaacaggtatattcatatatcgtaatttttcttgtaatgcctaaaatccaaactatttctgattaccctctaaaaaagtaggttggttgtttcgttggtgaaaaaggaggaaacattatgaaactagaaaatatttccggtgcaaagatacaccgccttggtgtagattcttatacacacatgcagctttataagatatctggcaccccgcatcaaataagcaaggcggaaaatcttgtaaaggaattcctacaagaggttaattaatttgcttcttttttttctgtattcttagtgtttgttaatatgcatggtgtactaataaaaacaaaatctttttagatggattctatggttgaggaggagatctccgttcctatggagaaggtggggctgctgaaaaatactaagtccaaaactaaattagtttctaatgtaaaatcttgtaggttggtttggtcatcgggagtggtggtgcaactattaaaaaatacaaagtatatctggagcatctgttaaggtggttttaaatgaataaatacccttttcatctgtctatttaataattagattggtaacttgtttcttttttaatcttggtagaatttacatccaaggagtgagtcaggcactacaggaaggtttgttatccggggttctcaaaaccaggtagaccaagcaagatcaatgataaaagatgttgcatctaaaggtttgttgataccgatacaagtagttaatttattgatttaacatgctcctatcatcttgtgtctcccccctaacttgtgtgtggataatgtgtctcagagaacctcgggccaaaaacaaggttccgatgatgattctttccccaccaaagatggatgcactaaaagtagatccacaagaatgatggcattgagagatccggggttactttggtgaatgtcatagcaaagcatttcggttgaggaagtcggccacatttgtgctgtataatataggttcaccaattttaacagtgaaaacctttgtcctattgctacgactgacatggaaatttcttagtattgtgaaacagtggaagtcgcttatttcctaataagccaaaacggcttattaggaaataaaaatgaatttgtgggtaaaacttttataaatgtattctttgtgacctaaaagccaatgttgaaaaagaaactatattgaaaatatgtcaaaatcaatcttaaaattaagcttgaaaatttaaaatctggctttttctttgacttattaggccatccgatggggctggaaggccttttactctgatttacatgtttgccttggtgatgtggccttttactctagatactgcaggaatgttcttaggcagatactgcggtaatgttcttgtaaagcagctgttttgaagcacttgatagaccatttctgacataaattttgaagagttcagactcaagagtactcgggggtatgaagaagattcttttgttgtagatggaaccagcgggagccgggaggtacagtagcgcagcacaaatttccagtttgctctgtgatggtttattaccaaaagatagtgaaattccccttgctctcttttatcttagtattgtgatggctatagatttaagggttcaggcaaatttccggctagcgtgaggaggaggcgatgagacgcggtcgtatcggcctcgtcaaatggcagtgtactagttgatttcaagggtacataggtaatttcacatgctggaacagatcttggctccgtgggctaggccacgcccactgtgggctgagtagccccatgtgtgtcttcaaacagaaatggacccgattttaggccacatggcattgtgtagcttatggtttttgaagttttttagtctatttggcaccccaaactgaacggattgagtgatacattgctcttgctcttactcccctctccgaatgtgggtttagattgtcagtccgcctaagcgcttgtgctgagcaggcgattgtagaagagccagcttctttctctcacatccgatttttccttccacgtcagatccagatgacatgtaccggctaatcaccgacttattagcgctgctctaagagcaagattaatagagagagcttatcatcggatccaaagcaatccagctcagccttacccttagagcaaatttatattgtttaatagtatagagtctaataatatagctgggtcattagctccaaaatatcaaaatattctatgtcagctgtagatgaacatggtgttagctacataacacaatcctctattttttttaatctaactggttataaatatgttgttgtggaatctgtggattaggcagcacaggcatacatgcatagcccacggtaatcggctcaagcccagcgcaagtttatctgtttcctcagcaacattgttgtcccgtgcataaagtaacaagctcttcattgcaatgcgatggcttggtcatctagctggattctggatggttcagctcacggagaggcacgggagtggaagcctggaacttcgctggtaagtagagccgcacaaagcaggcggaagattgcagggccctgcacctttttttttaacgactaagttcagcgggaaaaaattacaagattacaaccctgtagggtcgtaaccagaaaaaaggaaaagaaaaataccatcacccacacatcgacatcgtcaacacaagcccaggagaagactaacaccggaccggccgccgctaaacgtgaccgaccgccactagatcaacaaagggacacagacgagatcgccccctagaggatacaaaaacgacgtcttgaaaaagagaagcgacagaaaaaccgccgccaccgtccgtcgggactcaatggagccaagactaggctttcgcccggcaatcacccttgaggggtgagacaacacgacaacgccctcaggagggggaatgaaccatcgttgtcggtccggccaaggccggactgggttttcacccgccgctcaccacctgcaaatccatggctgaagcactgatgctccaccaccatacaagctctgccgacatgtgagacccctgcaccgacgtcctccgccggccagccttcatgtgccgaaaaccgcgccacactcaccggcagctcctccccacacctaggtcgccttctccaccgccggccgcgcctctcgcgccaagtcggcctcctccaccggacgagcctctcgcgccaatccggcctccctccatcgggcgcgcctctcgcgccaagctggtctccatctccgccgcccgcgcctctcgcgccgagccggcctcccctgccatcggctacgcctctctgcgccaagctggtctccgacccctctaccaaacgatgccacgctggccagatgcagccatctcccacgccctcggctagccatccgaagccgccatgcctctggtgaccgcagacacggtcaccaccaccgcagccgctgctgctgaacgcccagccacctcacctcgcacccgactccttccccgccaccgacgtcgccaccggcttcacacgcgccctcggccgacgccatccccgccgccttcaaccaccaccgcccggcacagcgcaccgcgacggccgccacctcagccacagccaccgccagccgcctcagacgccgccgtcctcgccacataggagccaacctccccgtttcctccacgcagccgcaccccgccgcctcaccaccgctgcaaaaagtgctgctgtgtgctgagtctgggcagggaaggtgggtctggccatctcgccccccaaacccctgcgccaccgtcaccgatcgcctccgcctctgccggctgaggttgccggcagcaagccatcgcctccttcggcccgtcgagccgccaccgcgcccgagggcaaccgaaccgtcgccgagctgccgccgatgctcccagccgcctcatgccgccatcgcgcccggggtgctcccaccgctgcgcgcaggctgccgcaccatcgctgagccgccgccgtggtgtccgggctgttccgctacctctgcaccgccgccgaagctcccagccagctgctccggccgaatctaggcatgggagggccaaatccggcctcagaggagccagatccgccgcctccccaagccgccacgccgtctcctcccctggctgcgacggagtacttcgtcggcttcccccgtcctcgtcgcaccgaggtggagaccgtcgagttgttgggtcttggcgagctccagcggcgacgagatggagaaggtggagtggcggtgcgggcggctaggattttcgcctcccgagccgcccgcgcgagagctacgcgggagttgcaattgattttcgcacagggccctgcacctgggacaattaatgctagctatgatgggagtttatcatttcggttcacgtcctttatcataacaaaactatgattatactattatagacactaatatagtaatatcttctataccaacgattataatggtaatagcagagtatcctcaccttttgtcattatgatcctggatgagttggaggctcgcgcccatcaggtaccagaacaatctggcagggacaaaatcaaggttagcccttgtagaatctagtaaagcaaattctacagacagggaactggattgatgtaacccaataccagctgaagctctagtttacatatgctaccgtgtcgttgattgttgtcctaggaatttaaataatggcatgagtgctaatatatctactcctagcaaacgtaatatagttgggaggtttgtgaggtcgtctagtgtttaagtggcaaaagaatatgatccattgggtcaattagctctctagcaaatcaacacatgatgccttcttaccgctgtattacaattaatggagaattcttcgatgcagctaaagatttggtagtatcagttcctaaaatgaagagcaggcccctaattttgagataacagtacaatcctacttttctttttgtgctatagaaatctctcacaaaaaataagatccttattactacatagtagaactaagcatcagaaattcactacgtcaagaccacattcttcccaatctctataagtgaatggtggattttgaaatgtcacctaattgatccgcgtaagctaaaaaagttggaccatcggataaaggaagccattggattgtatcagtgaaaaagggtaaaactgatcttctggagctttccagctcctccggtcctccccacacaagtgggagagagtgcaaagaaaataaaaaaaaattgcaaagggaacacaggaataaaattatcttttgaagcaaacccacatcgctcttgacactggcagtcatggtgttcaaaacaaattgcagaaaggcttgagggataaaattgtaatcatcctacttttgctataatatgaaaaaagaaatagtaaaattgatgagggatgttaggcctcgatcttccaataggtattgataaacaatcgatttgggcggagtcgcgacacaactcaatccggcttctgaacgaacacgctactgagccccgcaatcgcaacaccacgtctcctctggttatcaatcgtgccgaaacctggttgacctcgccgagaaggctaatacctgcatgcgtatcgaagaacacaagcaagaacaagatagattgcaaccaaattgcatatgaatgattaagcactcgaatttggggttctacaaaccgatctagcggcgaaactgttcttgacagactaatctaagcaaaacccgactctaaatgatgacggctactgattaagtatgattagggacgtcctagggttgccctagggcgcacatccccttgggctaagcccacgacacaattataaggcccaaaacataaatcagatttggactggataaggtacgtgttttgttttgtagattcccggcagctcggtaggaattttgacatggaaccaaaaccatatgaaagtagactccataagctttccaacaactactcatgggcttcgaaattccttctagatcagcagctaggtccatttgaaattgatgctgtcaggagatctgaatccaatatgtgtggaactttatctcttgtcttctatggaccaaaagtgacatggtgaggtagaagtagacttggagaaggtcttggtttggtccccaatcaatttctttaatcatccatgcatttattacgctcggtctcttttctttcgcttctttcgcccaagcaagtacctttacaaacgaaaacgcacgaaacttattatgtagcaacggttgttcaaatatataacaagtaaatcttatatagaacatatacgcctttagttgattaatacataaggtagtcatatttatatccgagctagtcgtgtcctcataaaaatggtattccgttgtactttttattcattccctacgattaaattaacaataggtaataacacttactaaaaatatgcatggcaaaatatgtcaattttagaacgatttcataattatacgtagagctattgacttaatttaaaaattaaaaatttataagcatattatttcaaagcaggtgcaccaatgaaaagtaaggacaagataaggggatcatacaacaatggagacggtgaaaagcaaggactcatacaccatagaagatggcgttaataataatactaaaatcatgtaaatttagtttaacatctgaatgtaaagtttgcaataaatgtttattgcacataaaaataaatctatacttattttaactagactcctggatattttttttgtctaaaacattaaaataaatctaagacaaataatataaactagctggtggcccgcgcaattgcgtggctagcacccatataaaattatatatttttccatatggttttacttaaaatttattaaatagttatattgatgtcttaagattttgaaagaccaaaccttatcatcccatgtttctaattttatacttttcaaaagtcacaccagttgctacccctacttctgacatattattctttattagcttgtttgatctactactgtttctaatcattctccttggaacctttaaaaattggatctttttagagtttatcgtcctgttaatcttcttttttataatttttagaagtcccatcaaacgtttccattatactcctctacaaccgtccactgcataccttatcatcctcgtgtttctaattttatagtttttaaaagtcacaccggttgctaccccttgcttctgttatattattctttattagcttgctcgatctaccactgtttctattcattctccttggaacgtttcaaaattggatctaaaaacttatagtttttagagtttattgtcaagttaggcttcttttttataactctagaagtcccatcaaacgctaccattatactcctctagaaccgtccactgcatcttctctttattgttattgctatttgaaaaatcgaacataattatcgtttaggtttatttttttactttcttgaagttccgccaaaacgtcagagactttgtcactgtactcctctacagctcgcccgctgccgcccttctttattgtcattgagattttaaaatcaaacatgattatcattgaggtttatttttttttactttttagaagcccgaacctttaaaaattgaatcttatagttttagagtttattgtctcgttgggtttctttttttatataatttttagaaatcccgtcaaacgctaccactatactcctctacgacccgtccgccacatactctttattatcactgggattataaaaatctaacataactaccgttggaattcatttttactttctagaagacccaccaaccatcggcggctctgccattgtattcctatacgaccttcccgctgcctctcttttttattgtaattgagattttaaaaatcaaatatgattatcattggggtttatttttttacttcctaaaagtctcgccaatcgccttgaccgatttgctacacgacctgccccgtcgtcattccttttaatcgtcattaggattgtatttggtgttttattaatactttttagatgtctcatcaaccgccaccactttgctcctctataggcctgttacttaaataatctcgtcatgtgttttagatggtcttttctttcagtagtcttattttttttatcaccaattgtagttatttataaattgtattcctagttgaaatcttatttttctctttctaatttcagaattaattttatttttcttattgtgttcttttgatatttgtattttttttgttttcaatttcagttgtttcaaaattgtattcctactctaactctcttttcaatttgtctaatttctgattttattttattttatttttttattccgcattttaattaatctactattgggttcttatatgtactcttatttaaatattgcttatatttaatttcaaatttaagttaattttaaattgtattcctacctgaactcttcttttcttttcttttttctaattttgattttttattctgaattttaattaatcttgtattggattcttttatggactattctttcaatattccttatttttaattccgaatttcagttatttttaagtgtattcatactcgaactcttccttttccttttcctattttcaaaatttattttatttttattctgaaatttaattaatcatgtattgggttcctatatggactcgtctttcaatattgcatatttttaattccgaatttcagctatttttagattgtatttctacttgtactcttttttttctttttctccgattaatgtgggaatttctagcctccacaacgaacatggtgcatccttttaaggctgttttaataatataatagatagatatagagggggttaccatgacttaataactaaggttatgtgtcacgtgtcaaaatttctatatttttttaacttgaatcataataggtggggttttatgaaattatgtttgaaaaaatgatgtatgccaaatataattcatatattttgatatacatagcaaatagtaggatggttagagtcgtacaaatgcgcgactatatacactagttctaaaccgaaatgaaacaacatcttgctcaagtggaacggcaacaccatgatttactcatcaatctcttccaaattcaccaatttctcattcgtactcccttcgtttcatataataaattgttttgacttttttttccttgtcaaaactttttaactttgatcaagtttatagatagcaataattttagcacaaaacaaacatactatgaaatatatttaatgttatatttaattaaactaatttggttttatagatgttgctaaattttctataaacttataatatgaaaagagtcaaaacgacttataatataaaaatgagtacataacaactaacgccaaaacgatcaagtcaaagtgtttgtggctgctcaacccaaaaaattctacaccctccatcctaaaataagtttatttgtagggttatgtgtctagtgtttgaccgtccatcttacttaaaaaattattatgattaatattttattattattagatgataaaacatgaataatattttatgtgagacttattttttttatcttttcataaatttttcaaacgtcggatacaaataaagttattttgggacaaagggtgtacctagaagtgtcatggattaatttacagcgaagacgagttgtaccaactacactccctaagagcatctccaacagcctctctaattgactctccaagttaaattttagcaattatatccaaaaaaaacatgctccaacagcctctccaactcactgctatttggctggccaaaccatcctcctcactggctacatttggccattctacttggctggtcaatggtgggccccacacatcccatctcctccaccccctcccccctctctctctctctcgcagtctcgcatccgtctttttcccacccaatctcgacggcgagctcgagcacggcgcgaggaggcacgggaaggagcactgctacgatgcggtgacgacagtgccagccgcgacaatggcgcccgtagccccaggcgatggtggacaacggcgacgacaacgaagagaccgccatccgtgcgcgcatcctctcccatgcgagcggcggcggtgccgcagccgccggcctacgcctgccgcttccgctcgccgcttcccggctcagctcgcctcagcccgcggcctcaactcgccacagtccccgcctccgcttgccgcagtcgtcggtctccgcttgcctcaacccgtgacccgcctccgcctcagcccgccgcctccgctcgccaccacctgtcgcctccgctcagcccgccagctctgcgtcgcctccgcttgctgcagtccgccgcctcgccgccaccgctatctgcagctcgttgcttcgcacgctcgtggcccgccgtccgccgtcgccgcatcggaggagaggttgtgggaagaaggctgtagactgtagtccaggaggaggaagggagatgtgagtgggaaaatggggtggaagaggaagaagaagggtagcagagactaacatgtgggtcctatttgtaatagactagtaatagactagtaatggagagggtagacagagaggctcttggagcgagtaacgactttgacttgctaaatcaaatggatagctggctatatagatgtttggagagtctattttagagagactgttggagatgctctaacaacccaaagatgaggtcccgcatcttgtggatgagccacgctgagcgcttcttcatgtggctcggcggcttctgttgctctgagctcctcaaggtttgacacgagtgatcacccacccaattcagtaacaagcaaagaatctgaagctaccattgactgctattgttgaatgatgatgatgatgttgtttgtgcaggtacttgagagccatcttgagccgctgacgaatcagcagttgatgggcatctgcaacctgcagcagtcgtcgcagcaggccgaggacgcgctgtcacaggggatggaggctctgcagcagacgctaggagacacactggcatcggcggccgccaccgtggtcgtcggcggtgtaggcgccgacaacgtcaccaactacatgggacagatggccatcgccatggccatgctcaccacgctggagaacttcctcaagcttcggtcaaacatcaatggcgaactaaattgcttattaccatggcgtgatgcgatgatatttttgtgtaggctgatctgctgaggcagcagatgcatcggatcctaaccacgaggcaggcggcgcgggcgctgctcgtcatcaacgactacttctcgtggctccgagcgctaagctcgctgtggctggcgcggccgagggacgcgcgtcacggcatggcagagcgcgcatcgcaccgaccgcgcccccggcggcacggccaggtacgcgccgcagccactgcatcccgctgtcggcgaccacctccccacccaccggccggcctgcccaagaggagaaaagtgagagagagagagaaagagagagaggaggaagggagaggaggggaaagagatagggtgatgacgtggaatcctggcatgtggggcccacatgggttccacgctgattcagccgtcacgtcagacaaaaccgcggtcaaaaccaccgagggacctaaagtgaacggttttgtaagttgagagatatcatatatctggttttgcggttgtgggacgattttgtaactcgatgacaagttgagggaccttgggtgtactttttcctttgaaagttgggacaaattgagggacctatagtgaacttaaccccccccccctaccttttcttttcatgtgcttgacgggccgcgaatgtcgcgtttgacatgtgggcctgtgggggcaaaccttagggtgtgtttggataatggaaaatgtggagtggaattgggattgagaaatgaatgaagggttagaattaaatggaaaagggagaatgaatgattaagatttaaagatgtcttttagtggatgggaaatgatttcccattagccaaacaggaccaaaataaataaaaatcacccccgtggcatgtgcccccgcaacacagaattccccaattccccttctcccatcccaggaggagccgccggaaccctcaccgtccccccaagatccaaccaatctaccggtagacccggtgttgtgccgtgatggatccattaggcggtcgccgccgccgtactgctgcatctgagagtggaggaggatggatgaagggttgtaccagtgtgagggcgagagatgtaagtcacctccgatcccttcaaaacccaccattttttttcttgtcttggcttattttgtggcaacacatcaggccagccagacacataatttaccaccagatctgaatcgctcccgcggttgtaatgtataggatgtatgtatgtatgcatgttcatctgtttgtttggttttccctttcactagattcattctttcttagcacaaagcacccccccaaaaaaactctcttttcgttgtccttgtggatttctcagaattcggcgcagctgactccgattcgtttttggtgttagagagacaccgattcggactatgttatgttaccttttgtgaataaatatagtactagtgtatatgtgcaccgcaatctcagagttaagcatcatacatagtctttgtttgtgtgtttgctgcatgtacgacgacaccatggacgtgaagacgaggagcaggaataggaagaggaagaggactgtagtaccacctgcagcagctacttttcctgatctgctgccggaggagattgtggtggagattctggctcggctgcccgtcaaatccctgctacgcttcaagtccgtctgcagagggtggcgtgcaatcatctccgagccatccttcatccgaacgcaactccagtgctcggcttctaaacaggagccatccatcctcatcagcccccacaccctccttgggcgttgcgatattcaacccccagttggaggactaggtgattggcccaacaacttctccacccaaatcagcttctaccaatggcagcgaggtgcctccattgccaggttcatggatgccacggccttccctgccaacgagttccacctcgtctgccacttcgcccactgcgatggcctagtgctcgcccccacagacaccaacctctacctcttcaacccggccacgagggacaccatcactctccctgacggccatggtgataaccaccaccatggcacggaaatggaagcttgctacgctgcagggctaggcctagatcctgtcacacgcaagtacaaggtggttcgagcattctaccgttcaatggaccccatccgcatggggatggaggtgttcaccgtcggtgaaacgggcgcaggctgtggctggagggagaccgtcactgatcctccctaccctgtcagtagatggctcactgccttcactgtcaatggtggctacttgttctggtacatggatcggtttcgctaccctaatgacactctccatggtggcctcctttggtttagcctgcaagaccaagcgttccgcgtcactcttcttcctcattcactggaccctgccctagatgacaaggtcaggccggacgtgctacacggcgaattgtgcgtccttcatgccaacagtgacaccatgcctgtgacgatttggacgacaaattcgccgtcttttgatgattgggagcggcgatactgcatctatgtctcgagactttgccatccaatgggccttcttggtgatggcgggatgttgctgtgggcaaaacacaccatccaccgctacgacctgtggagcgatgagctgacggccgtgtgcgagctgggtggcatcaggtatcagggtggtaggccaccaaggtggaagaatctcttcaacttcagcgtaatgccatacaccgagagtcttgttagaatcactgctgctgcttaaggcatccggaatccggatcctataggcttgtacttaatgtatatctcactctatttatcacctaaatacagtgcaattgccaggatctgatactgacagtgactgttttgcgtgttgtattattaatttatctgtttactactgaggtactggctaaagttattttgcaatttgcccgggaaattaatacattttgagtttatttattgatccatcccaagatatgaaataagcgtgccaaaatgatctgttcgatagttttggatgggctgctgctattgcctgtgtaattttttccttggcagcacacccgattcctagcagtgatcaccaaatgtatcctgaaaattctccctgatctgcctctgtcaatatactggagtataactcagtgcctgcagccagtgctgctgatatttttcccggatcgatcgatcgatcgatcaatccatcaatacttctaatgctggcggttctaccagctgccgattggtaaagtatccctcagcattggtaaagtatcctgatcttctccttttcttctaaggtgctgatttgcaacaatcagatttcatcagtcataaatgaaggcagacctgtctattaactggtagatagcttgattatacatgatttagagctgtatgggagagttcaagctcctaattcttggaattgggtatccctaggtcccaaaattgttgttcaggtatcagggtggtaggcccaccaagttggaagaatctcttcaacttcaacgtaatttcccctacagtgagagtctggtcagaattactgcgcgctgcttaaggcttttacgccatgagaagcaacttgtatttgatgtatatcaacctattaattttatcactaaaaatagtgcaaatgatcgaagagatctggtactgagtactgactgtgagtctgtgaatgtttgcatgttgtattattaatgtttttaagggctcctttaaatcactggaatgaaaaaatggaggaataggaaaaacattggattctgatagaaatgtaagtgtaaaatagatgattgtaaaaacacaggaaaaacataggaatgaccgtttgattggatcacaacaaaaacataggaatttgaggtgagataaaaacttgaaggattctttccataaggctctacttcatgttaaattttccttcaaaactcgcatgggaagaggcatttcatagaaatttcataggattcatttctttgagctatatagaaaaaaattctataggaataaaattctctaaaatttctatgaaattatgaatttcctttgaatccgaggggcctagatctattaactgaggtgcctttatgtattgatccatccaaagatatcacgagaagtgtgacaaaatgatctgttagatagttttggatgggctgcgctgatgcctatgtaatttctccttgggctcgcttgggccaggctttgggagagctttggcagcccacccaattcctaacaatgatcactaaatgaatccagatggttctgaatttttttttccctgatctgcctctgccacatgcaactcagtgtctgcagccagtgctgctgatattttcccacatactactgtatagtgctgatgtttcttggccattttaacagcatcaccatttcgcttatacttattacaagcgaaatggcttattagtgttattagtgatttaaaaacgaatactgaaaaagaaaccacaatgaaaaaaaccgaaaaccaactctaaaattaagttttgaatttaaatataagctgaaggctaaacgatgaagctataacactagtaagatgatgagtatggcttgcatcgacggaatggtatggaagcttcactttttcttatcagaaagtggcaaagaggcagcagacagaatcgatccatggcaaaggcagagtcactgagagtccttccaaagctgccacttgagaattgccaatgcattgctcctcctcttttcttttccttttcatcatcttcttcttccttaaccaaaagagccccttcctgcctgcctgcctagctatgtggctagaaggaacaaatcctaaagatcagagagaatcagtgacacgtttcgactttcagctccaagcctaatcatcatggccatcgtctctccctgcagattgctacttgtttgtgtgtgagagaagcaaagaacagagtgagtggtgttccttttttttttcttatttcttgtttatgaccatggaaggaaagaaagatacctttgattttgtttctcttggatcacttctctttttctttctttttgtctgtcgagcgatagatacatactggctttgagcctgcaggtcagtgccaaaaaaatgttgtgttgggagggtatatttgacgtgaggctttattcgattccaaccttagctagcttctctttctcctcccatcatttgctacagaaactgtatttgcatctggttattcatgtcgttttcatcgcataactttttatatataaaaaaattcactgacttggcattgttcagtgttgagaggtatatagtatctttggtcgatctgctgcctttgccgaatcagttgttcagtactcgagtcggtgcgtgccttgtcttctcttcctctttgcacagttgcagatgcagagagctgatgggcctacatatgtccaaatttaaacctagaattaagtttttttagatggagggagtatgcgtctagctatagtttcatgggggaaagagcagcagaagcagcatgaatgcacggttgaaaacttgaaataatctgtttcctttccctggtaaacgtatgcatggtttcactccaatcggggcatcaaactataataactgacttgtcaacggcatgcgtgtacgcgtgatctaaggaacgtatccggaggagttcatttgaggcgaaaaatacccacccagagagagagagagagagagagagagtttacttcctagcccacccagagcatttggtcactgatacagtaaggccttgtttactttccttttttttttcctaaaaacatcgcatcgaatctttgtacatatgtatagagcattaaatatagacaaaaagaaaaaactaattgcctagtttgcatggaaatcgtgatacgaatctttcgaacctaattatttcatgattagctataagtgctacagtaacccacatgtactaatgataggttaattaggcttaataaatttgtctcgcggtttccaggtgagttataaaattagttttgttattcgtgtccgtaaactccttccaatatccgatcaaatattccatgtgataccccaaaattttcttttcagtaactaatcaggcctaagcttcgcatagtaatcctagtactctctccgtttacttccgcacgagtcaccgttgactccaccaagtagaataaactgtagagtactgtataaacttttgaatagtacttattccatactatattacggttctactatatatggatttttatccctcgatgggatatctgttgacgaccaaattttcgcgtcaacaatatcccttcgttgtttgtatgtcatctaaatagttatcaacaaaaattgacaatatagattaatatgaaatatattactccacaaacatgcaagaccaaatttaacttctacaagtagcaacaaaaatactaaattaaaaagtatttatcgtacattcgcatctatatttgttatttttgttataacttgtagaagttgaatttgatatatttcatattattctatcttgccaatttttttataactatttaggtggcatgcacgaaacaagggatatctccttgagggataaaatcacttcccataccgttgagctattatgagatggaaggagtaaatcattttagtattatcgtaagccaaacttttataattctaatcaagtctttagaaaaacacatcaacaagatttagactatcagaattaaatcaaacattgatgtcttcatagtgtatttatttgttagtacaaataaaggtgtatattttataaacttggtcgaagtttgacttgagataaaactgaaaataacttacaatatagaacaatgggagtattcagctttgatattatgtggtatttgcaattcattaacaagtcgcttttgaaatgtcggattctttttaaatttctgttagaaataagatgaatcttatgccttcttgaatgctaagctactttatacaaggaaaaaaaaaagcaaaggggaaacaacttgaataaaagacattttattttatttttatatatgtgcgtgcttacatatagtatgtggaattgtaaagctgatggaactgagaatcaaatcaaacctgatatcgatatgtctcaaagttacttgttattattacctgcttttacatttgtaaatcctcatttactttaaaccgaacaaatatataatcctaagaacagaatctagaaaagcatacaggattacctgcatactcacgtcatgctgatcgtagctgacccaactgcaatgctagtttctgcagagataatacggtgcaaactgaaccaaaggaactgaagaagaagatcgggagtttttttcagaccaacaagttcttttttttcccgagaaatttcagatcaacaaattgagagacatactactacaggagggagagatagatagggcttgttcagtctattaacaaaattaaccttactaaaatttgataatatcaagatattattgatttatagcctcgtcaaattttggttggagtgacattgataagaatactgacattggtaatagcaaaatattatgtttagtttattactctatcaccattttgataaccccggaaatccatgcactaccaaatcatccaatgaggagtctcacacagccagcaagcagaagtgagatgtggcatcatgcagattccaatttgaagattagtggcctgattagacactagattagcagcagttgtgatgaatgggaagcatcaagtggcgacatggttgcaggtggtggcaggagacatgcacgtgagggctcccccatcattggagagtacttgcagatagaccctgtgagagtgtgagacccattcatccattcaccaacaaatcgatgcagtgccacttgtagatggagtacctagctatagtcacaaatggagtactgatcaggttattatgttgctcagctactcataaactaactagggagtaccaaggtgtacgttttttatcagttctagtgaaaccgttagggatcggtttgtaaaaatcgaacaaatttagataatttccacacaaaagttgtcagtgttttgctcggttttcagtaaacaaacatgatcgttttcagaaaacggtaaggtaaaccatgaggagcactaccttgcttgctcttcatgtgtacgttgctagcaagcaaacatgatgtatgtaccctaccctcatcatgaatgaaaccacgcccccactatatatatgaaggtatcagtgaaattcagaatggatgcaaagccttactgtcttatagcatcacactttgccgcagtttactatgtgtgaaaaatgctaggttaatttgtagtatagtatttgattcaattctcgtacgagctaaaggctcatgcattgcaacggatattatcgaatattataagagataaaaacaaaaaatacaagtttatagcatagttagtttattaggcatataatactatatatttaaggaatgttacatctaaagcaaaagcattgacgtctggagaccttatagccccaaatatcagcttgttgtgtttaaagacaggctcgaataccatcactaacataatttaaagtagtatagatttgatttgcacagtagttttgtaccgtcccttatctaagttgcggcactactcgtgctgccgtgcagtattggtgggcccgtggtagtcagtaggacgaggtccaagaaacccgccacaagcccaccgctgcagctcagctcagtacaccacagtacaagtagggtcactcacaaggctgcatgtatctaaatatttgacaccgttaacttttttaaatatgtttaaccattcatcttatttaaaaacttttgtaaaatatgtaaaactatacgtatacataaaaatatattaaaaaatgaatcaaatgataggaaaaaattattaattaataatgaattaaacttttataaaatatgtaaaactatatgtatacatcttgaccttgacacatatgcaaattaaattgggattttatctaaattttcttttcatagaaggagtaatattaatagtgtgtatttgcttttcaaacggaaaaaagaatcatacgttttccctcacttttgttggctttgaaagataagaatgcatacaaggcaggcagcatggacagcctaatatatgattggctgttggcccatgtatttctagacacgttcatgtagtagctgcatgcacttcgtttgtttatagatcttgatatatacaatccacgagcaacttggtatatacatcgatgtctttgtgttccattagaagtgtacgtccaattcaaaatttaagaaaaccatgggtcaatttttaaattaatccctacatctgcaatttttagttccatttgtgggaagatcaactcattgaccggataggccttcatttctacgaaatggcagctctccatgcatgagagcagatttaattgacttttgcttgtaaggtttttgtcgtgctacagtgctgctctctctttttttccctttaattcctagaataggagctctactaattcttcaaaaataattaataagaaattacaaacagcgtgtaaaagtctaaaggcataatatcgtgagctacaaattaacatttacgccacgtggacaacccaatacaacataccacacgccaagtatataaaactcaagaaaaacacgacactctaccaaactatcgcaccctcacgctctacatccaactcaccatttacaattgtcgctttatatcgctcacctcatgaagctagctctaacttcaccaacgaaggcattgtcacgtgtaccatctattgtacatcatcgcgacggtagcgccaatttcctcgtgatacttctaaaaatatcgggaggctttttaactctcaagatgttccaaatatctcatgttattggtatgaaacttacttttccttaattatcctttctttggtatgattaattacagcataaattaggccatgttgatatattcctttcttaagaacattagcactaccaataaacttcccaatcctttagctataatttatatccaaagtttaaataattcaaaagaagataagggaaagcaaagaattcaacggagacaaaccctcttgagcccccccaaatcccaaattgcgaaaatctagtacactcaaatcacaacactagccaagccagcacaccactactctactggatcgagtacagtacacagtatgatgattttttttgtgattatagaaattaaatgttaaatagtgaaattaggagaggaagaatccaagagcaattaggatgcgagtgcagaagcgtccctttcccggacaatttcccggcagaagtataaatcacaagccgccatggccgccctcgcttcctgccaaaatccttacttataagccacagacaagtgccgtagctaagctagctcacctttctcctcaccggcaagatcgcaagaacgcaacaagagaggaggagattgatgtcgtcttcggctgtgattccgccgccgtcgccggagaggagggtgccgatggtggctgtgccggtggtggccgacgatggaggcggagggcatggggcgaaaggggaggagagtgtgagcgggagcgtcgcgggcatttcgccgagcatcctcatcatcgccgtcatcgtcgtggtgatgctcctcgcctccgtctccatccactacttcatccgccacctgtgccgccgctcgtcggcgtcggcggccgcgtcgtcctccgcgccggtgctccccgtcgtggtgcgccccgcgtcgtcggcggccgtgggggagcaggtggtggggaaggcgtcggcggagcgcgcggcggagatggagcggctcatctcgcggctgccgctgttcacgctggcgtcgtcgctggcggcgctccccaagtcgtcgcgcgactgcgccgtgtgccagagcgcgttccgcgacgacgacgagctccgcctcctcccggcgtgccgccacgcgttccactcccgctgcgtcgacccgtggctccgcgccaacccctcctgccgtcccaaaaaaaaggcaacctagaaggggatgtgacccctcctagtataacgaatctgaaaggagggagtacgatgccttttttggtttttgttccagtcatctgaacgctcatgggggatcctctagaatcggcttcgagctgcagcatagttctcatngaccag

SEQ ID NO: 6726 - DNA, 3948 bp, Oryza sativa
  unsure (1)..(3948): unsure at all n locations
acggctttgagatccgattcactattgccgaactcgagctcggtacccactccgagtacctcgtcgaggaggagctcgaggtcgtcatcaagcaacccgccgccgccgctgcgccaagaaccggcgagccaagccagcatccgctgccggcggcgcaggcggagcgtgggcagccgtcgtcggtgaccccgacggcgtcgttcagctcggcgaggtcgcaggagcggtggagcaacaggtggagcagcagatggagcagccggtggagcagcgggcggtggagcagccggtacgacgccggcacggtgacggcggccgccacggcggagtggtggtgggacatggacggcggcgcggcgcccgccgcgcggcggcgcgaggtggaggagcagggcaacgcgttccacggcttcatgcgctggctcacaggggcatactagtaatttaccactcgatcaatgcccagttcactcgctcgtcaacctcgccggcgccggcgatcgccggagaattgaattcaactgaatttgaaatgaattatgaatttctgatgcggctcggctctgcttttgggcattcgtgattaggagtaattaatagtgtctccttttctcttttttttggctgtgaattcttgtattattttttttcttgagtgcgtggatttcgagggtggaggatgcatatggtgggaaggtttttgatgccgtacggatttgaaaactgcttcttcctccgaattggagaatgtcggcgggaagattgaggaattcggggactttgaggcaaatgaactgaactgcccaataaaaaaacagaattatttccagcttgatcgtataggctatagaaccatgctgcattttgtttggatattgcaaatttgggagcgagactgtgtgccagaatgcatatatatattccctctgtacttaaaaaaaaggaatcaatttttgaggatgaagctagtacttgatgttgattctttttgtgattgaaattagcaaaatgaaaattactgttgcatttgtacatatatatattcaggttatacttatgcttctgaacgtgccaaagcacatttcacttattttaactgattcaggttttatgctgcagcatatgatcagtactagggctttgtttctttttgtattgttcatggggagtgtagtatcttctctatctaatcatagcatgggtgtgtgtagtactagagtacaacagctgaactttgaggcatggtggtgtcaggtaggcatgcaggcaagagcagcatggatttgttcttcttcgtccgtccaacacaaggtgatcgatgatgatcatcgagtagagtagagaatgcagtgcagagtgcagtgcacatggggatgagggttaggataggagattcctggtccttgagattacgcacaacactacaaacctcctctcctctcctactacagtctacagtgctagtagtactgctacttggaaaaggactcgcctgtcccattatttccattgccatttgggacagatggctactagtacttggttcactatcagtgtcaccattagctgctatggttagctttaatttgtctgcttaattaactgatttgctaagtgtctactccctatgtcccaaaatatcgacttggcactactaatactaggttttgctgaagaatattttgggacgaagggagtagctatctgaacgagtagcgtattgttttgaccatggccatatatctcattttgaccttaaattattattagataattatgttataattgaaagtcgtctaggtacatattttgatcgaataggtattttataaactttccttaaaaagttaagtgatcatcaaagcttaaacttgaatagtgttcatataaattatataccccagtgggtagctattaagcagcttgacctagcaagctgcatgcttgcctttaggtagggatgagctgatattgatcagactcgaaagagagctcggcaggaggacattgatgcgtatgtcgcttttgtggttggcaatgccattgccattgccatgccatgcaccggatggaaagccttttcattgttgcccttagctttgctgtgtaaatgtatgtgatgagctacaggactacatgctgctgctgcttctgcaggaagcagcaggacttcacctttgcatttctccatgcatgttaacacactcaactactgaatatttgattgttagaaaagtgaagagagaaaaaatgcactatactgagtttcttattatatatgccttgttctttttgttcgttcagttgagggatgtttttcgttttattttaatagctgaatcgcaccgttttctgagaaattcacgtataaaaagttttttttaaaaaaaacaatcacgtcatttaaatgcctggaagcatgctgctgaatgaaatggttgcattcccatttagattataaaataacacgtccattaatttgggtactatagctatcactactgaatcactgattcactgatcgatatatatatattttctatccatccatccatcgagagagaggccggtcgatcggtcagtagctagctagcttcttgttgttgttagctcgagctgggggagacaaggaaaagcaaaaggccctctgcttctggattctgcatgcattgcaatttcctttcctttcaaccttcttttcctttctctctactcccaaaaaaaaaagacaaacactagttttccgtgccaacgtttgactgtccgtattatatgaattttttttataattagtattttcattgttgttagatgataaaatatgattaatattttatgcgtgacttatctttttaattttttttataattttttcaaaaaagacggacggtcaagcgttggacacggaaaccaggtttgtctttttttaggacggagggagtacgtacgtacagctgctgctgctggtactcacagtctcttttcagccttgtgctgtgaatctgtgatgatctgtgttgctgttcaccagccgatggggagtcaaaaaattcagaagaaaaaggggaggcatttgccatcgattgaccgacacaacacacagccaagccagctgatgctgctctatctatagctctgcatatatgcaaatgtcgtcctagctatagtacagtagtgcaggcatgtgtacatgttcttttgcatgccatgagctgatcaagataaactgttgtatgtacgttgccagcagctatagctcaactgctcaagtgtggactgaatcagtgagtgtaaaaagatggagatatatgatttattttttttactgtgcctcgcatgcgagagatgcttggtgctgggggagcacaacagatctggatttttcacattttggtccttttgaaaaacttatttcgcaagtagatccctagaaaaacttatcccaaaaatggtcctttttggggcgccagagtggctgccgccgtcccaccgccgacgtggcggggcgatgctgaggtggctagggggactttttattgataactcnagctgggggagactaggaaaagcagaaggccctctgcttctgaacatggatgcgttgtaattgtctttaatcccaaccatgttctacttcctgtctactcccaaaaaaaaaaaagcagcgctccttctacgtgccaacgttggactgtcccgtgtctgtgaatttctattataaatcagatttgcattgcggcagatgacaacatactaccaatattgtatgcgtgccttatatttttaaatgtctttataaccttttcaaaaaagacgggcggatatacggtttgaccctgcaaaccaggttatgttctctttttctgaccgatgggggtgcgtatgaacagggtgctgctgggtgaactaacaggttccttcttagccctgttcatcaagtttaggatg

SEQ ID NO: 6727 - DNA, 2322 bp, Oryza sativa
  unsure (1)..(2322): unsure at all n locations
cgagagaaagacagatagttttcaacctcaaaaaggagaagtgataggtgttaacagtgtgtgaggttttttgttagaaggatagggatcctgtggactagagatagacgggagtagaaaaaatctcgtgggaggggngtatccccccccccccccccgaaattttttatttttgttttatttgtttgatatttttttcacgcttagggacacacacaagaaccaaccatagaaaaattgaactcaaatggacgtaatatgtgacatgtagaatttttcctctcctctcctctctccgaactagtgcagaggagagagatgtgcaacttttttatttttattttattttttttgatatttttttcacacttaggaactcacaggaaccaaccacgtaaaaaataaaatcaaacggatgaaatatgtggcatgtgaaattttccaaagctcaaccgaaaaacttctctcctcgaaaacacaatcttgcaagcggaatttggaggttttaatatttccgaacccggcaaagcgggggagaatcggatgtaactttttctgtagatgtccgtgcatatattatttgcctgattccgagtccgtatgagaaagttacgcctattttaatagatggcatattttgtccgtttcggtagagttttggaaaattctacatgtcacatattttgtccgtttgagtttattttttatacggttggttcctatgttctcctaagtgtgaaaaaaatatcaaaaaaatgaaataaaaataaaaaaaattgcatctctatgtactgtttaacttatatatgtcattttatgtggttatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagttaagtggtagttcgagtttaaattttttttgtggttggttgtatcgtgatcctgagtgtgaaaaaacatccaaaaaaataaaataaaaatgacaccgttgcaactccatacagagaaacaggaatggaggcggcggcgccagccatgctggtgccctcctccctggggcggcgccagcatggctggcgccctcctcctgccacgtcggttcacgtgcgccacggtagcaggaggacggcgctagagaggctggcgccgtcccgttggatgacggcgccagccactctggcgccccaaaaaggaccatttctggaataagttttttcaggggtctatttgcgaaataagttttttaaaaggatcaaaaatgtgaaaaatccagcacatcagatcaggtgcacttggggctagctagctatagagcaaatacctacatatataggaaaaaaaactttcatcttttgtcggaagtgaccataagaagaagaataaaaatggcaaatccggtacgtgtttgtttttaaataatatgagcttttattaaactcaaacaattatatctaaggagatacaactatgcaatgagatccatccgtatgacgcatcctacgtgcagaagcaaatacagtatgcactggcaccgaccatagtgacttcatttgtaagtgtgatggatttctcttcgaactttatggtttatgagaggtatcaagagctaccaaattcttctaagtaaaacactaccaaattctacagtaaaaatacaatacctccctctatctcatcaaagattgaaacatcactatttcattactactcgtaagctaggctcaaaagcctcaaaccaatccatataagtagcactggtagagaaaccatctttgatcggtcgaccaaattccacaatagtcccggttgcaataaaaaccgggactaaagatcatttttagtcccggttcaaagaagttggtgggtagagtcaggcttcaattatctttagtcccggttggntttgcccccgggtcttttgtggtttttggtcggccggtctttggtggtttctctacctgtgcctcttatatggattggtctgaggctattgagccttgcttacgagtagtattgaaaatgtgatgtcaccctccttgatgagatcgcgggaggtttcgattttttcagttgattttggtagtgtttaacctcgatgatttgtgagctcatgatacctcctctaaaccttaatgttcgaaggggaatggtgttccctcttgtgtcgccctgctgtcttgcatgcctgcgttatccatagtgtctcctcaccggctgttcaaaatatcatttcccca

SEQ ID NO: 6728 - DNA, 3624 bp, Oryza sativa
  unsure (1)..(3624): unsure at all n locations
gtgggaattccgtaagaacagnaccttccnnccngcntgaggtcgactctagaggatccccggtataaacaaccaagactaaaaatagatctttagtcctggttgtttataccaaccgggaccaaaataaactgccgagcgcgcgctgaatttatctcctcggtatcccctccccttttttctctccttcattaaaaaacgccgagactaagcctcggtatccaccagtccgcctcctccccttcctccctgtcggtgacatgggaccgggagtatcatgactagaggcttgggcagctgcggtcacccacgtggcctgaccccctcggggggtcgggcccgagggagacgtgcccaccccctcctctgtctccccgaggggtcgggccgctcctgtttcggccccgagggctggggcgccccgaccccctgtggtattggcgccacgtgtgtgggttaggtgggcacagcggcgctcaccaaaccacatttattgcggaatggacaagcgcgccacgccgcatttaatgcagcacggcgcacgcatatccggtccgtgaccggtcgcagtgtgtgaccggtcacagaccggtcagatcgcgggttaggtggcagcaggcggcctgtcacacgcctcgccccgtcccgtcgaaatgatgagagcctcttggcactcgtccctagctggagccggcgtggtaactcctggagttagcacgtcagtcccggctcgattcatgccaggcttcatcgcaaccattgcaaggaagtcactgtatgaagaagggcagatgtgcggcatgctaaactgacgcgtggtggagaagaatgaccggtctgtgactggactgacgccggtcacgtcatcggcagacaaccgtgctcccacgttgcatctgcttccggcggagtggaggtaggtatgacccatcccatcggagggtcattcagacagcggccattgcagatctcctcccattaatgaagaaatgacagggtgatcccctgtgtccgacgagtgacggcgctgggcatcactcaaggacaagcggtgatttagcttccaggcggaggcgcgagtcaagatttggtcaagatagggtgggtccccacccaaaagaagagtatgtagaagaagtgcatgtggtatccccttgagatataaaaggaggaccttgcccacttaaaagagagggggagattgagagagaaaaggaacgagaagagaaggaaaaagaggggttatagagcttgaactctcttgctctccatttgctctgtaactccttcacacacagatccaccagaacacaggagtatggtattacgcttctcagcggcccgaacctgtatacatcgcctgtgtcttgtgcatttgctctctcgtgaacattccacagatcgagggtgaagaacctcactcagcgcccccggccgaaccggcaaaggggggcctgccctgtctcccggtgaggagccccacgctccgtcactcccccttcccctttttttcgatcccccatccatgcctcctccttctccttcccctctttgctgcggttgcgcggcggcgacggaacgagccggccgcgcggcaggcggtcgtacggtggaggatggcggtgaccatgcggcaaccggtccggcggcggtggaactaggcggccggtggggccacgccccgtggccggtggggccactggtggtggccggcgacagcggcaacccgtgtttttttatctgtgattcacttagatgtattttgtatggataattttgtgattcattgcacatttgtatggatctgtgatatatttgatatgtttataatttttataggatttgggatgttactttgatttggggatttggggtttgatttgggatatatattccactcgattcgggagaaaaaaaagaaaaaaaaagaaaaggggaccatctcgctgccgctaccgtctttttagtcaccaaccgggactaaagatctcctctctttaccggttggtaacaccaaccgggactaaagatagcgatctttagtcccggtcagcggggttacgaaccgggactaaaaagcacttctccacaagtgtaggtggagtacgtattggcggatgtacagtactactaggaactgctataaaaaatgatatggacgatgtacttgccaacatgctctcctcattccaaaataaaccgacctaatactacgaattcatacatatagatgtttggctgtactacgaattcggacagagatttgtttgtccttattgagtacgactacgagtgtcaccaataacatatggttaggaaaataaataaataaataataataataataataataataataataataatagaagaagaagaagaagaagaagaagaagaagaagaagaagaagaagaagaagaagaagaagaagaagaagaagaagaagaagaagaagttgttgggcgagtgatcgcgaagacaaaagtcatgcaaaacgcccatggatggatgtaccgtccggacggcgtttgagttcccgcgcccacacacgcgttcgtcgccacgatctttttactttgtacgtagtacacgcatatatatgcatcgtcagttcgtcacccgttacatcactcgcgtgtgctcaggactactacgtactccctccattaaaaaaaaaacaaaccctgatttccgtgtctaacgtttgaccgtccatcttatttaaaaaaattatgaaaaaaattaaaaagataagccacgcataaagtattaatcatgttttatcatctaacaacaatggaaatactaattataaaaaaatttcatataagatgaacagttaaacgttggcatggcaacctatagtttgccttttgtttttgaaacagagggagtacttactaagcatcatgtgcactcatgcgaaatttccctattgacctaattagagaaatcacctaaatatgtactccttccatttcaaaatataaacattcatataaaaagtttgaactattaaatcgttgcacgctctcatcgcctagtttagaacccaccgtttcagtttcttttctccgccattcatctcctccctccccctgtttttattcatcttcgagtgtgagcatgcatgtgctgtagctcctacctttgctcatcatcaccatccgttatttttttaaaaaaaaaaattaaagatgccacatctgtttgaaacaatttagggcccccccaacaatttaaccaagtgaaaattaatgcttttttcgtcctgtgatccctagtgaaacaatttacccaagtgaaaaaaaatgcgcaacactttcctctatcataacacctgacgttttacaccgaatcgaaggcgtgatacgtcaattaagagatgtgcccatgatgcatggataaaaatcctagctagcttcgtactataagaggacgccacgtcatctgttaaaccagcgtgtttatatatatatatatatatatatatatatatatatatatatatatatatatatgaaagtcgaatttcttccaacataattaactgcattgatctcggtagctacggggtaccgagctcgaattcgccgtatagtcaatcgtatctccaccccacg

SEQ ID NO: 6729 - DNA, 12685 bp, Oryza sativa
  unsure (1)..(12685): unsure at all n locations
gggctggaatgaaaactatggaannnnctganatgaagaaaccttnnnnnnnnnnnnnnnnnnnnnnnnnnnnnnnnnnnnntttaaccaagtgaaaattaatgcttttttcgtcctgtgatccctagtgaaacaatttaaccaagtgaaaaaaaatgcgcaacactttcctctatcataacacctgacgttttacaccgaatcgaaggcgtgatacgtcaattaagagatgtgcccatgatgcatggataaaaatcctagctagcttcgtactataagaggacgccacgtcatctgttaaactagcgtgtttatatatatatatatatatatatatatatatatatatatatatatatatatatatatatatatatatatatatatatatatatatatatatatatatatgaaagtcgatttttttccacaataattaactgcattgatctcggtagctacgccacccacagaatttaaagagcctaaggagcatgggtcatatattctgccgaacgtcgttcttgctaaggttgtatgtcttttttcaacctactcaagtccaaaccgttggggccctttaaaggttctaaccatggagcacgaaggtcccaaaaacgcatagtttcccctccaaaaataacctctcccgttggggaacgcattagatatttacctaaacctgtgggtccttgggcagatcccacattagctccaagacgctgatctctaactagaaaagtaaatgcttgagcttgaaaagcttctggcccagtaggtccataaaactcactcggataagctgtattattaaaccagacaaaacaacaagcgataaaaccaaagacagataaagcgcctaaactataagacaagtaagcttctccagaccatacaaatgcacggcgagcccatgcgaagggtttggttaagatatgccaaattccaccaaatacacaaatgaaacccaaccatacatgtcccccaattatatcttctaaatcatccacactaacaatccaaccctctcccccaaaaggggattttagtaaataaccaaatataacaccggggctaagggtcaaattggtaatttttcttacatctcctccccaggagcctaggtatcatatataccgccaaaataaagagctttgagtactagaagaaaagcacctatacctaacaaaattaggtgaatacccaaaattgtagtcattttatttctatctttccacacataaccaaagaatggaaaagattcttcaagagtctccggtcccagaagcgcgtgataaatgccaccgaagcctaagactgcggaggaaattagatgaagtactccagatacaaagtacggaaaagtatctagaaattctcccccgggccctactccccaacctagagtagctaagtgcggaagtaaaatcaacccttgttcatacatgggtttttctggtacgaaatgggccacttcaaataggttcattgctccggcccagaatacgattaatcctgcatgggctacgtgagctccaagtagtttacccgacaaattgataagtctggcattcccggcccaccaagcaaaaccggtggtttcttggtcacgaccagctaaaacaaaagttccattaaagagcgtttccacgtggtagaacctcctcagggaatataagattttcatgaggctgatcctgagctgccatccacgcacgaataccctcgtttaaaagaatatttttggtgaagaaagtctcaaattcaggatcttccgctgcacggatttcctgggaaacgaagtcataggcacgtaggttcagagccaggccgactacgccaatagcactcatccataaaccggtgaccggtacaaatagcataaagaaatgtaaccaacgtttattggaaaaagcaacaccaaagatttgggaccaaaagcgattagcggtgaccattgaataagtttcttcagcttgagttgggttaaaagcgcggaaggtatttgcaccatcaccgtcctcaaatagagtgttttccacggttgccccatgaatagcgcatagcagagccgcacctaatactccggcaactcccatcatatgaaatgggttcaacgtccaattatgaaatccttggaagaagaggatgaatcgaaatatcgctgctacgccaaaactcggcgcaaagaaccaaccggattgccccagtggataaatcaggaatacggaaacaaaaacaacgattgggccagagaatgaaattgcattataaggccgcaattgaacagaccgagcaagttcaaattgacgtaacatgaaacctattagtgcaaaagccccatagagagcaacaaaagtccacagaccacctaattgacaccaacgagtaaaatccccttgtgcttccgggccccatagtagcaacaaagagtgtgctaaactattggcaggggtggaaactgccgcggttaagaaattgcaaccttccaaataggaactcgccaatccatgggtataccaagaagttacaaaagttgtccctgtaaaccaacctcctaaagcgaaataagcacaaggaaaaagcaataggccagaccatcctacaaaaacaaaacggtcccttcgtaaccagtcgtccataatatcaaacaaatcattttcttctttagtaactctaccaagggctatagtcatagtgatcctcctattcaattacttcaaccatttccgagcaccttatatcacttccaaggcatacgatagattatctgtggacgattttttctcgttcaatgccttttttcaatggtctcgaagatagaaattttgcatttttatctatggggtcacagccgaggtcgtggtaaatccatgaatttgattcaattagtttttcttatactatagaaataaacattggaattcaggattattccatgattcctatttccaagaaagcctattttttaagggaaaaatgaaaaaaagtaacctctcttttcccactcgctctctattgcatgggtataagaacaaaaataggattctgaaaaaaagtaaagatattgaaaagaaaaattgactttcgaaatccatttttatgtgtagcggaaaggggttgcgatttcttcttattcctatagaacatctagtaacaagaatatgaaatagtaaatagcgagaaattcttgccttgcgtggtctaagtctaaggaaatacaaaaaaatccacttatacaatttcatctacatcgaatttatatatcagaatagcggatagaggcctcattcaaggagtcaggtccacttactttatctttctttccaattttatggggtgggttggtttgataagacccctttttgctttgttgataaataataaaaaaagagtttttttctataacctgcttgttttattataacaagtcctatatggaaatgcctgctgaagagaaaatctatctgattgtcttttagccaatatccaattttagaattagaaagaaaaaagaagaattttcttcttttttttattaacattaagaaaaaagaatataactaaaatggaattggcaatataatttttttgaacttttgaaagaaaaaggaaggattttttgcaatcgttatttcttgcctctgtcatatcacggaaacctttcgatttggaacggggagagatggctgagtggactaaagcggcggattgctaatccgttgtacaatttttttgtaccgagggttcgaatccctctctttccgccccctcggatcgtttgggactttcgaattggaaggaattctgacccccggattttctcgtagataaatgtatgaaacaaatccaatttgtaagaaaaaattttggatttttactcgtcacgcccaggattacgtcctggatcattagataagaatccaaagataaagagggaaacaaagaatatcactactgtataaacaaaaagtttgagagtaagcattacataatctccaagattttttttaaggaatagattacccgtttttccttaccacacaaatccactaggatgggttttgtttattttgacacctaaaaatgcaaaaatcaatttttgaaaaaaattgcaagaattgatttataataagcactcttatcaataaattaggttaggtattgtgcggttacctaaagatacctgctcaacgtagatgcagggagtagaaagactgatccaaatttattgctgcagctatacattcaatgtagaagaatttgaattttagaatcgaaggttcataatataagacttctcggctcttatccatatttcgaatttttttagaatgaatacatgattcaatttggcagacagagtagtaaagatttcatcgaaaacttacagcagcttgccaaacaaaggctaatagaaaaaagagtacaggtatgacaggcataaaatccacgattgggttgaaaatggcataagcttcgggcaatttggcgaagaaaaaactagtcggataaataatagaattaaaacaaatacaggttaaactaagtatattaggcataacaagcgtttcgttcttgtagagtagataattggattttgattgagttatttttctaagggaaaaaggaaaaggaggattcaaaatccttttttcttcggactttcccaaacacaaaatacctccttgtattcgcactctcaaatgagagtggaagaaattcgactttcatatatatatatatatatatatatatatataatgtggcaatcgatcgatctcatcatttgttagatgcattatcacttatctgtgacttaatttgttaatgtaactttcaacttactttctctgtagtttaaaaaatatattctaaaacgaagaaagtacgtaggtggtaccactggtacgttgtccaggtagagcacacgtgggcaatggcgaagccaagatttagtgatagggggtgctggccacgagatgcaagaactcaccagcgcctcggtagacaaaagtgtggatcttgatggctcagttcatgctgagtggcagattgccctcacctcacctcttgttcgcactaatatacgtggtcgccaaagaatcattttttaaaattaggcaactaaatagcaccaaatttactgaatacatgaatctattcatccttttttagttttggagacttgcaaccgcatcgcttagttgcattaactcaggtaatcacgtattggttagttatgtataggctcaacttgcaactaactaatgagttaattgtatggattagatgcctaatcaccgggggtgcatggggatggggggtgccaggcccaccctggcaccccggtggcttcgccactacacgtgggaacgaaaatgtatatgcgtgctactttctccgttttaaattataagtcgttttgatgtcaaagtcaaattattgtaaatttaacttaagtttagagacaaatatgttataatatttacaacaccaaattaatttcattaaatcgataattgaatatattttcataatatatttgtcttgtgttaaaaatgttactatttttttctataaatttaatcaaaattaaaacagcctaactttaatcaaaattaaaatggtttataatctaatacggagcgagtagataaaaaagactctgatatgcaagttgtacgtcgactagtcgtgtgtccacctgctcgatcgcttgaccgagacatgtcatctgtgagtagatttggtttcatcacttggtccgcaagttaattaaacagttaactaattaattaatttgctcgatttgcgctggcctcgggcgtcctcgacggctaacccaacctgattagtttagcgattaacctcgtttaattcctgagttacgtgtgctctgccgagagattaaaagcgtattaattaatactccatccgttttttaatagatgacgccgttgactttttctcacatgtttgaccattcgtcttattcaaaaattttatgcaaatgtataagatataaataacacttaaagtactataagaaataaaataactcataacaaaataaattataattatgtaaatttttttgaataagacaaatggtcaaacatgtgagaaaaagtcaacggcatcatctattaaaaaacggaggtggtatatattaatcgagtaaccaatggctgcctcgatctgtcacgtcatagatcatctttctttgaccttctttcacattaattttccatgtacgcgtccacatcagctaacacacacgtcggtgcatgttatatctttttctttttttaaaataaggatttgaattacaatatttgcgtcgtagggttaaatttacatgtatggatgaaaaccaacaaaaattccgtttccacgtgaacgaattaaccacgtatattaattatagtagagtatatttagtttgttttcgccggtccagcattgtagctagtatatttgcaaattaagtacatggttgatgcgtacagctgcagcttcgtcccgatgaggacaaacaaataccgtcagtgatatatatagtacatgtgctgttgatgccgacctttgccaaacttaatccatctcgacgtaattcactctctccgacttatattaaagaatctttaacttttctctaagtcagcttttttaaaaaaaaattaacataatttataatatttctaacacaaaataaacttactacgaaaatacattcaatgctaaaaactaattcagggttatatgttgctattttttatgtaagttttatcaaattttaaaatgttatatatatgtcttatattgctaaactgatcgatggagtatttctcctgtgtggctatatatacttgcctcctactagcactctacatctcctttactgatattttgtgtagccgtctgagccgtctgagccatgcatgcatataaaaatgtaggaatagtaaaaacataagaatattataggaatgtatgtgtaaaatagagaaataaaaaatatacgaatttcttgttcttcgtgcgaagaattcttacaacaaagagggtagatcgagtggactatttttatgtgaaaatatgggcaaccctttgaaatgaatgcatctacaagatctaattcaaaggaatcatcaatcctctatttttctatttttccttcacatttcctcccttcggaatgagcccttacggcttgtttggttggagggagtttttagaagggattgggagtttagagggatgaggctataagtgttttgtttggttgggagacatgtgaattttggtgggatggggatggggaattgaggaaggaactccctccttttcaatacctgggtaggggcaggtaattgggagagaattcctcatttactttttctaagcaaatctcagccatccgtttttattaatgacctaatctccaactaaactccctatcaatttctatcacctctccaaacaagatattaggattaaaaatcaaattcccatcttaatctcatcatcaattccctcgtgtaaactcccgatccctttccctcgagttaccaaacaagccgttagtaggcagtagtaggagtagaagaacagccagttacccccactagctagtaggagtacgtcttgtacgtcgtatgcatgcatctgatcggccgaattgagaaggatggatgtgtttgggtggagggggtggagaaaattaagaaggatacctaaaacaagataagtcatagcatgttattaattaagtattaataatttagaacttaaaaggaacatattaatataattttttaaacaactttaatatagatgtacttctttaatctttataaaaaacactataatctcctgtatcacgggaggcccatcgatcgtaggatgtggtgtcatgtatagtagccaacccggccggccagtgcgtgcagtgcagctagctagcttgagcttgctacagtatgcgtgatccatccagatctcatctctcggcctgccctgcccctacgcacattgatcaggatcactgccaaaccatgacaaatctgctgcaagtgcaatctaccaatactattgttcactgtaccacccttatcagtatctgcattctgcaactctctctgcattcagtaacagtaacttcggaacaattgattgtactgtaggggtgggattgtgattggaaaatgaatgaagggttaggattaaatggaagggggagaatgaatagttaggatttaatgatgttttttggtgggtgggaaatcatttccctatctcatttgcgcctaagagtaattaattaacaaagaactatataatcgaagaccaaatccacgtctatattgggcctaatactgtcctggaaattaagttgggtcggcatcctcggtgttgatagttatagcccagtagtacatttgcggcccactaagaagccatctccggaagcatcgagaaggagaagccatcgtcaatctcatcctcctcgacgaaagaaagaggagcagaagcagataagagaagcgcctgtcctcctctccggcgaagcctctgcctcctctccacttcttctagaaccttccgcgcttccgtgctccccaccgccacctcgcccgctcgctgtccccagatggccccctccctcctagccgccgccgccttgccctttcttctccacggcgccgccgccgccagtggcagccgcaggccgcttgtcgccgccgccgccaccggccgccgcgccgcctcctccctccgagtcgccgccctcaagtacgacccttccaaggtaaccgcattacgggtggctcgagttcgagttccaggggtttgggggggtagggttctgacgtctgtgctaatgtgctatctggtggtggtgttgttgttgtccaggtggcgccgcagtccgaccgggtgctcgtccgcctcgaacagattcctgaggtatctcgtgctccattgcctcgcaatgccctttaatttgctctgcattttaatttgttagttcaagcatttcagttaattgcttagccattgtctgtggtgatagctattctgaatgcctctagttgagtgaatcctttgttgatgtagcgtgaatcgaaacatctaggtttaggtggaatgctggtaatggtgcagaaatggtaggaaggttgtgactagggagtcagtttttacatatttaatttcactaggattaggcttcaattatcatattttggcactgatacttgcatagttgcagatatattatactccctccatattttaatgtatgacgccgttgactttttaatcaacgtttgaccattcgtcttattcaaaaaatttatgtaattatcatttattttattgtggcttgatttatcatcaaatattttttaagtatgacataaatatttttatatttgcacaaaaaatttaaataaaacgaatggtcaaacgttgttcgagaagtcaacggtgtcatacattaaaatacggagggagtaaaatgtaatttgcctgcttttcagctaatgctttttcagttatgttggaacttgtgatatattatctaggaagctacatgtttaggtagcataagaaaattttgaattctggagtggtgaagaatttatctttaaacatcagcacttcgttatttgtcttacatagcgccatttgtttacactaaactttgaaataagttaactacagaaaataattcaggtgatccagttagtttcgtgccaaaagactgcagaatgtaacacactgttcagctatcactgggtcactgggtgactggattgtctaggatggctactctttttgtccgctatggcaaataatcattatcatagcattttatgaggaaaaacttctgaaaattttcttcggccaatctacagatgcgtatttccatgaaaatcatgttatggttattctgaagttataggcatagtcactaggagtagattatcttgtaacgtagcttattcttataaaacttttgacgcctacagaaatctgttggaggagtcctgctgccaaaatctgctgttaagtttgagaggtatttgatgggtgaggtaagatcttacattgccatgctctactcttataattgttaccttcaccgggctataattccttaacatcatactatttctgctagattttgtctgttggtgctgatgttaatgaagttgaagctggaaagaaggtaaactcttaatgcatgttccgagtgtgtatgtacgtcaacaaaggagaattctatgcttgcaaaactttgacatattatattcacttctgaatagcacgtaccagattgtatgttattgcctgtggtgttcttcactttgcatagtacttccatgtactgcactactacatttagattagatgcaggggggatctctaatgacaatttgttctttatgggtataactaaatttatgataacttacagtttgcgccagatttggttttatgtgtagttacctgcagaaattgtaattgctgtaagcttcatccattagaaaatgcaatctgcattttaaaatacttcccttttagtatagctacttcccttgatctttttggtggcgagaagtgagcccgccaagcactgctgtgggataacacagtagaaacttaagtgatactcggattgtcgaacattgaaatcttaaaatcactaatatatgaaaaggcatcaatattacattagtaggtttctcatatatataaaggtgcaatatcatgttaaacacaatacaacatggagaaaaaactgcccactactaatttttactgtgtgcttagatgtggtgcgatgatcccatggtcagcaaggtctcatttgggcttgcttatcttgtgcttctacacaacctattaattttccttttattgtatagtataaaacgttgcaatatactattaacttagcatattcatatttcttgtatgttatagggaaagatacttgacttgctgcatagaaatatgcatgaatgtcatgttaactgtttcaaagattgctccattaaatgtgaaatgtttatgtggcttaatgaagctgagtgatatctttggtctttaggcaatttcatttttaatggaaactccagtttttggtcattagagcaggtggttttttaatgcaagctgattagatgcccatggcccgttgtgtgaatctgaaaccactgcttgatcattacctcttttattatgcccttcatttttctgtttcttttccctggagctccactgcaattcttgttttcactctcacttgtcaaatacaacatatatcttctgctttcacctttacagtcggcacagctgttccgcctgtgttctttgtatcgcattaaaatgtcaattgaacatgattcactgacctggttctgcttgtgactttgcaggttctcttctctgacataaatgcttatgaggtaaatgaattggcttctccctaacggatacattttgtggtctttctcctaagtactccctccgtcccaaaaaaaaggcaacctagaaggggatgtgacccctcctagtataacgaatctgaaaggagggagtacgatgccttttttggtttttgttccagtcatctgaacgctcatggtattgcatgtacttgcaggtggacctgggtaccgatgagaagcactgcttctgccgtgagtctgatctgttagccgttgttgaatgagtttttactccaaaatcggagtgtccaattccacaggctagaacaaatcccaaatttattatctgctatgtgatggcgatgagttgaacaatttgatatgtcattctctacaaatgaattttggcttctaggagtataaattgggacagcaaatatcctatcaatcaatcttattcacagttacactaattttcttaaatatattgatgtcctggagataaacgaaacatgaattatggctaaaaaaaggccagagtctagaactttgacttgtttccaatgcacggctggagcttagagctggctgctgagtgttgaccgcaattcttgcattaatcaagccttgtgtatctctgtgccagggaatgttaccttctgattttcttatgcactataggatgcttactgtttagatcgcattatgtactacagcttggagtaaaatattttgagagagagagagagagagagagagagagagagagtgtgtcataatagtgggtaatagcattagtaggattcatgcatatacgggggtgnnnnnaaaatttttnaanccctcattttctctaaaatacacaaactacggatataaaacacatctaaacgaatgccaaagtaaacgaaacgctaaggctcttacaataggggtatatcaagccgggccacaattaaccggctccgaatataccaaaaaaaggatgcctgaacctccagtaggaaagcggcctcaccagtttganttcctggagaagccgtccaataaaaggttcgctcgattttctctttgaacacacaagccacgttgcgcgtccagtttaaacaaatacaaaaagtaggacctttagactgtagcttcatctggcggatctaagaactatcatcaatctttatgtcgatgctaggaggcaataacttactcgcgtacattagccg

SEQ ID NO: 6730 - DNA, 11118 bp, Oryza sativa
  unsure (1)..(11118): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaccccgttaattagctggagcccggcagccggttcaaggtctggactctgcataagatgcccggattaagaaatttgcctcagctttcgtgaggttgaagattcccagcttcccaggcttcgctctcgggatgcactactctgctaccttgtttgcagcgagcactagtcgcattcgctggctccagaacccttaaagatgcttattgactaatccagcttaccgtccctaggtttcttctggtacatgtcaacagtagaggtgaacagggcagtatgtatcacatgcatttctccttgacccttagagattcccttcctggccttaatttttctctgagaagtaaatactatgtatgggattgtttggttcattgccaatcctaaccataccaattgttttagcaatggcaagaattggttgtgaccatttgtttgttttggtaaagattggcatttggcaaccgtttttgtttcgtatgctaccacaaaggtgtattttggcttaggctcaattcaaccaaaccaaataaaccgtcatccttttttcatttttttttgctataaaccaaatagaatgacaaatattttggcatctccaaattttcggcttggtcgagattggatatgcgaaccaaacaagccctatattcccttcgctctaaaataagttaatttatggtcataaatctagacacataagtaaatttttggctataaacctggacagtggtgtctaggtttatcgacttattttggtacagggtgagtagtcgtattatcttcattcataaatatattattattgagtaagagtaccgctgctcttgtatcatggagtgtctttatttttatacgagccacgtacaaaacaaaaagaatctcaaggcagtgatcaagtacaactcacaaggtacttctagtgaagtagagaaggaaaacactactaaattactaaagtgctactagctaagctccagtaaattaatttgctaaaatctttactgaaatcaactactaatgtatagtagaatcatggatgcaatcattgacaagatcaggagggcaaaagaaaagaatgaatgtgcatatatgctctggctggatgtgctcatatactacgatctctctctctttaaatctgtttgtttctttgatggatgttctaattaattaactatagcacttgggcatcatgctcctagctagttaattggtcctccggcagttagccctgatctcgccggcggcgccggtcttgacgtcgacggcggcgagcttgttgagggcgtaggggaacatggaggagaagaagtcggtggtgccgaggaagttgaccatccaggcggtggcggcgtggtcgccgagcttctggtcgacggcgaggacgccgcggcggtggaggatctgggagtagtagctcttgtcgacggtgaggatgctggaggggtcgtccaggtagacgatgttgtcgaaggcctggctctttgggcacgcgaacgtcgtcaggatccacacgtatatcgggtccatcgacgggtccgcctcgccggtgccgttgaagttgtacagccggtcctttatcaccgagcagtgtgtcacccccaccgtgtgagcccctgcacatataatatcatgatgcaattttattttagaacagacgcatggttgtttgagccatgttacaatgcctgataataagccgtgaagaaatgaaccaagtaaccggaataagttatgggtaaaacgttattaccggtttaaaaagtaatgatgcaaaatggactatattaaatttaaaatctaaatttggttgtcactgatgaccaagaagctaatagcttgtctttgcagacacactataaacagagtatggtcatatcagatggggaattgacggccaagattttgtaaaggttgtaaccctaaacacagtggccactgtatcatcatttttatatataggtgtgtgtgtgtgtgtgataacggctgtggatctcactcttcccaattaccaatgtgtgccagctgatcaataaagcatagcttcagatctcgatcaacagaattctttaagtaattaaacaaattaacatgatcgatgaggaaactgagtatagtagtgctaattgagattgacggtagtaagtactcccacagataccatgaacccctttttaatgcgtagcaccggtatacgtgacattccatgtgtttagcccctcgattatatattctgatgcgctctgcccccggtcaaattacgccaaagtacttaaagtataaacacatgcacatggcctagttatctactagcttctttgattttgaaaaaaaaagaacagttaatcgatcacagttaagttcaatttgtactctgtttttctttttgtgaagaagtttaattagtactctgaagttgaattagtagtgagttagttacccatgaggatggccatgtcgaagctgttgaggcccttcttggcgaacatgtcgatggcggtggggatgtcgacgtcggggcccggcaggtccgccgccatccacgcctgcgacaccgtcccgtccagcctccccagctgcacctcgtaccgaggccctccacactgtttcgtcatcgcaaatttgcagaatgccaaaattttaatttggattttcgattcagaaatgacaaatatgaattggagtattggtttgagaaatgtgtgtgtaccatgccgacggcgtccctggtcgcggcgacgatgatgtcggcgcaggagacgacgccggggcaggccttctcgagcgtgtccttgatgtcgtcgatgaggtcgtagccgaagatgccgttgttctgcggcgccgtcttctccgtgtttggcccatccagcagtatcgacgcgtcacacccctgcaccacacacacatgtccagattgtagccaatttgttaaaatatagtacattactaattttgacaatttaataatattgttaagttttgacgaaatttcctgtgtatttatcagagtttagtaaaaaaactaaatggatgcacatatttaataactttaagaaaaataatatggtttgaaatgatatcaatccgaacaacccctatatacattcatcagttaatcataataagatcgaacacaaatttatccatcgattaattcagcgatgattcagatacagtattgattaattagctgatcgaactgatcttgattaagagagcagtgtgtatatggattgtacgtacggcgacgaagcagtcgtggaagatgaggtggaggaggccggcgaccatccgcttgtcccaggcgaggcgtgcctggacggcgtcgtggatgatgctctccacgtccaccgccacgctcgagttgccgccgccgccgttcacgcacttgccggcgtagtagccgctcgccagctgcgctcggcatcgccccgccgacgacgcggcgagcacgagcaccgccaccgccatggccagccgcggcacgccgccgccgccccgccgctgctgcattctcttgtgtaatccgctgtacgctatcgatttgtagctagctaccaacccttgattgatagatacacgcgcaagcaagcaagctcagctagctttctcttccggttaatatgatcttgtcgccggcgagcttgcgttgccgcactagcaatggctgtgctagtggctactactctactctaccttcctgcagctgactaagctaagctatacgcgcagcagctgcagctgcaggaggagctagctgctagctaggcagatggtgactttgctgcagcagaagcgaatataaatgtacaggctagctagcttccctgctgcttgatgtctcgaatcgaagcagcacacaggatggaagatatggaggttgggatcgaccggccagctatatatgtaggtaggggaggagaggagaggatcgggaacatgcatgattagaagaagaagaactgaagaagaagatgcagtggcagtgagattgcgtggggagtcgtgggggcgcgttcggatcctgtgctactgtcactggcactctgctctgcgctgccacacgtgcctgctttctttgctggagtacttagctcgccgacgccggccggacggtgcaaaacctcatagtaattcagtatacagtgtagctgtttgttactgttcgttacgagatgtacaagttgaatttgaacttacatgtttgtagagtattatatcacatgttaatacaccttctcaatttttttcataaccatttaagtgacatgcaaagaacgaggggttattctctcgagggattaaaatagtttcccttgttactataaacaaaattcagtatacaatactcatcctgtgtcatcccttaaaaaaaaagagaagagatcttatggagcacagaaatttgactgcattgtctgcaaaactcactctccatgtatgtaagccaagcgagctagcttaggtctctgtaatcgtgtgtcagcattgttcagttgatctgctcatcagcaactgctgggattccaggattctagtaaatttacgtcgttcctgaaattatgctaatagcgtgtataaacatacatcacatgaatccatatattcaccaccgactctcatctgtcttccatgtactatatgccatttttgaacagatagttatatagtagttccagctggatcaactcgtacggttttcaggaataatcaccttttacctgtactactagctaatgtacttactgaacaaaagcagaggcagtgaatctgtcttgatcgatggtagtaacatttctatccaactcctgttgcctctgctttagttttctgtggattgcggcaggcattgacccggccggtttcaatcctccaaatccattttactgacgcactacacaatcttcaattccctgatgcagtttttttttcaactgaacatgtacaccagctcaatacaatacaattcaatccaattatcatatgctttcctgctttacatatataaacctgattgatcacctcctaattatcacttgaccaatgtactcataagatccgcaaatgaaggaacaacgcggtcgatgataattctgcatgtgtgtgctctacctgcataattcaggccagctaggcaggcagatgagcaaattaaatcgtcatatcgatttcctaatatgttctgaacctagaatcatcatatcggtttcaagaacaatataaattgaagcacttctcaatattaacaatgtaattagctgctgcgcatgcatgcattccaggtgattttaaaaatgatgggagtcaacaatgaaatggttgcaccgaggagagggtagtaccgaagtaagcaaaacaagaagcttgagatgagcgtgcatgtgatcaactggtggctcagttggctggggcatgtgctctgattcgtaaacacaaacctcattactagtagtacattatgcctcccaaagagaagaggtcgccacctagctagtagcttaattatctgtaattaacttatgatgatatactaattgtatttctactactgcccagtttacagttgcagttagttgtccgaggtagatcaagctgcttgttattgcattcctagcattcattcattaatgcaccaagtagcttacttggtctgacagggagatggaaacaccggccttgcatttcttctttcaagtttcagctgacttctcacattttcagaaagcttagaccttccggccaatataatttcagctcgaacattaagggcttttgctgctttgttcaaggtcctgatctgatttcttttctgcaaccaactttcttatatagtgaagtatgtatataacttgtatacttcactcctattcacaagtcttctgtcatagactttgctagagatccacgcaaaaaacacttctctgatgatctattgtcgtagtaggcagtagccattagtatagtgttgtgagtcgaagctaccttaattattctcttcttctgttcatgcatgtgcattgcgcttagctagctagcaagatagttatagagtgatttggctagcgatataagctagggatatatctatattgtctctnnnntgatcagttaaaantgaancaaccaaacattcattcattcagtcgttggctcgcatatatacaacacaaacaggccgggcagatcagatcgatctgccacctaactatgaagaacatatgtactccggatcctacctgtatagatgctcatgcagtgatcctaccatgtgctcataactatatatatcctgaattaccgatgatgcatcatgcatatgcttggtgaataatcttgagcttttttgagcattacaccttcccctgtgatgttgatatcgacggatcgatgtagtgtagcaggatggccgatgctgttgaaacaaaagcccaacgactagattaaactactccctcctccattttaggttataaaacgtttttgactttagttaaagccaaactattttaaatttgatcaagtttatagaaaaaaatagtaacattttcaactcaagacaaatttattatgaaaatatattcaattattgatttgatgaaactaatttagtattataaatactactatatttgtctataaacttagtcaaacttaaaacagtttgactttgatcaaaatcaaaacgtcttataacctgaaacggaggaagtagctctctaggagtagctcacatgcaattccaatgaattcgccggcgacggcgaagagaagacgatgacgggaatggaatggagaggttccctcggtcgtttagcatctggcttggttctccttgcaggccaagcgggttcggagtttagttctccgaacaccccgttttctcaatttcttcattttttttcaagtcaataaggacagaaccataatgagaaattgcaaatggcttcaaattcaaagtttctacataaaatttctctctatctctctctctcttaccgtcatgctgtctcaacagtatattcaaataattacaaaccatctctgcgtcgaagcatctgaaatgaaatctgcaaagtcacctggtatacgctgaaaaccagactgaaattttttcctcacgcacctactccctccatctcaaaaaaaaaagtgaatttagtactggatgcgacatattttagtacaataaatctggacaactagaatatatcacatctagtggttggttttttatgggatggaaggagtatttgtttgggcttgaacaagatagtgacgtacgtgcggcccataccccaattctccctactactttgggctgaaacgggacaacaactatggagcccatatttatttcgctcatttctacgtacgtgcggcccataatagttcgggccggaaagggcttgcgagggaataaggcccattaatgcgtgggttgattctaatacccgccgccgccgccgtcttctccggcgagcaggagacccctcccgccgttcggagctcggacgctttctcgccgctgctcaccttccgttccctccccttccacgcgccgccgccgccgattctttgctccgtttggcggccgctgggccgtacgggagggggtgggactggatggagtcgtcggtgcggagggtgcagcagcgggtgaggaaggcgcgggaggagatggatcggtgggacgacctcaactcccgcctcctctctcagttcgcaaacgctgccgccatcgttgctcgtctcccggtatcctcttcctctcttctctgcaaaaaaagatatatccccttttggtggtttggagtacagttttactgtggttgtagagaaacaacactactcggtgtggcagcaattcttttctttttctttattttgacacggcagcaattcttttgttgacaaagaaatttaatggacatgtaacaagcatttagttttgtggtagcatcatgcattggggggcagatttcactaatgtaatgaaattacagattcagttagttttccccctcggataactgcagcaagttcagggctttcagctagtgctgacaggaccacttctagtattttccacctgcaagttttttcaagctagatggtcggttgctcatgaaaaacatatcaattgataatttggtagacacactgtaattctagtgagcagtaaatgcattgtgatattagctgcgtgacaaatcatatgttaaaaggtgctggaagaggttaagaactatggtgtcctacgatgtgtccctaacatcagagagaatcttttgggtaagcaaatggagagtttggagatcatcttcgtctctatgagggagacagtgtaagtggctttgctgctgttgcaatcccttttagtttcggtgtgacactagaagcagacggagaaaaaaaaattgatctgacgttgctgctgttgctattgttcagggaggaattcaatagcattgccagatctttacataaggctttgcgggatactaatcaaatggtgagaggtgggtctgcactcagtgcaaaacagatgcagttacaagtgggaattttgccaactatagcagactgcttggatgggctacggactttatgtgaaatgcaccaggccgagtaatgacctaaagaagacccccccccccccccctttttttttgctgttgtgaagctcattgtactgaacctcatccattatagttgaatcaaaattaaaccaaccttatggccgtcttacatatatgcaacaccccaagcactgttttccatttcaccaatactgacttcagttgcagcacttagtttgctatcatcatatattaagatgctctttattctgacgctgcacatattactttttttttctgtactgaagccactccgtgttgcggtcctctgaattgcctaaattccatttgacaggtatgcactaaaatcatcagtcatctcttcgctgacatggacgagcaggtaaaagttcaactatttgtttcaccaaacatctatattcctatctgtgtgctctgtatggagttctgtatctgcttttagtttatccctgaattatcaattcagacatgtttgtcagtcttcactaacttgaatgcccatggtgctctttctttgcagttccagtgacattgccgcgatgcgtcaactcttagtagaccagccaaacataccaaaagatgaaggtaaggaatgaaagaagagagaactaaagttgtcaattaaggtttctagctatccaatttatgaggctgacagttacattccaatcttgttttgcagtgcaagctatttttgacattatattcgcagatgaaatctgttgatgtacttgcacgattgctattggaagcactatgccctggagtcctggacatgttgacatcattatgttttgatgtacttgcatgcccagatggccagatgaaccaaagatgctgatgcactgtaacaaagctggaattgctgtgtctggctgccagcaagagagtaggatgtaggagtagctttctaacatacactaaaatatcttccctttttttatccccaaattttcctagttctatgttaacagtcatgtcctggagactaaaatttatctttgactgaatgcacattttcatgtcctggagactataatttatctttgactgggtgtgtttagttcatgctaaaattgaaagtttgattgaaattggaacgatgtgacagaaaagttgaaagtttatgtgtgtagaaaagttttgatgtgatggaaaagttggaagtttgaagaaaaaagttgggaactaaaccaggcctgaatgcacattttatgtcatgaatctgtttcttgtgtgaaagacaaatcagacacatatgagcttctacgtctgtctcaaaatatagcaactagtatcggatagaaacttaggtaaatttcatttctgtgcatggtggttgcatatgaaatgatcctatgcttcaggttctcatgatcttggttgacctgcagagtccattagagccgttcatttttattttgtttttgaattggacggcccacgttgactggcggcgaccacatgcaagagtattttgtctgagtccgccgcctccgcccacagattacttcccttccccgcccgatgtccctccccgtcggctcgccgccgccgccgccgacatcgccgccgtacaccggcatcctcgccgccctccaccgcagcatcgcaggaggccacgcggccgccgcggtggccctcctcccggagctctcccgcgccggcctgcgcccgcccttcccgctcctctcctcgctcgcccgcctcctcctgctccgccgcgccacggcgccgtgcttcccctccctcgccggccgcctcctcctctacgtccgcctcgccggcctcaagaggctcgtgccttgctccacccagctcgccaaccacctcctgtcgctcaacttcctcctccgccgcccgcgcgatgcgcgccgcctgttcgccagaatgcccctccccgacgtctgctcctacaacgccatgctcgcggggtacgcccgcctcgcgctcgcggcccccgcggccgaggtgttcgccgccatgccacaccgcgacctcctctcctataatgctactctgctcgcgctcgccggcggtggtgagatgcagaaagccgtggcgctctactccgagctccgcggcacgtcgacttcacttgggtacagtgatcaaaccttcttggcactccttgtaggctgtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgggttactcgactctcaatngncccagt

SEQ ID NO: 6731 - DNA, 954 bp, Oryza sativa
  unsure (1)..(954): unsure at all n locations
gtggggcttgantttgaagtagagatacnnnnnnnnnnnnnnnnnnnnnnnnnnnnnnnnnncaagaattgatttataataagcactcttatcaataaattaggttaggtattgtgcggttacctaaagatacctgctcaacgtagatgcagggagtagaaagactgatccaaatttattgctgcagctatacattcaatgtagaagaatttgaattttagaatcgaaggttcataatataagacttctcggctcttatccatatttcgaatttttttagaatgaatacatgattcaatttggcagacagagtagtaaagatttcatcgaaaacttacagcagcttgccaaacaaaggctaatagaaaaaagagtacaggtatgacaggcataaaatccacgattgggttgaaaatggcataagcttcgggcaatttggcgaagaaaaaactagtcggataaataatagaattaaaacaaatacaggttaaactaagtatattaggcataacaagcgtttcgttcttgtagagtagataattggattttgattgagttatttttctaagggaaaaaggaaaaggaggattcaaaatccttttttcttcggactttcccaaacacaaaatacctccttgtattcgcactctcaaatgagagtggaagaaattcgactttcatatatatatatatatatatatatatatatatatatatatatatatatatatatatatataatgtggcaatcgatcgatctcatcatttgttagatgcattatcacttatctgtgacttaatttgttaatgtaactttccccttactttctctgtagtttaaaaaatatattctaaaacgaagaaagtacgtaggtggtaccactggtacgttgtccaggtgggtaccgaaataaaattcgcgntgtagtctcacgttgctctattttacccact

SEQ ID NO: 6732 - DNA, 696 bp, Oryza sativa
  unsure (1)..(696): unsure at all n locations
agtgcatgagatgcaatcgacngccnnnngnnnatntagaggatcccctggcnnnnnnnnnnnnnnnnnnnnnnnnnnnnnnnnnnnnnnnnnnnnnnnnnnnnnnnnnnnnnnnnncttgctgccgactgatggtgacgccgaaaactttatgaaatcgcatgttgagccgacgattcgcgatattccgtcacttctggcgctggccccctggtatggaaaaaagcaccgggacaatacgctcagtatgaaacgcttctccaacggtcgcgggttctggtgtctgggtggtaaagcggcgaaaaactatcgtgagaaatcggtcgatgtccccggttacgatgaactggcggcattcgatgaagatattgagaaagagggatccccgacgttcctgggtgataaacgtattgaggggtctgtctggcccaaatctattccggctcaacgccaaaaacaaaggggaccctgcagattgagcgtgcttccagcgagttcgggcatttcatgcgttttcatgttgcctgtccccactgtggtgaagagcagtaccttaaattccgcgacaaagagaccccgttcgggctgaaatggacaccgggcgaacccttcagcgtcttttacctgtgtgaacataatgcctgcgtcattaagcagcaggaagctgatttcacttgagctcgttacattctgcga

SEQ ID NO: 6733 - DNA, 717 bp, Oryza sativa
  unsure (1)..(717): unsure at all n locations
acgtggactganactgcaatgccgcctggcccgnangccngcaggtcgactctagaggatcccccaatttcatatcctgttgaacaggaatatagtcatcattttctttgtagccaataatcctattcaatctttcccaatcttcatcactaaaactctttgagtctccctcatcctttgaagagccagtcctgcacacaaaagatgaattaatttctacaccttccacaagcataaagcgcgaggtttgtatccgaactaaccatccaaatgaccaccaggactgctgcttattttgttgagcatattgatgtgtttctgctgactgctctacaaacttgtgggccaacatcctgcacaaatgatagtaaaaaaaacatcaaaaaactatatactaaactaaatgcattgagcaatgaagaaatggtataagaacatgcacatgaaacaaggcctggagcagaagtttagtttaactccatgtgttagtgcatggataattacggacaaccttcgttctattctctatggctcaaatgatcatgaagttgaacaggacactcatctattcattgtacttgtacatgtaaaagcataacaaagctatgaatcatatactaagtattattcataggactaaaaagggccatgatgtgtgcattgaattcaatataaggaaattttaaacagcaagaataacatacattaatcaacagg

SEQ ID NO: 6734 - DNA, 947 bp, Oryza sativa
  unsure (1)..(947): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagaagaaatgaatgccgagctggcatttacttagctaaagcacagcgtttattaactcggtagccgttccgaccgtttcctcccctccctctcccgcggtttgcaaggacgccctctcgttcaaacgttcgtctgttcaaacgtcaacctttccaattcaaacaatcaaacccctttacccttctcccaacctcctcctatttgaacccttcccaccacctccagtctcccgtattgaactcttctcagctcaaagccttacaccacaacacgcagctgttctcgctgggcttctcttcttgcgctgcggtgatcgatcgagagcttgggatggcgctgctggcgcggagggcgcggaaggcggtgatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6735 - DNA, 789 bp, Oryza sativa
  unsure (1)..(789): unsure at all n locations
cgcgggnaattgattgtcnagnnnnnnnnnnnnnnnnnnnnnnnnnnnnnnnnnnnnnnnnnnnnttataagtttatcagtcgtcttcttttttttcttgacataacatgtctaattccgatcatgtttattgcagcgtggtacgctcacgtggcttattaggccatctgatgggagccttacagaaactggaatatccagaaaatcatacaaatattaaaaaaataacaaaattacaaagccaacaggttatcttcagagtaatgtgagtatagtgcacaaaaaaacagtttaacatgaatattggatcaagactcttcagacagcaccctagattctgtttgtaaaatcaagaataatataaaatcacctcctgtctcgttcttacaccacaggatggcaaagtggaaacacaaactaaaacaatgtttctgagatgtgtcgcccataaatatgatgccgatttcagtacataaaagctcctaattccaagaaaatatactacagatcgatccgcccttgaccctaggtcaaaatggcaaccttagtatggttatagtaccatctcaaatcctaaacaagatgttgtggtacatgcaagcaactgtattgattaaagacaagtatcgctataactcaagattggtacctttttatgatctcaacagcctgctcattgatgtatccaccttcaatgagcccaggagtgtcaataatgttcaaggtgaagcctgccctggtgcgagaacacatcatcggcctgagacccttcgacttgacaggaaaaca

SEQ ID NO: 6736 - DNA, 902 bp, Oryza sativa
  unsure (1)..(902): unsure at all n locations
accttaatgaataataaaggggggcgccggacgaaataagtgccaaaaacattttaaatttttataatactaaaaaaaaaacaggtgcgttccaacgggtaaatacattttttatgatccaccaccaactattaagagttaagtcatgggaatcgctatactctataattaaaaaattaatgaatttttttcttggttttaaaccgaaagcacaatattttttctttgttagtcctaacccagtccactaaaacctttgttagtcctaatccagtccgctacctccctccattcgccccgcctttcttcggtcgtcaagctccaaaaggtaatcccgggcttgtacaatgccaaattcagttgaattattctcgatctcccaaaattaaattggttgaggattttttgatccaccaaatctccttttttccttgtttttccccaaaatcgaagcgaatcaaagcttgttgacctgccatgatcaacgacttttaaatagggattaaattcagtaaattaaagtccaggatatggaaaatgatgatggaggaatgtgaaatcgatttttgcaatcagttagagtagaaaacatacgggaggtagatcgaacgtggcagtggcgctagggttcggcccagaccagacgagatcgaaaaaagacaaaaaaaaaccggacttactgcgtgcgaagaaaaaaaaccatttcgcgtgcaaaaaaagcaaaaaaaataaaccgctcagaccaaggaaagcggaagcttggcggctcaggcggggcacgctaagcgcgtgcggatcggatcagagatcaggaaaaagacaaaaaaaaaaaagaaaaagaaannnnnnnnnnnnnnnnnnnnnnnnnnnnnnnnnnnnnnnnnnnnnggatctacaagcgt

SEQ ID NO: 6737 - DNA, 1296 bp, Oryza sativa
  unsure (1)..(1296): unsure at all n locations
nnnnnnnnnnnnnnnnnnnnnnnnnnnnnnnnnnnnnnnnnnnnnnnnnnnnnnnnnnnnnnnnnnnnnnnnnnnnaattaattttacaaaatggctttgttagttttactcggaaatcctgatccgactacgaagcgtttgaaaatggggaatcggatgaacctgatgaatgatgaaggggggcgacggacgaaatcagtggcaaaaacatcttaaatttttataatactaaaaaaaataccggtgcgttgcaacgggtaaatacattttttatgatacaacaacaactattaagagctaagtcattggaatcactatacactataattaaaaaattaatgaatttttttcttggttttaaaccgaaagcacaatattttttctttgttagtcctaacccagtccactaaaacctttgttagtcctaatccagtccgctacctccctccattcgccccgcctttcttcggtcgtcaagctccaaaaggtaatcccgggcttgtacaatgccaaattcagttgaattattctcgatctcccaaaattaaattggttgaggattttttgatccaccaaatctccttttttccttgtttttccccaaaatcgaagcgaatcaaagcttgttgacctgccatgatcaacgacttttaaatagggattaaattcagtaaattaaagtccaggatatggaaaatgatgatggaggaatgtgaaatcgatttttgcaatcagttagagtagaaaacatacgggaggtagatcgaacgtggcagtggcgctagggttcggcccagaccagacgagatcgaaaaaagacaaaaaaaaaccggacttactgcgtgcgaagaaaaaaaaccatttcgcgtgcaaaaaaagcaaaaaaaataaaccgctcagaccaaggaaagcggaagcctggcgctgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaannnnnnnnnnnnnnnnnnnnnnnnnnnnnnnnnnnnnnagagaggcggaatntcaaaaannngggnnntcaatncagcggccg

SEQ ID NO: 6738 - DNA, 14018 bp, Oryza sativa
  unsure (1)..(14018): unsure at all n locations
agcgcgcctttgtttgacatatcgatctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttactggtaaagcaacacaactgcagaatcttatggacatattgtccatggaattttatcttatcattgtttttttaaaaaaaaactttgggacaggtgcattttccgtatttgcaagtacaacaaggatattaaggcattggaggagactgagaaacgcctcaaggaagagtagattaatcacacttacaggtctgccaataacttagacaacacgttttcaatggagcatatggctgttgatttaaaatgtcgactcaacaatcttttcaaaaatcgagatttagtttattggaatccttttactagatagacgttgaagattcttgttttagacttgtgttgatgtatttcaaggagtaggcttagctgagaacctagatcttcacctaataatttggtggtgatgaaacttggacatattcaccattcacctcattcctgtcttgcaaattataaagctaggaaagaaacaaaatcatttccatttcaattcaaaagaatctgatgtttgataaaccatgctggcatgccattgattctgatcaattctgctctgttgttcaaagttaagtaatacaaggggttgcatgaatttttaaatgactttgttattggctgccatgcttgcgaatacggaaatagaattacattgagcactggcattcatttatctttccttcataatcacttgctgcaccaacaattagtctattagacaatgcttaaagattggttccagtaaaggctgaaataccaggtgctagtggtgccatacttatcttgtgtcaagtagatgaatgtgatgttaccatccaactgtgcacaaacttgcaataatttgacatgggaaaattgatggatcgttccttctataatttattgatgcaggtggattttgtgctattcctgtccttcagatgtatgcagatagttatgtgggattcccagtgtatattgttcgccttgaggcaaagaaaatgttacgctgtttcggcacatgattttcagtacgatttctcgtttaattgtaagtcgtccggattctctttttttgtgttttaacttgggatgatgtcagtacgatttctcgtttaattgtaagtcgtccggattctctttttttttgtgttttaacttgggatgatgtctaccaagaatacatgagaaccactgaaccctggtcatccttcaattcaaccgtttgaacatttgcctgcatgttgtctgaacatccatttactggcttcctcgtggtcatcgttgttgaattagtctggtatgtgtttagaattgtacatgggactgctcgatgcatctagtatgtacggcgtcaaggtttctgaacagttgaaccaagactcggtcttaaacctacggtagatatgtactttacgttgcagcttgcaaagggcaaaggtttggagtaccccatgtatcagggcaaatgtttccagctgttttacgtttgccaagcccacggatttattattatctcgtagactctgttatccttttcaccattctgactaattcacggagctttgcaatggaacggcggatgagaaggtatgctattcatgtgcagactgcatatgtccgatgagaacaaactcgctctgtatctgtaaacctcaaactgcagagaaaccacagtagatactctcttacattgcatttggaaggtcttcttacatcgaggcaggtacgaactgtttccgttgtttggggttaggaccgggttgatgtgaaccccttccgaactgcacgacacggcggaggaaagaacagcttgcttagctagctctacctgtttgcacaccagaaagagagcgtacggtggccggaagaaatagaggaaaagacgccgtcgtcttctcgcgaacacgcggtagtcgcgtacccgcgcgctggagaaaccgtgttgccgcggcggacacagcggcagagtcatggactcggactctcatgggaatgagtataaacactggcatgaacaagttctctctgctgcaatttcttcaaaaaaatgccagaaacaaattgccagcacctaacatgaacaggcaaataaacaagtaaaaaatgccacacaaatttctgtagtatgagaatacacgcaacgaagtagttaaaaaggagaaaagaaaaggaatatagcatttttgtttctctaaacgaaacgtttcctctcatatgaaacgcattttgctgcctactccagtcacacaatgcgtgcacgatatggaatagtttatgtggcgcaaaggagcgtgtgacggtgtggagcgtgtcggtcttagttaaaactgaatggcgtttggtccgtgcctacctccatcagagaccaggaattgactggaacaaaacaattcagttgctcaaacataaatatatttataaatcataaaacattcaacctattggacgggcaatcgagtgaaattgaatgttaggtgaattcacctaaatttcggtttccacgtagcaggatagaccgagcatgggaacagagaaaaggggcgcatgaactgaatcctgttgacccctcccggttttgtctaatgaagctaactgttgtctgaagctttggcattttcagtcgtttgaatttgtttgtcctttaacataacttctggcaatctagaatcagcatcagctcttgcaactcttcacttgatatgcttctagagaaagaaaatgcaaacacaaagagatgttcacagaatttaaaagtagcaaatgaattcatacatagccagtcataaagtccactggctatgtacatcctctcatgaatgcagagtccgggtttcataatcctttttttaaaaaaaaaaatccattgttagatatttcctccgtcccaattcagattcatggtaatgatttgatttttttaaagacaaatggtgtatcttccaaaagaaatgctccctaaattgacaaacttagctagcttagttgaatgatcacactgatgtggttaaaaaccataatgaccattactcagtaatctgtaaaacacggattaatgaaacatttcaagtggctgtattaacatgtcaccatgtatttaattgctaaaagaagtcagtgatgtatagcttgtattaactgagttgctttcaggcaatccatagtggtaggaaaagtacagctactgtttggtaagtagggtctaatagcagtacctgtgatttgacctagctaattaccagtataagtttctagagtagctcacttggtttgagttagtcttaaaaattgaagaagttggtgtgagttattcctaggtttgaaaatgcgagatgtccacacatattttaccgccgcctacaaatctacaaccaccagtgattattctgaatgatcggtggtggcattatgaaagctgcagcgatcagctgaattactcagatgaaagaattgcaactgtactccctccggttctataataattgacgttttagataagattgaggtcaaacttttataactttgaccatcaataactttaaaaatatttagtttaaagaaactcgaacaacatatataaatttgtctttcaaaacactataaaaagtaaacatatatttatttattgtgtatattataatagaaaaataaggtcaaagttatattttgtaaaccgtgtcattgtccaaaatatcaattaaaatgaaaccggagggagtatttctcaaaagaaatttcacagccactgcataagatttacttcgacttagccggtattccgagcgaaagttaccgtactgttcgcgcaagtgacgaactgaatacaatggtgacaaaagcaagcagttgcataaacaacgactggactttgaataattctagttttataggatgaaccggtccttttcttgcatgattatagatcccggttagtatcaccttatcctagtcaagaatgtggaaaaaaacaattacaaaattgaaatcaaagtgacacacaaaatcaattaattattccacatgccatttggtatgaactcatgaaccataaaaaactggacctatgtatgaactacattcacacaggatcataaactcctaaatccttcaaatttaaaagaagaaaaaaaaagaatacggcgtacggttaagttcattatggtggaaccaacccacccaaattttaatcatagacttaacactgatgatcatacttacagctaattatttttttagtgacaaacatatctgtcgacagcaaaacacccgtggtgacttcatccacatgtcagtcagtcttctggagataatatatgagtaaagtatacatgtgcgttcatatgggtgaatatatgcgtgatatgagcacctatgtctatattattttctcattcaatgctttcttcgtaaaaaaaacatattgacggagggagtactacctcctttctaaattagtggtcgttttgactttcttcttgcaatgtttgattatttgttttatttgaaaaattagtgcaaatataaaaaagataagttatacttaaagtacttttgataataaagcaagtcacaaataaaataaataataattctataattttttgaataagataaatgatcaaacattacgaacaaaaactcacaacaacaaatattttgggacggaggtagtaatacataagaagaagaagaaatgaatgtgagttggcatttactttctccgtcccaaaaataagtgtacttttacactgttcacgtctaacgtttaaccgctgatcttatttaaaaaaaatttatgattagtatttttgttgttattagatgataaaacatgaatagtattttatgtgagacttacttttttttattttttttcaaataagacggatggtcaaataaataatatttctataatttttgaataacataaatgatcaaacattataaacaaaaactcacaacgataaatattttgagacggatacagtagtacataagaagaagaagaaatgaatgccgagctggcatttacttagctaaagcacagcgtttattaactcggtagccgttccgaccgtttcctcccctccctctcccgcggtttgcaaggacgccctctcgttcaaacgttcgtctgttcaaacgtcaacctttccaattcaaacaatcaaacccctttacccttctcccaacctcctcctatttgaacccttcccaccacctccagtctcccgtattgaactcttctcagctcaaagccttacaccacaacacgcagctgttctcgctgggcttctcttcttgcgctgcggtgatcgatcgagagcttgggatggcgctgctggcgcggagggcgcggaaggcggtgatggcgaaggcgccggcgccgctgctgcagaagaggggtggcggcgcggcggcggagctggcgatcccggcgcacttccggtgcccgatctcgctggacctgatgcgcgacccggtgacggcgccgacggggatcacgtacgacagggaggggatcgaggcgtggctggacaccgggcgcgcggtgtgccccgtcacccacgcgccgctccggcacgaggacctcgtccccaaccacgccatccgccgcgtcatccaggactggtgcgtcgccaaccggtcccgcggcgtggagcgcatccccacgcccaagatccccgtcacgcccgtgcaggcctccgagctgctgttcgacgtcgcggagtcggcggcgcggcgcggcgcggcggggcgcgccgccggggcggtcgccagggtccgggcgctcgcgagggacagcgagcggaaccggcggtgcttcgtgtccgtcggcacggggcgcgtgctggccgcggcgttcgagtctctcgccgccgccggggaggcgggcgttctcgaggacgtcctggcggcattggtctgcatgatgccgttggacgaggaggcggccagggtcttggcctcgtctagctcgatgggttcactcgtcgccattgccaagcacgggagcttggccggaaggctgaacgctgtgctggcgatcaaggaggccgtgtcgcgggacggagcgttcgtggacctggcggatgacaaggtcgacaaggtcgtcgacgcgctggtcgtgatcatcaaggctccgatctgcccgcaggccaccaaggctgccatggtcgccacctaccacctggcgagctccgacgagcgcgtcgcggcgagggtagcatccacggggctcgtcccaacgctcatcgaggccctcgtagacgccgacaagagcgtgtccgagaaggccctggcggtgctcgacgcaatgctcgcctcgaaggaaggccgcgcgagcgcgcggggccacgccctcgcaatgccggccctcgtgaagaagatgttccgcgtgtccgacgtggccaccgagctcgccgtgtcggcgatgtggcggctcggctgcaaggcctcctccggcgacgaggaggccgccgcgacggggtgcctggtcgaggcgctgcgtgtgggcgcgttccagaagcttctcctcctcctgcaggtgggctgcagggacgcgaccaaggagaaggccactgagctgctcaagatgctcaacaagcacaaagggttgggggagtgtgtcgacgctgtggatttcagagggctcaataggctgtcatgaattgagatcagtgttcagaatcattgtaaaaatagttgcgagcagctaggaaatgcagattgtaaaaatagttgatggggatttttgcggatgtgctttccatgctagattgtaaatctaattgcaaaaacaagtttcctactttcctcactgtaaatattttgcatgtaaattccttcttttactgcccatttgacttttgcacgatttttttaaaatatatctgtcgttgtttttgtggatgagatttttcacatttcgagccaacaacaatcaaatttgatgcataacgttcatttgtcctagtgtaaccaacaccaaccggatcgccgttttcaattaaaaaatgaatttgagtttttattatccactaaaatcaacattccagtcgtaagaagaatcttaaacgttgaacacctgttcctccaacccaacctgcatgaggcaggtacaagttctcagttctcacctttgaaaacttcggttcaagcttggacgaaagcggctgtggtcggtcgatccgagcgtgacgacccggttgacctccacggctcatccaccgcgcgcagcgctcagcctctcggtcaggaccgcgcgacaccatccagaattttgacctctcctcccaacctcgagcacgcgctatgcatctgcacgtgaaaccgtgatatttcacgccgcggcgcgccgcactatgctcctcgacctcgacggctggctaagccgcgttcaccgatctgctctcctcggccggcgcggcgctagtgtgtgcagcgtactcctcgacagttgtggtggtggattgggtggataagctcatacgcacgtacgcaacgtgaaacacgaccccgggggggggggggggggggggagtgttgccggcctggacgtccctctcggcacacgcggcggctctccccgggaaattattctaatccctcgaggggatgttccctcgtttgctcaaaaaccatctaaacagttatgaaaaacttgataacattcatacaacacacacatatatatatgtaggtaaattaactggtgctacatggagtatgggctccaagattcaaattgagtatatacccaatttgaatgagtatgaatttttttttgtaaatgtttagatatgaacattaacttctttactaacaagttcaaacaagtttgaactaagtttaaactttttttttgttagattttggttctagatatataacatccaaacatataattcattaggtatgtaataatgaattgtgaaataaagttgagtttgagttgttttgttgttaggtatttgtatgaatcaatttcatatacctaggtatatactcacaatttgaaaatttttaaaaatttgagagaatttgtgtgttttataccttggcccgggcaccatggagtcccatatgggtatcatatatatatatatatatatatatatatatatatatatatatatatatatatatatatatatatatatatatataactccataaaatcttaagtccaaactcaactcacacgttgacatataaaaaagacaaattcagcatatgaataatatcgcactgtgtatatttaaatttgcctttttttttctcgatgtgtagatcaaatttgaatataaattttgggggactagtaggtatcattatactttacattgccaattttttatagaaattttcatagctatttatattaaatttgaaaaaaaaaattatgtacgagggatgtcccttcaagagattagaatccactcccggctctccccaccgcgccgcccgcgctccagccagccgaaccgcggagcggagtctggtcgaccgcgagtagaccgcccgtcgccattctcccacgacgcggtcgccggtggccgtttgggccgcgtctcggatctgagtcagaatgggcctaatggagagatgggctgtacggagatggacgttcgactcggtctagttagactgggccgcaggtcaataaaaccttttgcctagttgtagtccggtattcgtccgaagaaaaagaggtaaattgcagtattgcaccaagactactagagtaataataacgtaattacagatcaaggttgggattttgtaattacgtccaaggttgaaaatcccaaccatattcccgtgaggcgttgctaccggaattcttccaattttacttgctgcattcaatgttttaatacaaaaaaaaaacttatgtgcactcaaggttttaataaaaaaaacttatgtgcactcaaggtgtatgataaagtagatttacatgagtagaacagaaggccacagctctttttatcaacaactcaacaacaattccaaaataaacagctctaacttgtcgtctcagagagctgaacccaaccaaaagaacaagcgcccgcaggcccagcccgtttagcccacaagaaaaagcaaaagacaaaactagaaaaaaaaaagagaaaaaaaagaggaagagtgaagaaaagaaaagttcatctcctcctctccttatcccttcccttcaccaaaacccccccgacaccgagcccctcctcctcgacctcgccgcaaatcctccgccgctcctccgccgctagggcataaccgcccgcctctcgccggcatccgcatctcccggtaagcattccgtccgagtctccacgtggtcctcgcggccgccgccctgcgccctgtccaaattgggtcggggtttctgatttgattggttggtccatgtgttaggggaagggaagggaagggaagggaaggaaggaaggtgagggcggatatgtcggcggcgccgataccccgcgagtgggtggggctgcagcagtttccggcggctacccagaccaagctgcacgagctcctcggcaagctcaaggaggaggtattacacgcctatgcaaacgcttcttttatggactggttaatggattggcgatgattatatatatcccgctcttgttttacgttgttagtaactggtggtaattgtgtgttttgttactccgtctgtgatgtgattgtatgttttactgctttgtttgtgatgaagaatgtgagcacattgacaattctggtgatggggaagggcggggtggggaagtcatccaccgtcaactccatcgttggcgagagggtcgctactgtcagcgccttccaggtaatgcttcttccaggtctgatttctattgagcccataaccgaagttgcgtacttatgggtgtgttgatgaatgttttcctgtacagtccgagggtctcaggccgatgatgtgttctcgcaccagggcaggcttcaccttgaacattattgacactcctgggctcattgaaggtggatacatcaatgagcaggctgttgagatcataaaaaggtaccaatcttgagttatagcgatacttgtctttaatcaatacagttgcttgcatgtaccacaacatcttgtttaggatttgagatggtactataaccatactaaggttgccattttgacctagggtcaagggcggatcgatctgtagtatattttcttggaattaggagcttttatgtactgaaatcggcatcatatttatgggcgacacatctcagaaacattgttttagtttgtgtttccactttgccatcctgtggtgtaagaacgagacaggaggtgattttatattattcttgattttacaaacagaatctagggtgctgtctgaagagtcttgatccaatattcatgttaaactgtttttttgtgcactatactcacattactctgaagataacctgttggctttgtaattttgttatttttttaatatttgtatgattttctggatattccagtttctgtaaggctcccatcagatggcctaataagccaaagaaaaagccaaaatttgaattttcaagcttaattttgagattgattttgagatattttcaacgtagtttctttttcaacattggcttttaagtcacaaagaacacatttataaaagttttacccacaaattcatttttatttcctaataagccgttttggcttattaggaaataagccaaacgatggggacctaagggtataatagtctctaggagcaaaccctgatggttgattggttaactactgttgactgcacatcaatgcaaaagggaaatggatgactagtaatggaggcgaaaaatagaagtgcaactcacaatgttagagagagtgaatcaggttgcaaggagtgacaaaaggaaaattctcttaattattaacaataactattatgaatcaacacaacttttctttaggttgctgctcataaatttgaccttcgcgaagttttcattatgctgtcttcaaaagttctattcctatacaagtcatatgtgttatctactgtatcgcaggtttcttctgggcaagactattgatgtcctcctttatgtggatcgattggatgcatacagaatggacacgttggatgatcaagttattagagctgtcaccaattcatttggaaaggccatttggcgaagaacattggttgtattaacacatgctcagctctcaccacctgatggacttgactataacgatttctttacaaaaagatctgagtcacttttgcgatacattcgtgctggtgcaggagtcagcaaacgagaacttggggtaatgtatacctcacttgtcttttatatgggtattatcggcatatcaagattttttttttttttttgcaatttatctgcagcttcctctgtctaaactaatattttttcttcatgtgtattatttgacatgctctttcagaacaattattcattttctgtcctgtgttgttgctgtttctttgctgatctggaataatagaacacatagtaatctgtcatttcccttctccttgggtctatttattttgctgtgtaactaacacactctcttcagttcatctgtaggttatgtatttatgtgttaatattattctatgaatcaaattatcttttgaagtcactgattttgcatgctaaccgacgtccaatgtttttttaccttgaaatttagtattcatgttatgaacctgaacctccgcttgttttggttacttatagtgtctcagtcaatgatactccctcatgggtctactgttgcttcaaccttctgggttcttgagtggctagctttaaattgtacactttcttatgtttccaacttgtctgtttgcaaaatgctacaacaatatggctgtttgggtgctaagtttctggggaaacgtggtactttccagtttgcactctccaacacgagatatgcatatgtcacattgcatatggcaagtatacaaaattacagatggagttgaactctgcagaaaaaagaaaattctcatcactagctaaatgtgcatcagtcttaggttacacaaacatctttttctccaacctgcctttttgctttctggcatgctctcagctaaatgtatatggtgcatcactcttaggttacacaaacatctttttctccaacctgcctttttgctttctggcatgctctttcattgcaaatggttgcagaattaacctgaactttttatttctctgtgtactacagaatctgtttggaaatatattatttcctcaggtgtcacaaacagttgtgcttttaaaatctatagtcctttttctatactaatgttaattgtaataacattctgctccttttaggattttcccttgccaattgcattggtggagaacagtggaaggtgcaaaactaatgagaatggagagaaggtttgactatctcatcatcatgtttggcttgtatttgaacatgtctagcttctaggtaattgaggatgccatacaactgtatcacaggttctccctgatggaactccatggattccgaacttgatgaaagagattactactgttgtctcaaacgggagcaaatccattcatgttgatcaaaagctaatagatggtccaaatcccaacaatcgctggaagatgttcataccgctcatccttatggtggaggttagctcctttaaaacaaaacagttctaaatctaagcacagcattttcatcttttgcctcaacataatgcctcacttatgtttaccatgctcttctccagtactttttggttgtaaaaggcatccgaagggccattcatgctgacatatcaaacgggaagctagatgactgggaacagcgttacagagacttggttggaagcaaggacccggtagaccagaaaggttcatcatccggcaaccgcaaggcttgagctgaagaatgataccgcatgcatcgtgacccattcaattctctgtgcttttctttttgcgctctattccagtgatctatttgggaagctttatagagttatctgggacaatttgagcaaatttgctcttgtttttagttgctaaaaaaactgtactgaatttttttgtgctgtcgcaattttgcaaatgttgttgatcgaaacttcagttatttgagttccttgtgatgttccatagtggccgcctgaccatctggcacctatgtattgttgtgggcttatagcaacatggcagatccaacttcgaagcagaggtgggcttccattgcatgctctacaacgaggtgtttccaaacttccaatggaggttggctcaggcaagttagcccgtgcaggtactggactactggttaatgctgagtggtatcacaatataagcaagcaaaattgactgtaatcacaatatacgcaagcaaaaattaggagttcacttcaagaaacacagtgatcgccaacaaatctagtcaggtactcggggtcgtatgggcaactatgtgctttatattgctatcaatatcgattttaaaactgtatttcggcataaagaatggccaaagaactagcttcaaattgaaaccataaagcattgcaagatgnnnnnnnnnnnnnnnnnnnnnnnnnnnnnnnnnnnnnnnagangggtatctattacatg
